United States Patent 7,365,185 (GENOMIC PLANT SEQUENCES AND USES THEREOF) - sequence listing, part 73

SEQ ID NO: 74982 - DNA, 10838 bp, Oryza sativa
gtttggctccaccaccaccagatccggccgccatggcatcggtgccgccgttgccgtcgccgtcccacaacagacaatgacatccttcccgccggcgccgagcgtcgccggatgcctccccgccagatccggcgcagatctggtggcctcgtcctccgcagcgcctctaaacttcgtcaccaccctcgccaaacgccactgctcgaacacactaccacgccgccggctacctccccgccagatccggccagtcggcgcggatctgggcggtttccgcctcccgatgctaggcagtcccccctgcccttgtgcagtgagacggagcgaagctccgccgccaccatccttgtggccgcgtggctttgcccgtggccgctcgggcagcgtcgagatggaggaggagggagggagctgtgggcgataacgagctgggcgcctcccgtgtcacccgcagtttatatctcaaatagtaatgtttaagcaacaataaaacatcttacaaatgaaacaaataatcacacttaattgtaccaacaattggtctcattatcttttacacacatttgattttggacacatcgaattcattagagggcaaaatagtaacaaaaggcagttaaataactaatctaaacaacacgaacattaacaccatcaacgaataataccggagagtccccgcaaaaaaaaaataccggagagaaaaaaattctctggtctctggtcaaaaatggcgagagatgcttgtatcagcacgagaaaattattgcacgagatcaaagataaaaggagaggtaggtgtcctgtttttaattgttttgctaatgataatgacgatacagaagatggattaagaccttaattaccatgtacagggcataattgtgtgttcatactgattgaggccgacatgaacggctacgggcaccaaccaacgtgccgtctcaatcgcatcattttccactgccgatttgggatttgttttttgcgtgataacaaatctagcaaggagatgcctaaccttgcaaaaaagacagaaaataatcagctctgaaagtgttatctgatttactacataataacaatataaaattaacggtctcgttgcaaggaccacttgttgatttctttgtcaatattaggaatactagcatattgcccgttacaaagggattttaattaaataaatttattattaacatgttattatcatctcgtaatcattgtacatgtgaaccttattaaatctatatttttttccttcccaccaaagtaagagttggtgagagtagttgatatatgagcactctaaccctacatgtctttttttttttgttaaaagatgggagttggcattggggtggtggcaccactactcccttttacaaggactcaaggatagatagtaatgggatgataaaaatactggtatgagataaatacatgtgaaaaacatagaaacaatggagaaacttgtttaaaacgtataagaaaaacatagtattagaaatatgtttttttttcactaagatacttaaccatatcataatgtaatcttgtgatacctacttgaaaaataaaaaactatccgcttgtgaaattacttattttattatacataggtactatatatatatatatatatatatatatatatatatatagatagatagatgtgttgtcggtaggcaccaccatacaccgatggattggataggatatcaacgtttttctttttcaagttagataggagtccttaaccggttcacgttctctatcgtaatggtattatcattacatctattataatgatttttcgttatatagatattatattagtagatcctcacctgtacttaaccatatcagaatgtgaatcttgtggtggtctacttgattttgttttatttttaaaaaaatctaacccaagtggtgcattacactgtagtcctcaggattgaaatggacatgacggcataagacggtacgacctgcttgcgacaggatcgtcttaactttcacctgcaatcttcagttaaaaccgtgacaaaacacatgtctcacctacactctcatgccttctcaaaaatcacaacctacttgtactactaactacttctacttaaccatcaaactgcaaaacctgttgcagaattgaggaaatttcagagcagagagcccacagttttttcgttttcgccctgcaaatgctcatcagaatctgccaagaaacggccacctgacgcagacttttctctgaacctctagtgtgccgacaactgatcactgttcctgctgctgattagtaggaccaaacctagctaatgcatcacagctagtatgtgtgtgttaagcagtagcagtaatctacagttaggctaatctaatcttaatgatcaagacacgcatgagtgagtaacaaaaaatgcattgccttggcgtcactcaccttacaaatttgggaagctttgtgggggcgtgtcaatgtcggcacagttttgtgagctgcgtgaaacaggcagtactgttatattcagaattctgaggaagagattcggatttcagatttcatgtgggtactttcttcatcccagaatgtaaactttcttcatcccagaatgtaaaattaaattaaaaggtattataaatagtcgagataagttgataagtatagaagttgttatattatgtgataaattttaaatggtacaagttgctatattctttcgaaaaaagtactccctccgtcccaaaaaaagacaaaccctgatttccgtgcccaacgtttgaccgtccgtcttatttaaaaaaattatgaaaaaaattaaaaagacaagtcacgcacaaagtattaattatgttttatcatctaacaacaataaaaatacgaattataaaaaatttcatataagaagtacagtcaaaattggatacggaaatctaggatttgctttttttttttttttgaacggagagagtatattctacttactgttggtacttcacacctcttgtttgtgtcaccatgtgacttgtgtcactgagctgagctcatcttgtgcatgtttccaggtttggtgcctgcaaatatgcagtgcaattatgcaggtttcaattcttgccatgcagagagatgagtagcaaagatggggctttctgggtcctggatggatgactgaagatttcactgttgctgtgaaagtctggtgatcagacatgagggatcatattgatatttttacatggggatggctaccataccacagtagggcctgtgtcaggagtggtacatgatgtgtgcaggctttgttctggggtgtgggccctgtggttggggtagatatttgtgagcatttgtggctgacagtgagggcccaccatggggatggttgttgtgtgcatttgctgtgtcattgatgtaagtcatttgcctgatattgcaagttaaaaagaacagctgtcttttaccatgagctttgaatgtgaaatatcgtaccccctatgtaaaaaagaaaaaaaaacaatcctacttaccaacctagacatatttatgttcagattcgtagctagggtttatttttttagagtagtacaacttatatactcgcatggattgtttaagttattgggttttagaggtaaaacgaggagatgatttctggatatttggtggagttgtgagtatatgtctcatccactatgttcgaatttgagtgcccatactgaatatttggtttcctagccttaataaagaattgtttgcatgtcttaaatgtgaaagataagatgaaggaacgtattacacatgaaagttacagaacatataaaaatttattaatcaaatgggatgtttgggactcgatgttttggataatttaatagagtctctaatatatatgcctctttattttcttttataacaatatatttgtaaaaactatagctaaatgaaagtgttcttcatgataaatcttctaatattatttttcacgtatttgatcataatattatttttctattaatgacaagattttaagatttaactgcatggcattacctactctttttatctaaaaaaatcaagtatgaatctaaatatagtggacgaagagcaagggcggagctacataggagaaggggtgcccagaaatccggtcaagaatttttttttaagctatagttcatatatttttgtcatatatgtacctctcaatccaaactcaaacattcgtatcagcctaaatctatctaaagtatagtaaagtaagtgagtggtacctttctttattttgttttagctccgtccctgacgcagaaagtatttgagattgttggtaaagtaggcattatatacaaggacaccatgattcacatgacacaccgattagtcattagagagagacatgagcagactgctgccacgtgctatcatcatcctctctgctctacccagtgggtatgtttcttggaccaaggtggcagcatgtgtgttttttgcttaagattctcgttagcaatgtccttaagcaatttgtacattttggccagagacatctcagagatgtgatggtttatgtgttttgtgtcagttcctgaatactgacattgagccttgactgacccagtcttatctaattcctggcacagcgatccctacttaactggcaattatacagataatttgatgccttttggtttcccaaaaaactttgaaaaaacagtagaatatgacggttttcatggttctattcttaaaatataaaatgtattctctttcacttgcaataaagaaaattgaactagtagatcaagggatacataaatcctctccaatccctggagagctcacatattcaaacgaccttttactaattataaaggcgagattatgaggaccatcaacattcatatgaattcataaaatgtataactaatcacgcatacatgatggatccaatcatccattcgtgttcagtttcgttcgtttcttcgtaggtatggacaagccttgacgtcgaccctgtcctaacacaagcacacatctggacatcctgatgactgatcactcacatggcatgtggttgatggaaggaaaaaaaaacaaaactttgttcttatcggatactagtacgtagagaattaggtgcaaattggccacaattttcttcaatgagataataataggaaaaaaaaacttggttctattctatggaagaactatcctgaagacattgcatttgaggtcgagaagatagtaaagcattctcttacctacaggggaacacaccgttatcataggctatgtcttaacctgtattttaggcaaaacacacaacaaattattattattgttttttcatccaaggcttaagccctggttgatagcctcatggacttaccatcactacaagcacgttctctaatgagataatggagaattattcttattctttttatctgtcactttttatgttttccatattctctgatatgcaaattcggcatttccatcttatgattacatcaagatatttcagtaaaactaaaatgtaatgaaagtttcagcgacaaatctaatgaaataattttcatacaaccaaccatgtagcttttaagcatattaatattcaaagtttgccggcataaattgttgaacaaccacataactcttatcatcctaattaaaaggatttttatctcaaaaaaagattaaagggattttgacaacatatttgtggaaatccaatatttcttccctttttgagaggagaagccaatgtcagtagcaggtaccctcatgtgtccaattaaagtgtatacttaagctctaataaattggttgatgcgtataactcaatgatttcgactgaacatcacataccttatgggctcttgtgaagtcagatttgtggtagcgattggaccaggagatgatcaatctcaaacagtgatcagcgtattatcatagcaattatttttctccattttgtttcatgatcattcagtcagttaggtcacttttgtaccaagttgcttgtagagaaatcaaggatgtctttgggaagatgtggcatcaacgacctgataagacgtgagaagacacacattttatggacggcgagcttctgatcaaagaaagttcagaagaatctgatcattcagaagaattcttttggacttagcacatttcacaagctacaaaatgcaaccatatctgcaactctgcaagcatgattgtgggggactttgttctgtttctccttgaattgtgtgacccaaagaggggaagatttgatgccattgaagcaagtgtagtgtagtgtacagagtacagtatactgtagcagctcacatggaaggctagtgtctttgttgataccatgctatgcttccagctgaggagaagaatcttggcacaggacaattgattctcaagtcccaactttctcttattgtagctggtcacagttccaggactgacttcagagttctagattgcgacagagttggaagaacgatatactccctccgttcctaaatataagcgtttctggctatgcacctgaaacaatacggcagatatgtgcaggtgtatagtcaggaatacttatatttgggaatggagagagtacaaacaaggagaaatcaagtgctggaattcacatttgtcacaactgttcaatattctaacctcttggatggaaatggaatatgcctttcatacttacttacactgaagatttatgttcaaaagaatgatatgtgcagtaatagtgtaatatatcatccagttacatacacaacaacaatgcatagcaaaaccttgtgttctgaactatgcaaattgatctgaagaatgcaaatctttcatcacatgaaaacaagaataaagaaaacgtttacatcacaagcaaaaggctatacaagctcggatgaggctcctctgttctttcatgacaaactcttcgctgtcccaaactgacaaaggcttcagtacgtctgctatgcacactttagtgcagttcatcttcgctaaaacatcaacattcttggcaatggcatcagagagattttcgaatgcttcggggaggtatcacggattcgtcaaaatgggcatagaggtacatgattctgttgtggccccattagtgatagcattcagagttccattgttcaagaaatttatcccatctgatcatgtgcctccaacacatataatatcacttcccattgtaggtattgtaggtagctctggtgattcatactctctactagagtcattttttatgttgttacttatgtcctcttgatcagcaactgaagaaatgatatcagattcagtaactgtactcaatgtagacgcacttttgtcactgaattgtctctggaaatcacttgcacttggctcatcaatgtccattgcttcgatgataaaaggtggcttaaatcttgagggacgtctcccctggctgccaatgctgaagctttcatgccttgtgaagaacatgtcctggtggggtattgcgacatgttcatgtagatcactttcatctgattgctcaaaaggatgatcaaacggattcctccatgtatgcagaacggatggagctgagccaggaaattctgtctcatcagaacaagaaagaatatcagatgggtttctcttgcaaaccttatcattatcgatgtctaagttactgtcaggatcaaatactatgttcttccttgatcttctcttaaccatcaagatctctaacctacgatgcctttccacctcagagtacccaagatccatgacattcttatcatcatctacggttccaagaaatgcaggatcagtgctgacattcttgtcatcgtttttgttggccttgctcttgtcagattcataattattatctctcacagttctagaatcctgaagggacatgtggttgtccgagtcatcattttggatgggatcaggatggggggaatcagcactggaaagagggtcaatctcgtccaggacagaagcaatgcgtgttctaggagtaccaggagtggtaccctctgtctgatcatgatcaaaacctggtgaaccatcatggcagccaactctaccaaatggtgaatccaaagatgagtctaatggactgtccacagcagcattgataggctctaccttaatatcagaaagcttcttcctgcgacgaacagaaaaggcacggccccatttacaggtaccagccggtttatcttctgaatctactttcatctcatcactctgtgaatctgttgatcctctatcatgacttatcttgcccaccatctcaacaacttcgatagcatcttctctggaagaattcaagccatctttgatttcaccgtcatttaagctcgccgtgttctcttttgccgaaaatcccttgtttgcttccaaatggatattcctggacaaatctgcatacttgggatccgaaacctcggcgacagatttccgttcttccttgatctcagcaacgtttgtgctgccatggcttatcagcacaccaaggataagagcggcacatatgattacaggagagtgggacagaaggaaagcgaagaaacccggcgaagatctgaatagcaggtagagcagcaggaccgggaagaggagaacccagttttcagaagcatatctgtagctcatcctgattgaacacctcaagatcgtccttatacatggcgtaccatgatctgcctcgacacccatggccttgtcctctatcaacttgacagcacaaatctagcaaagaaacaaacgaaaaaggcaatagttcagccaaaataaggatctactagcaatgaatgaagcaaagagagaaaatgttccgtccataattctgaaactctcatgctaaataattccatgctatatatactacagaattacaagagatcaattcaggtagtgcagtagtggtaagcaatagctgaaatcgaaaactttaagaacaaagatgcaatccgtataatcttaaatctcctagaaccaaaaagcgagttcagcagcagcatcctgatcatcaccatctctgctacgacattacaactgcgactgatcgatggcgcacgaaagaaagattgtttaccttcaggcggcagccggcgatccgacggtgagatcttggtccctgaggcttctttccttcagcgcgccgggaagcaatcgacaatggcggccgtcgtcgtagaaagaacaaaaacaaaggtcgcagcaaggagagagagagagcacgaggagaccagctcaagaaagcgagacaagaaagaggcaggcaagcagcacggtggtgggggcaggtggtgggtgggcccggctggtcagcgtcggctggcactgtaccaacaccgtgacgtcgtcttcgccctcgtcgtcgtcggtccggctggacgccgtggcggtggcacgtgtgcgcacgccggcggtgggcccgccgccggttcacgcgaggccaggtttggcgcggcgcgggagcgttttcccgcgtgttttggtctctcttcgtgtgggtggggtggggtgggtgagatctggattccgtttgctttctttctgaattctgatctctagctctctctctctctctctctttctttctgtggccttttttttttgggggtgaggatggatcatggacggtgccgaaaaggctctctttttagcggctattaattctgtggttctccgtcaatgcagtgctgctcatgatgatgttaacagacgaaagggatctgtgtttagtaacaccgaaaattgtgccttttcttttcttaggagggaggacaatgagatcatgtttattttgattgttcacatttcacatgataatctctactattatttttttaccggtattttggtgcgtcatccgtgtttaggtcggttttttaaatctgttcgcttttagaaatacatatccgtatttaagtcagattttaagttcgtttacttttgaaaatacaaaatgagtcgtataagaaatctctttaaaaaaacttgcatgctaacttgagataaaagtcagactcctaactacatcttatgattttctaaactaaaatatccaagcgaatttccacggtgaatttcaccctagctaaaccggataagaattacaagattaaaataatcttcacccattgcaacacgctttttttggtttctttggaataatgggcatgtggtgaaccagtcatgagtaaatgtgcttgggacaaagtctcaaaggggataattcaatccatttgtcccagacagcacatttggttggggaaagacgaatctttatataatatggagtactccagatctgattagctaagggtgctaccatgaagaaacttaaaaagtgtgtgcttctagaggctcataccacatatgtaaatatcatttcattcattttcatctagcaaaaaaacacccaatgcacctctttcctgtgcatacaaaaactcggcacaccgaaagaaggcaagaatcacaataaaagaacacaaagaaaccctatttttacatgtgtatgaacaccatctctacatcgcaaagactccaagaatacagttaccgcagaatagatcaactgtatacatactcatccgattgtatgatcctaataagctcttgcagattatcaaatacgcgccttccagagctctcagctccaatgtagttcaaaagctgctctgtatcctaaccacccagcaaggaaatgatcataataacgatcttagtttatggggaaaatagattaaacaaacattacaacaaataagcagccagaataaaacattaagggggaaaacataccttg

SEQ ID NO: 74983 - DNA, 691 bp, Oryza sativa
tcatgtaagtggctgataggtttccagttttccgctctagggctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattatcgatttttggcgaaaccatttgatcatatgacaagatgtgtatctaccttaacttaatgatt

SEQ ID NO: 74984 - DNA, 505 bp, Oryza sativa
cctctttgtttaagcttaggcttattggcctagacttttaagtcagcttattggcttatatgatttataagccagtggatttaatgtcctaagtttaatggtagagtcatacatttatctcatataagccaaaaaaagcttctccaacctagcttttggcttaatagtggtagagtggcttatggcttaaaaaagccaaatgaaaaaacttgcctgttttgttttggcttagacttttcgacttataagttggcttataaacctaaacaaagagggccttagttgtttttctccgaaacccatcttaatttggccctttggctagatagaggtggttggcgactccatatcaccgcaaggcgtttaggtgttgcgatcgtgctcgtcgacttgtcaaaaaagttgccaacaaatggttctctagattgtcacctttttaataatgtgaaggtgttggactggtacacaagattccaagttattctaggtgttgcaaaaggattac

SEQ ID NO: 74985 - DNA, 1712 bp, Oryza sativa
ctgcagccctaatttcagtggttgcttcgtatcccacagtaggtttgaggtgggtgtagaggtggtgacagcccgcaattacactgaagtcctccctgtctgggtacgcaatagagccatatctgggagcagcgggctggtcagtgcctgatgtatcgtgttaggattaaattgagctttcgccggatccacccaccgtcgcgaagccacaactacacccgagggcggcagatccggccctcctgagggcggcgccgctggatccgccgcccactgtcgccgcccgccgttgcgaagccgcagccattgccacggctgcaccttcgctgagccgccgcccgcccatcgccgcccgtcgtcgcgaagccatattcattgcctcccgttgcacgaatgcatcattggtgtggctttatgagtacggtggttgaactcagtcttgctatttccttcttttagaagtggagcgcttttgagctgaagacgaagttagaggaccgaggctcaaaccccagttgagttttgtatgtggagtggagctgaagccccgctatgatcgcctttttccgttgctgctgctttcttttcggtgtgaggactaagcgcctcttctgtaagtatgcacgctttatttatgtttgaatttgtatattaatttgtcgccggtggcgagggtgggtgtgatggacttgggtcgcccggggtgtccggttgtccagcttccggattcactgcggcggacgaggggactgcctactccgggttaggggtcggggtgaaaccttagcatggtgtggatggttaggggagggttattcgaagggtcttgtcacaatcactcgacatggtgatgtgcccgcgcaggcatggtgacatgccggtagattgtgtcttgtgggtacagttgtgcacctttggctagagtaaaactattcgaatagccatgcccgtggttatgggcgatcgacaaggaattcaccttcgcgatgattagtgctcatccccttaataattggttaatgaactggtgtagttcaggtggtttggttgggcctgttcaacgtggtgtagcgttgatcagtagagatttattattatcttaattaatcaactgttttaccattttcaactataaatgctttacaactgcctttatgcaaatagccacaaacatcctttgcctcccgttgcatgaatgcatcattggtgtggcttgctgagtatggtggttgtactcagtctttctatttctccctttcagaagtgtagcgcttctgagctaaagacgaagttagaggaccgaggctcagaccccacttgagttttgcctgtggagtggagctgaagccccactaggatcgccttttccgttactgctgctctcttttcagtgtgaggactaagtgcctcttctgttagtatttacgcttttattgatgtttggatctgtatattaatttgtcgttttgtgtaccctggctgattcctggacaaagatttaatacacaaaatagtctggaaatttgggctaaatttctcgatgtgacatcgctggtcgtcgatccaacgtggttgcctgttggtatttcttaacgatattactagaaatattcattcctagaaatggcgacaaaatagtcctggtatatttatggctactgttggtatttcttatgatcacagatagaatccgcaagcgcacggatataccg

SEQ ID NO: 74986 - DNA, 6533 bp, Oryza sativa
catgtaaacattggccagcatcagctattcaacttatcagctactcattcaattcctcacattattcagctcctccatgaattcagcaaatgagtcaacctgtctcaatcttattctgttgagcccgtccttttactatgcacatatctcatatgccagatcctcattttcccccttcatttgaactgtatatatggcaccaaggaaggcctctttcagtcatttgtcttgaggtcagctacttgtcagtcacgaggtgagattgaaacaccccatatgttgtgtaatgaaagtattttgtctatttcatatgttgtgtaatgaaagtagtagccagatacaattcgaatcggagcgaatttgaaaaacccttctcggcccaagcctaaatgccttttgagagagtttaagatacaagagctgattggtagtcagcttctgaaaatttgaataaactaggttttctaccttatttagatttttgaaaaattggattctacaactacaacttttcagaatcttaacgaaaagttagattgttcagggaagattctgattctgagaaaatctaccgctgccaaaagtttctccaaccaggtcctaagtcgactaaataaccttatgccctgtttggactggcgaaaaaaaaaagaattcttgataatttgatcatgtttccatagcacgagtcacatatatacaattttctttttgtcaaaggcatatgtacaatttgataatgttggtgtcagtatcggattacgtacacgtcagcgatcctgtggcaccaaataaaaaggtagcttgaaaactatattcagttgagctcacaccgtttgtttgatatatctgggtgtactaaaccaaaggaaaatcagcaccaatcagccatcactaaatagtgccagaaagcgaccacccaattaacacgacgacaatacccccacagcggataagatctgtaacgcgtgtcctccacgctgacgtggaccgggggtatatgcacgtcacatgttccaacgtggatagttgctccttactctcttttgagtaataaactgcgtctacggtatataaacttagtatgtgggtgtaatctagtgaaaaacttaaaaatgagtatatagatgtaaaaacttggctagtgcgtgcattttggttaaaagatcaaaatattccacaccataccttttatgccatcttgataaagatctacatgtattatatgtattgcttttaattggttagttgtaataataaataatctatcgatttgaaaccaaaagatatatgattatcaaaagtaagtgcatgcaaataacataatttttgagcaatttgactaatcaacatattaattgtctcaggttatgaacatggcgaaacacgaaattgaatccatgagccaacaatctagtagttatgcttataatatcaggattaatgaaagacatatatcagtgttttttttttgactaaaatgcacgtgattgttaagttcatgtaccggtttacttatttcttgcactaaatcgcacccacttacggtgggcgcaatttactcttctctttttattcctttatttattttgtgaattgggtaaaataaaaaaacacccttaatgggctgggcccaactggactgtagtgggctaaggcacggcacgtgtacaatagcaacggtgcagcacgatatgtccgaagcatgagcacggcacaaacatggctcaaacaaacacctatagcttccctcttttgtttttaccgttatgttcatacgttgcaacgggtaaaaaccatataattagagatgtgttaggagggtgattgagaaacattggatctggtagttacgtaatcagagtggacacgccgcgtgcaattggaggggatggaagaagatgattcgctttttttttccttcccccgttcattttctttcattataaccattttctttaataaaaaagattaacataggctcatcaaagtcttgggtcatgtttgggcttcttgatcgacatgtgggccggtacaacatgacccgtttcgctagccgtgcttaacaagtcataccctaatgggtgctgtcctgttgcatattctatccgttctataaaaaaatgtcttagttcaaatctactctcttcatttcaaaataagccaagatcgtaccggtatatctagattcattgtgctacgatgcattacatctggtagtcattgatgtatagaaattaaagaaaacaaccatacaatgcgtgtaaccatacaaaagcttcaggcccagtagtgtatatgataggtgcatatgatatggtagtgtatcggtacgagattggtttattttgggatacaggagtagaagtttattttttatggcacaagtctcgttcacatttgttttcatatatttccaaaataaaaaatgtcttggaagctcgttatcgaacataacggagcgaataccaccaatagcaaaattctcacatatgagaatgaaaaaaaaacaatatttttggcgacttaaattgctgtgctatatacgcgatgagaaaaggtgacttggtcgcatgaatgaaacttataaaaagaaaaaaaaacataacgatgtgtttttcacacatatttataagcgcctgcgtttcactgtgtttttttaattaaaaagtaaaaataaaataaaaagcatatcgatttcaggactccccccccccccccccccaccaattccctccccttccccgtttcatctgctgcggccggactccctccacgaatcctcctccgccgccgtcgccgccgccgccgccgcaaggtacggtgtatgctgggtgccctctcctccgctctcctcctacggatctgctcgcttccgccttctctctgctcgttctgggaggacgtgtgatctgatggatgtttatggatggttgggagccgagggcgatctgttcttgccatgttagatctctgacgcgtggtgcgtagcgacgtgttatgttagatcccgagccttttttttttgttttttttggtctgagatttatgggggcggtgatcttccttccgcctcgttcatgaacggtttggatctctgatctgttcgttcttgttgttactacttgaattcctgatccgcgttactgcgtgcgtatcgtatccccgcgataattcagctcttcttctttgtctctgtgatctcttgcatatggtgctacaactacaagtgaagcatcgcataaggctcatttgtagatttgttcatgtctctgttgcctgttgatagtgtcatccaagtggtgttcgtttctaatgaagatgaagatgaagatgaagttgagttttaattatgacaaacttaaaagttggatttgtttgatattacaaagcaacttatatgtacgtacgaaacgtgttgtttagtagtttgaaagacgtgatgatggggattgaggtaaaatagaaacgaaaaccacctaagtctcacagtgtcgattcaattagaagatgcagtttagctagtctattagaaaactgtttattggtctcatgtcctttggggactgagtagattctacttcttatattcagccttttgccattgttatcctttcctatctgtcgtctgcaatttgtgcttccatcatatgatgggtgcctgtacttctgaatttcttgttgaacttattgatgcaacatgtttgattattgaactttgcattgtgtgtataccactagtgctgtcattctaatctttgaagcctgtattgcccttgcagagagctaaaacaagatgccggctaatggcgatggccctgccagagggagcgcagcagctgccgcaagcttgcgcaggcgcagaaccactggcggtgccggtgccggtgctagaggtggcaccagcacaatgcttcagttctacactgaagaggctgctgggtgcaagatgtcccccaatgctgttctgatcatgagcatcgggtttttcgcggtcgttgcccttctccatgttttcggcaagctataccgtacctcctccaactaggttgacaatgctattatccatgactagcagattcagtcaacagaggatttcgtttgtagagttccttcaatgcatagcaaattgctattcgattatgaaaagttttctgttatcatcatagaatgtcacatacctttcagtggagatgtttatggttgaattcttaaatgcgtcatttgttgatcattaatttgctgttgtggttattctcgcgaatgtttgtttctgcaatgaagtatgtcctgattatctgacatcctagattgattttggctatcttcagtctgatccttttgtatctcgccctttacattaagcaatggagcattgtgcaacagtacagtacatccatggcaatttcactattagggattttctccagtagaaaacaatgaatcccatacatacggatttgggttcacctgcagtcagtcattatgttataatgtattggctgcctatgcatgtgcatctgaaatgctcaaagctgtagctggcagtgtaatatggattcagaaatgctcttagttgaactggcttagtctccctgtccctaagccctcattaagtcattattcagacattgacagcaaagcaacactgttacttggcatcaaatctggcagaaagtattacaactccgtctagttatcctgtcaaaaacactatcgtattcccggttgggtatttgctgctgtgcttgttctgaagaatctgcagttgatcacgtacctggatacatatgagtcgccaatgaagctgcaaagcaaaaataactaaactcatgtgcaacataactatagttgggtatctttatgtcaccaattttattgtgaaagctctctatcataacattgttaattactccaatatagatgaggacatgaaacaaaatgcactgcactacatgtgaaatgttactggtaacaggaatgcacatctagtgcagcttaaatcgtcgacgagctcaacaaagcaatgtatcgagctaggcagctaactggatttgatatctggactcaagcattatgattgtttgggtgcccaaaaaaaagttatttgctacacaaaattgttagtacatcacttgggttgctgttgctattcaggtcatggaatgaagaatagtcatggtcttttcagacagagaatcgtatcaaccgataataaaacctcccctaaaaaagataaaatcgagagaggtccatgaagattaggcatttctgtatttctccaccttccatttcctcttgaataaattgccttctcttttgtgagtgtactctccctccaatagcttttatatgacgtttaggaacaaaaaaaaagtgagtgatttagtgcaatttttcttgtctgaaactccaaataattttgaccggagggagtacaagattgttacgacgcagccatccgttgggaaaaaaacgttctgaagatagttgaatgcaaagttcaaagtcatcatttataacgttcttctggtaaccatcttccaacagagagatttttttttctagtaatgcaatgatcaacatgataaatagtcggggtattgcccatgccacaaacctgacaacgatctggaattctaccaagatgcatttttctgccttcaaaacatttgtttctaacctttaggaatcatccagctgtggaggtatataagtagttaaatcaccctcgaaatatttagtcttaacaatttgtggccataataatccttgttcacattctaatttccaccaacacttgcaaagcaaattgatatttgaaagtctaaaggatttgatacgcggaccatcttaatgcttgggtttgcaaacaccttttcccatttcactgaaaatgccatattttctttagggtgaccaccctctcaaagaaaagccagaagcttagtcaattaaagatttataagcaaaaggatcattaacatgtgttacattggaatgctagtcaagcatgaatgaattaattgaagttattcttcctccaacagaaacatcacttcaataagataaatctagccttttggcaatttttccgacttgagaattccgaatcacaaactttcaccctggagaattcagcaggcactcccaactaacccaaacacaccatcaactcaagaaaaattattttaagcccagataattactttacatataacaatttttcatatttcttctttctaccacatcaccatccttttgccagatgacactgtcatctgcatccggtaaaatagccactcctcagatgaggaactgaaccacgcgctagattgtttaacttgttaagtctaatcagttctcaaaaattcaaaccagaaacaaacatggtttcatttctcaaatagcaatcacccactatcgaagtaatgtatagggatgaaaacggatcggaaacggatggaaactagctttatcatattcgttttcatattttttttcggaatcggactcggaaggggcgcaggaat

SEQ ID NO: 74987 - DNA, 4885 bp, Oryza sativa
aatcgaaaactcggatacggaaatgaaatcgaatattatcgaatatagatacggagcgaatacgagacggaacgaatacggtagcgaatatttaccgatatataaaaagcccctcaaattgagtttcttgataaaggaagagatatcacttattattttagttaaacatcgctaacaattatatcatcaattttgtagacggtctcacaaccgtatgtgaaaaatcgatttttattgttgttcctctaagagatccatatgcaaatatgattatcattttctattctcaagaccttttactatatgtataacttacttgccattgtataaattggagatgttatttattttacttcacatcctcgaaacttgcaatatttgttttatgctttaaatgctttcaaatacaaatgttataaactacaaagtggtagatcccgttgagctctacaactttgatatggaacacatctccatcagatatcgtttgaattgtaaatctgagattttgtaaaaattaatatggtatattataatgaatatttagacccttaaataacctcaaataataaaatagtcaatatgaaagttgtagatctcatcgagctctacaatgttgatataaagtttgtcttcatctgattccgtatgaaaaagttatgtatatatacatgttttttctaaaatttactcaatgtctgcggatatccgaaaaaaattccagatagtttccgaccgttttccgattccgacggatagtacccatactgtattcgttttcgtttccgagaaaaaaaatccgaattcgtttccgaatccgagaattttcggatagttccgaccgaaactatccgaatccgaaaaaaggtccggacggacggaactatccgaaccagtttcatccctagtaatgtagagtattcatctctatttgtgggattcagatatagtagaattggttctcggaatcgccaatacgactaggaaatgagaaactacatacactttgttactgatcacactgatctagctcctaaaaaaaatcttaacacctcatagttaatgtacgcctgaaaaaaattgcactgcaaacaacaaatggattaactgaaattgccacacaaatgccaacaaaggtatatcaaccggctggtcacaacttcacaagtacaaaagaaaccatcggcaccatcacatcacatcacatctagcttaattagttcaaagcagtacttgcaatttgacagaggcttaaaattagtactaagtgtcatcctcataaaggtagtagttagccatggattagtcaagcattgaatgcacatgagacatgaattaaggtagcactgaccaggcgatcatgaccgacatcctgcagaacccaagattgaatccacacctgcttctcaacgcatgcctaggcctgatgtccacctgtctcgtcacaatctcttcgctgccaatctctgcagcctccacaccaaggatcaggcttcccttctcctccaccaccacgacgcgccgctgcagcacgacgagtgggccactgtcgtcatcgtcattgaccaccgccaccttgccgtcaccggagtcgagcagcaccacgtcttcatcgatgccagcggtgcgagcggtgagacgggccctgaaatcggttgagccttcgatgacacgaactgcgatggtggcctccacggcgaatatcaggtgtgcgaagacgaactccattgtggagtgctccgtcgactcgacggatctccgggcgaagccagtgttgttcatgtgagctacgccgtcgtagaagaaggcgttgtagcttagcaccttatcgtcctcttcagattcagacaacggcaagccactattgttgtgggtgatcaccttgaggtcaacctcgaacatgacagggttgatcagcacgacggcacggctagggccagtgagcgtcagagatgaatcctgtatatatacatgcataaacacacataaatatatatgcacagtaagcaatatacagatcatgtctggattctgatcttacacattgatcttcagttcaaaaaatataagcaacaactgtgatccaggatgcaaaccccgaatttcagaccgataaaaccatactaactattacctccattttaaaaaggatgccagactgataaaactaaatactccatgcgtttacaaatataaatactttggacttagacacggtttccaatgtgctactttgacctgtatctataaaaataaattattccaaataaaaagagtcttatgataatttgtttaacgataaacctagcaacatctttcttacgtgatccatcattatgttctctttaacaatttggcagtcaaaactaaaaaggtttggcttgttctaaaagtgcttatatttatgatcaaagagaggagtaagctagtactagtataaatcatgggaaagataaatacgttgaatgtgatgcttgcctgtggcgaggtgagggtctggcagtcgtccctgtcgcggcggaagaggacgttcctcttgtgatccagcgagtcacggacagcaacgatgccgtagacacgcagtggccactcaaggttccccatgacctctgtcaccttgactgaaaatatttgtagcacgtccattggccacgaggatatcggcagcacaggtccatcagtgtgctgcatgggccggattgcagctgtaggcatatagatatagcactagttgaatcattattgaatacatggaatggaatttcagtgttctaaaagtccactgtgattttgtgtttgaatgtgcactaggcagctgtcctgtctggttatattgatataattctactttctttttggaaaaaagaaggcttgttaattgcttggaaagcgctagacaggtttgttataagagtttagccctatggaccaccttgcgtctagcaccttctcgaaccatgtggaatttcatagtgaaattctgtcgtgcgacctcattcctcctgacacatccagtgcagaccaggactgtttgtgtacgctcagattaacttacagcagagtggtcaatggtggtgtttgaatctcctgaagatgaatattaaatttttcacgcaaaacgaggtggtaataacgtgtgattaattgagttttaattatttcaaacttgaaaaatgtattaatctgatattttagaacaacttttatatagaaagttttcgcacgaaacgcaccgtttagcagtttgaaaagcgtgtcacgaatatctaaaacttaatccacttttttaagtggaaacgaacggagccatttgcctaataaaatttagagtgaattacgctttgggccacattttattacctaagtttcactttgaaccacccttaaacatatattttcactttggaccagatgactttgccattattgcgatttggaccaccatgaacgatttttttttcagtacaatcagcgaccttaaacacatcagctttagtacacggccgaactcctctatgtatagctcatatgtttgccgaaagggaagttagacatgatgagaaaaagttgtttatggtagtccaaaccgcaacaatggtaaatttacccggtccaaattaaaaagataggtttaagggtggtccaaattgaaacttaggtaataaaaggtggaccaaagtacaatttactttaaaatttatcttactagtatgcccaaaaaagaagggaaaaaaaactagtttgcacatgagcaaattgatggccatatatcgaaatcttgtccttaagattaagatgacgcctgtaaagaaattgtttgggcttcttgtccttaagattgtccttaagattaagatgatgagatgtgattggtgcgcaatgaattgtccttaagattaagatgatgagatgtgattggtgcgcaatgaagaagaagaagtgggggttactcactctcgtcctcaaaggaggatccgtcgtttttgccgtagttggtggcccaggtggtacggtaggagtcgaggaaattggagtcgtcgttgtagtagtcgttgtcctcgtcctcgtcttcttggcaggtggtggtggtgttgcggccgccctcctcgcgcgacctcttcgcgtctccgccggcggggatctcctcgtcggggccagcgatctggccgtggccggtcccgttccgacccgaatccacctccatcccctgtcgctcgcctcgccgccaagatcgatcgctagggttttttcttttttctttttctttccccggataagaaagctagggcttttgctcggctcgatgggaagtgtcggggaaatatagggatgatgaagaagcacgtcactggtgagatgggaagggaagtgggccgggccggagacaaatgagcctcaaatgaagcccacttggccatgggggcggttaccgattggaataagttcaccggaggtcctcaacttaacagcgagattttttgaaatcccttaaccacaaaaccataaatgtgtacccctaatctcacacaaaccgtgcactcagggtcctatggcagtatatatgggtggttttgcggacgtggcatcctagtcagtaaaaaaattaagaaaagtacgtggggcccacatatcagccgttatctcctcttttcttctccttctcttctcttttctctcttctctcttctcttcttcggtgaaggaaccggtggcgggtggagcggcgatcggcgagcgcgatgtgggtggcgggtggcgggcggagcgacggtgggtgagcgcgggagcgaagcacgcgatggtcgagcgcggcgacgggtgccaagagcgcgggagcggagcggcggtggcagcggttggcgagtgccgggcgaagcagtttggg

SEQ ID NO: 74988 - DNA, 21241 bp, Oryza sativa
ctcttggctagtggattaattggtttccggacccggaataaatcccggtctctcattgtatctatcataaatttcttactatacctgtcattcctagcccggattgaatccaagcgtaaccgaacaaggcctaaaggagaaaagagaagaaagggaaagaaaaaagaaatgtggggcccacatctctttctctcactgacatgtggacccccacatatttattttattatttttgctgattaggatgccacgtcatcaaaaccagccatatatactgccttgggacctaaattagacggttttgtatagtttaggggtgaagatttctggttttgcggttaacggatcataaaaaatctcgttgttaaattgagggacctccggtgaacttattccttcctgagcatttggaagcccacgagacggatttccctgacctaatccacgtgatatacccggggaaacctcccacgcctcacgaggtcgggaaaaaaatcctcgctgcggagccgcgtcacctctgcggctcggcgcctcttcctctcgcgagactcacgaccgcgaaacaacacctactcgcgagacgccggcggcggtctcctctgacgagacgccactgcaggcctctctccttcagacctgggccacggcgacatacatatgtatatacttcgtatatctatatctatatatacctacttaaaaaatacataaggttttcggtggtaattttcatccgtcgttttctttcgcacgcggtatttttttttctcacacgtggttttttttcttggtttttttcgtccgattcttctttttttaggtcgtccgattggtttttttcacgtgcggtttttctggcccagttttttcgtccgattttttttgcctagttttttttccgattgctttattttgtgggcccggttttttccaaaacactgtttttgaccgtgggtctcaaatttttttggtgggcccggttttttcctacctgttatttttttttgaaggatatcccaaatagaatcgtataaaattacatggctcaagaattacaacccaggaattacattcagaatccaagaataaaaattacatggaaggtatgatacaaacatcttctcaacctatataaagaaattgaaaacacaaacaagactcatatatatacacccgatatttggtgtggatattgagcaatctcttgattgacgctactcatatgcgctcaattttttttttaaaaaaagaccaatttgttgttggacgtgattctttaacccttaacaattagatttttttttgcataactttagaagcaattataatcaggatatgaatagcttgtaatttttgtaaattctgtcatattaaatgcatgtaccaggagaagaaatacaacttatttatcatgcataattaaatcattatattaacaagatgatattggcagtaattacctgaatattttttaaaaaaaatccatgacataatagtgtgatagagacataaatatatccaatctaacagtcttaatcaaccactgacaatatttaaaaactgaaagcatgcataaacttcacacaatatccttcagtagagacataaatatattcaatctaatggtcttattcaaccactggcaatacttaatacccttaatgccttgagttacagtagcttgttctgcatatgctactgtaggtggttattcatcacattcatatgccaacatggtttaaaaaaatcaaaacaataatattgactaaatatgctactttaaaggaaaccggtttcagagtttattatttctatttcccctatctttctctgaactcggtgcgcaaaagtattacttaatgcagcaatagaacacaagtgaaataaacacctatggtccatgcagaatcaacagacaataatatagagctcttaaaaattccaaagcattaaagggggcatagcaaatacagtaggttccaatttagccatgcaaccaaacttattttgaacaaaaaaaaattcacctgaatatttttttggcaaccatctcgattccataactccaacccatcaaagtcaacaaatctcatcttctgtctccttgaaaacctggcaacacacctaaacaaatataaaatatggcaagaaatacaacttatttatcatgatgacttaccttgctgcatccagatcaagataaagttgtgctgggattttaaccatgattgtgtggtgacactcaaaatcacagctaactgagtttagttcagagcatgcaagaacaacaaacaggaataggggacagcaggatgaacattacattttttttgtttttttttgtgggaacattacatatttgttggacttgatatcggagtagatcactatgaaatcaccctcctacggctcatttaaatgaacaaaatcacctgaaaaacataagacatcaatcaacaatataattgagagtgacaattttagtatggcagttactggcttatgactaaatttgaatgattcaattagttggccaagcaatcataatatctcattttccaataatgggaaaccaagaacacgagaacaccaggaaagcgagataggaggtctcaccggcagataggaactgggacgccgttgtggcctgcgggaaagcgagtgcgccgtccaacaccggcagccccaccttgccgcctccggctccgcctgcaagaaaaccatcatccagcgatgagtcagccactcgaccaagatcgtcgtaatgattaactaataagtttacacctaggtcagaaaccccaacaagcaaagaacacacatccatattgccgggcccctacatacacatacacacacacaaatttatgtctaaacgtgtaaccaaataactcggaaaatgttaatgaaccaagaacgcacctgaaatcttcagtaccaccgctcgggcgctcggtaccaccactcgactgcgctctcctcggtgcaccttcgtccgcaagcttgaaccctcctctctggctggccgaatagctagcaaaactgacatgttatctaacctgccagtaagcaacaagattactcctatgcaagatgatccaaagatttcacatgaacaatatgatatattgtcaaagaaaataaagtacctgggcgaaaagattgcgatggcgcccaaaccacatgtgtcgccatcgtcgaggtcgtcgccccatctgccagtctgccaccccacctccgtccctcccatcatcacccgcggcggatcagcacgaacggagggtggagagacgacggaggtcgccggatcgacccacccatcgccgcggacggcagatccgcacaagaggggagcggagagacgacgggatccatgcaggaggggaagaggtcgccggatccacccctcccgtcgccgccgacagcggatccgcgcgagaggcgctagcggcggaggtgtacaagctgaggaaccaagaatccaccttaacgttagggtgcagatcgcacgagttgaggcatgccgactacagcgagctcatgaggttagccatctactcgccggcgtgacggtgccccggaacaagacgaccacctcgcaaaacccgagccgccgcgtcatctcgtcgggggacatggcgaagtacccgatccaccgccccccggcaactcgacgatggctccatggttgatctggtgggcaaaactagagaaggggatggagagagacggggaaagactgagagatagaacgagagtgagagactgggagagagagaacgagagtgacaggataaggatctcgcagggttcaccataccgccgataaccgcgcgggttcaccataccgccgataaccgcgcggttaccgcggttaccagacttaccgcgggggtacggtaatataaataccgcggtaacctccttaaattcaaataaatttaaaaaataatttgaatttttgataaattttgcacggttttgtacggtttttcacggttaccgcggttaccgcgcggtaaccgtgcttaccgccggggtgcggtaaccttgactccggcggtttaggaaaccctgaatctcccaggcagggttcaccataccaccggtaaccgcgcggttgctgggcttaccgcgggggtatggtgatataaataccgcggtaacctccttaaattcaaataaatttaaaaaataatttaaatttttgataaattttgcacggttttgtacggtttttcacggttaccgcggttaccgcgtggtaaccttgcttaccgccggggtgcggtaaccccgaccccggcggtttgggaaaccctgctcccaggcgatcactcatttttctcgcgtcaatttttctttattatttttagaaaaatctacgaccttagattggactgggttgtaactacatttgctgtgtgctatctctgcacacggaaaacggaatggtccattaacacgtgattaattaagtattagctatttttttaaaaaaaattaatcaatatgattttttaaacaacttttgtatagaaactttttgcaaaaaaaaaacatgccgtttatcagtttaaaaggcgtgcgcgcgaaatatgagggtgattgattgagaaagttggggaaagaactcagaatcaactcccgttgtgttgctaatccatggattgaattctgctaaaaaatgatttattttattaagtttttttatttaagataaaaagatgtttattgtaaaaaataaaatttctcacgaaacatgacatattatgataaaattacctattttaaatacattttttcaatcacacaaatttttgtccatcgactattgcatgaaagtgaccaagctattcaccgttattcctcgtttattcctcgcatggtacaatcatcgcactaaagtattatatacatatcacactaacgcatcgtgtacatcattcatatcatgtacgtaaacaggaataattgtccaaacaaaatacactttggcgttgtttagatcccctgccaaaatttacaccctgtcgcatcgaatgtttgatacatgcattaaatatagatgaaaaaaaataactaattacacatattgcgtgttgtcgacgggtgatacccgtagaccggatatagagggtattgaggtacgttggtacaaggatctacgtaatacgacatcaagcaaatagaagacgaagattatactggttcaggccccttgataggtaatagtcctaatccagttaatgtgggattatatgatggaaatcacaggttacaaagggaacgatggaactcgatgaaaccggcgagatcgtaaccgagttggttcgactagatctcctggcgacttggctcctgcaagctccgacttcgtaggctgtggtggttgtgttggctatgagattcgatgccctcggtcctcccagggggttccttttatatcgcaggtcaggcggtttccaagtagaactcggagacatcggaccctacacgatacattgacgacccagtcctgtccgagtaggactcttattctctgcaaacttcgtaaaggatttccttagtgtatgtagagaatgtccatatatgcgcgggcatgccatatcgatatgtaacatatatcgaagggtaaagggtatacctaacccgtaaccctgacagtagcccccgacttcggcttaaatgaactcgtgtaaccaatcgcgacttctgatgtcgaggctgatgtcgttttcggtgtgggaaccatagagacaggacatagtcgagaacaccatgtgaagcccaatggttatgtgtgagtttaaactgaagtctgaaagactaccgcgcgtaacggacccagaaatttccggcggccatctctctcctttccttgaaattcgcaccgtcggaagtgtgcctatttaagagagttttggggatttattttgaagtccgcctgttgtggaaaaaactttccagcctccaagcgcatctcatcttctccgctcccgcaaaaaaaccctagcttgttaatctccgtcctttctccagcgatctttagtcggtaatggatctcggcaagtctacctcgaccaacgcgtcgctaaagaagctccaggaagatggcacccttcctggccatggagccatggagagagaagttgaaggtactaaacgccggcctgtcctgggtcgcatggttgtgatcgaggactacattctgtgtggttttctccctccactttctgaatttcttctcttgattttgaacttctatggcctttctttgctccatttgaaccccaattccattgccttcttaagtatctttgcacacctttgtgaagcctatattggggtatagccctttctcaatcttttccgcttctactatgaattgcgttggatggaatccaacagagtgtctggatgcgttggattccgacttcgggatggtctgaagtcgcgttatatccccttccagtgcccttcttctcgtagcaaatggcgggcaaggtggttctatcttcagatagagaattcggatcctgtctttgttgttcctaaggaacaaccagacaagatttcgtcttggaccgcaaagcctaccttgacccccgcccttcggttcttcgtcgaggccatcgatgacctccgagtacgaggtttgtcggggtatgaagtcgctgccaacttcgttggtaggcgaatccagccgctccagactcgagctcatccagcctttgactattctgggccggaggacacgacccgggtttctcctcggggtatttttcttgtgtttgatttgacctccttataggcatgctcctcctggcttaccgaattccggttcttgacttgcaggcttgaacagcgaaacggtggagcgctgcgtcggccaactgatgatcaacggcccgacaacggcaagcgacatccccgtccccctttgtgagaaggaggcggccgatcgtgaaaccgcaatcaatgtgagtgtattcggcgacccccctctattcttgctcctggatcggataacgacttcatgcggtgcaggttctccctctgactgacgtcatcggaccgctcgtggatcaccaggcggcggcctcgctgaaagagtgtgtcgcgcatggggcatccaacgcggccgctgctgctgccacagcgactagcgggagctgccccccaaggaggggaaggaagttcacctccgtacttggcagtcgccggaagggtcctccccccggtaagtttcttgagccattaaccttgtaatcggaaaagtcgttcctcaaatcatccttggtttactaaggcctccgacgcgtctccgccacctccacgacggcaaaagttggtgacgctaggcgagaagtaagtaggtggagattgagttctttcctttggttggagatctggcgactagtcttgatattcggatgccatgatcttttgtaagtgggcgccagcgaaagccgcgcaagataagtttggtgagacctccagcgtgtctcctgcaacggtctccactgacgtcgtggtcgccccacgaagtcaggaggcgacaccccacggcctgtccggtgatctcgggcctgttcgcggcccgcctgcggacgtcctcagctggggggagctccaagtcgagatggggtgcctcctcgaagctagcgctcgcggcataagttgcgagattgctgaggcgaggacagcggcggcgtcgtcggctaacgagcgcgccgacaagctggagcgcaaactggcggaagttcgcgaggacctccagaagatgagggagctggtggccggcaacgagcgacagcggcggggtcttgaggaccgcatggcggaactcgagagtaacctatcggagctccgtggctcgctgcgagtcactttcaccggcctacaccagctcgccgggcaatgtggtgtcacgaccacgatcccggcgaaccccgacgagttctcgctgacgtcttcactcgcagaactggctacggcgatggaggcgataccctccaagcacgcggcctggatcaggaaggagacatccaatgggatctataccggggcatgtcatgtcctcgcgtgcgtcaagttggcacatccgaaactcgatctccagcggatcttggagcagggggcgacgaacgacgcgcgtagaggcgtgatggaagaagtcagcgatctgggagagtctgttctctcgctctttgaagagtaggaccttagttcccctgtgtcttttctccagttacgctttgtaaaaacatttctcaacctttttgcgtgtgcagtcatcgcttcagttttccccaacattttttatcccgagcacttgttgtcctttgtagagatgtcgatgtcgaggatgtccagcagtgtgggcagcctgagtcatcagtgatccttccggatcttgcatctgagggacccacgtcgctgaacgatgtggatgaaattttacccgcgagaatggggacggcaacgactttcttaggttggtggtctcttcatcccgtttcgctcctccgacttgatcagccgtgttctcgagagagaaaagcagcttgacttagtcgtttccatattgaacagatctcgagaatgcacttgctgaccaagatcgtcgtatccaatattggaagacaaaatttaaagtggcggaactcgagagagctatgttggaagtgaagaaggagcaggccgtggaaacactccgaggtcgtgaggtgtggttcaactcgtatttgaagagttgctgcacgtccatggcccgagtttgtagagagctccgagtactccgcggagatcccgaggagtcagcggccggatacatctcatggctgaatggggcctgtactcagctcgaaggcatcggcaagcgcatcgatgaagccctgaagcaggaatgccgtcgatcgagccgatatgctggagggcatgtgttgtcttgcatacgagatcatcgtccgcaactgcacctcgagtttctccatgaagggttcgctcgttctcggaggactccggcggagatagaccacctggcgaagtcgatggcgccgctggcggagaaggtcttccagtctatggactggcgttggccttcctggtagtctttgtatcctgtgatagatatcttaggaaaaaggtgtaatatagttccggacttgtgtggaattgtaagaagtatcttgtgaaatagaaaagaaatctatcttaatgagtccttcttactctggatgtagtgtgtaagagtgcctcctcagttcccgactttagctagtcatttgagtcgtacactctccctagcccccagccttgtcgtcgaggaattcttctcggaggacaaggctcttggacctttgacctgcctcggttgagaaagcactgattctagccctcaactgtgaagttggaaagttaatttctgattacacggcttggttaatacgcacggcgagaactcttacacgaccaggtcttacatggtctttcgtctctacaggatccgacaaggccttatcggctctgggcatccccagccgaagatcccttaggttcctcggaggccttgtcaggacggcataaagggacatgaggataggtttcaacgcaaggtgtcatctgggtaaggggtcatcaggcaggaacactgtgattgtaatatgcgcctgaaaataggctttattgatactgtaaggtgtcttacaggtatggattgtattgactcatacatagaatttacgtagttggtcaatgttccaagaatttgccaactcgcggccatcgccgtctacaactttgaatgcgcctggccgcaagacttgtgtgatcgtgtaaggtccttcccatttgggtgagagcttgtttcgccctgcttggctttgaactcgtcggaggatgtagtcgccgatcgaaagtatgcgtgctcggatgcgcttctcgtggtaacggcggagggcctgttggtaactggctgctcgaacggcaactcgttcgcgatgttcctcgagtagattcacatggtcgtttcgctgcttctcctgatccttgtcggaatacctctgtattcatgtactttgatatcgtagctcgctggggagcatggcctcagagccgtacacgaggaagaagggtgtttccttgttagatgttgtcggtgtggtgcatacggcccatagtactgatgggagttcttcgacccatttcttgtcgtgtgacatgagcctgtcgtagacacgggtcttgatcccttgtagtactatgccatttgccctctcgacttgtccgttgctttgaggatgagaaaccaaagcgaaacatatcttgattcccagcctgatgcagtaatcctggaaatcggcgctgatgaactgggagccgttgttggtgatgatgcgatgtggtagtccgtatctgcaaaatatccctttgatgaatttgatggcgttgtcggccttgatttcccccgtgggtatcgcttcgatccatttagtgaatttgtcgattgccacgaataggaacctgtagccgccctgtcctcgtgggaatggcccgagtatatctagcccccagcacgagaacggccaagtaagagggatagtctggagcgcttgtgcgggtagctttgtgtgtttattgtggaattgacaggctttacaccgctggactatgtcgcacgcatctttgagggcggttggccagaaaaacccttgtcgaaaagctttcccgaccaacgtccgaccggcggcgtgtgacccatagatgccttcatgtatatcaaggaggaggtgtctaccgtcgtcggacgagacgcatttgagaagtaccccgtttggcgctttcttgtatagatcgttgccgatcgtgcaatagatttttgctttacgggttattttctcagcctctgcgtcgtcctcgggcaactcttcgctgttgatgaatttgatcagtggggtgcgccagtcgtctatggtctcgatatcggcaacggcgtgttctgcctctgtggcctccaagctgatgtcgggggtgtctgggttaatttcgccgctgacctctttcactgatggctttgtcaggatgtccagaaaagtgctaggctcgagtggttctcgtctggatgcgcgccgtgctagatcatctggctcaatattgttcttgcggtatacgtgtcggacctcgatcccatcgaaccttttctccagcttcctgacttctgcgagatacttggataattcggggttagagcatttataatctttgtgcacctggttcgctactagttcagagtcccctttcacgatcagtcgtttgaccccaagtgcggctgcagctcttatcccggcgagtagtccttcgtactcggctggttattggttgccctgaagttgaggtggattgcgtgcttgaattgatctccggaaggagatgtcaagatgaatcctgcccctactccttggctgttgagtgcaccatcgaacgccattgtccacgtttcgtcgtcgatttggttgtctgatttgttatcaggcatagtccaatcggctacgaagtcggcgagtacctgggacttgatggctgttcgtggcacaaagtggacgtcaaactggcttagctcaactacccacttcgcaatgcggccgacaacgtctttgtttctcacgacttcaccgagagggaaggaggagacaactgtgactctgtgggcttgaaagtagtgacgcagcttccttgatgtcatgattaccgcgtaaagcagcttttgtatctgtggatatcttgtctttgcgtcatggagagcttcgctgacgtagtagattggtcgttgtactttctctctcgacagcaatgacggtgctaacagaataaggcgtggcggcaatatagaggaataattcttcattaggttggggagcaacgagtacagggggggtttgataggtagcgcttgagtgcaatgaatgcctcttcagcttcctgtgtccatacaaatttgttttgcttctttagcagagcgaagaagggttgtgctcgttctcccatcctagcgacgaacctgcttagcgctgccatgcatccggttagcttttgtactttcttgagtcttttgggcgacttcatgttctcgattgctttgatcttctcgggatttgcttctattcctctgccagatacgaggaaaccgagaagcttgcccgactgtactccgaacgtgcacttctctggattgagcatgaggcgatatcatcggaggttgtcgaacgtttcccgtagatcgtcaatcaatgagtcgcttgtcttagtcttgacaacgatgtcgtcgacgtatgcctcgacgttgttgctgagctggtcgctaagtgcgccctggaccgtgcgctggaaagtattccctacggttatcagtccgaatggcatcttaacatagtagaataccccgaacggtgtgatgaatgctgtcctctcttcgtcctctttcgccatgctgatttggtggtagccagagtaagcgtcgaggaagctcaacagctcacagccggctgttgaatccaccaactgatcaattcgaggaagagggaagtgatccttgggacacgccttgttgaggtcggtgaaatcgacgcacattctccattttccgttggccttccgcaccatgactggattggctagccactctggatgaagtacctctctgataaagccagctttgagaagtttgtcgagctcttctcgtatggcttgtttttagtctggtgcaaatcgccacagtctttgttttactggcttggcatcgggtcgcaccaagagtttgtgctcgatcacctccctagggacccccggcatgtcagacggctgccaagcgaacacgtctgaaaaggttggtgatgaaggtgatgagcgcgaattcctatttctcacttagtgatgccccgatcttgacggtcttgtcaaggttggcactagagagttgaacgatcttgatcgcgccgtctggtttcagcgtcttgtttgtcttgctcactttcttgggaggctcagttgtagcgggtgggctgggcgtgtgctcgaccatgtcgaggctccgcttgtcgcattgtaccgctagcttggcgttcccttgaatagtgattgttcctttcggtcccggcatcttgagcacttgatacgcgtagtgagatgcggccatgaacttcgcaagtgcagttttcccgatgatggcgttatacgctgtatcgaattcagcgacatcaaaggtgatctgctccattcggaagttgtttgcttggccgaaagtcacaggcaacgtaattttgcccaatggtttggacgaggaatggggagtaattccatggaagggttgatcggtgggtgtcaactcgcttcgtgggattcccatcacgtccaaggtgctggcgaagagaaggttgattgagctaccaccgtcgatgagaacccgcgcgaccttgatgttccgaatagtgggttcgaccacaatcggatagcgtcctgggatgacggcagtcttgtgatggtcttcttccgagaattcaatcttctgttcagactacttcatcttgggtgcagccccctgccatgtcgaacagacttcacgttccactttcttgtattctcgctttgaggagtacactgtggaacctccgaaaatgtgcgagacgtggaggtcagagtctggatatgctgagtccgattcctgagcagccgcctccgcatccttctcgaccactcgtactcgcttgcctttttccaacgccatgtgcttctcgagcgactttttgaaaacaaggcaatcttccaaagaatgtctgtccgtcttgtgtatggggcaccatgctttctttgcgtcgctaccttgtgggtctgggcgcttgggtgggttcgcgtattctgctacgagaacttccgcttgagctttccttttcccactcttgcgatttttcttcttgcttgactcaggtgcgtccgtggctggtttcttttctcccccggttttcggcttgtcgttcttgcatctcagcgcatcgtctacgtgggtgcatcgctcaacgatctcgaataatctccgagtagttgtgatgcgtcttgtcgccaactcctgggtagtatagcgatctcggacaccggacttgaaggcgcgaattacagaagcgtcggtgatttcggggattgtatttctgcactcgttaaagcgccaaacatattccctcaaggattcacccgagttctgtgtcaacgcatgtaggtcgtcttcgatcgcgtggcgcttgtatgttccttggaagttggcgacgaactgctgccacaggtttgcccacgaagaaatcgagtagggcgggaaatgcatcagccatgaacgtgcagagccttttaatgcagttggcagataatttgccaacgcgttgtcgtctgctccggcagcgtagagtactgtggagtagacttgaaggaattcttctgggtcagtactcccatcgtacttctctattgctccgggtcggaatctccaggccatcggacatcacgaagggaacgaccgaaagctctacacctagcgctgggagcagtgggttgtcggcgatcgtgtgtccttcgtggatgtctgtctgacgatgaggatgaagaagaagatgacaatgatgatggatcgcttggttttggtgtgggattacgaggtcgtcggctggattctcgagaatcctgtcgtcgccctccgttgttttcccggcgccgatctctgttgtcctcatcgttatggcggtgtcctcgaccagtatcgccctgcatccgcctctcacgatcatcatgatcgtggcgattgtgagatgaattttttaagcctaattgtgccatgatttgacaatgtggtgctacagagtacatgtgctaatgacagattaattaggtttaataaattcatctcgtagtttagaggtggattctgtaatttgttttattattagactacgtttaatactttaaatatgtgtccgtacatccgatgtgacacgccaaaactttacacctctggatctaaacacagcctttgattattattgacatagtagactgcttaagaaatagtacagttaaacttcaatcaccgcgatattacccggtgcaacgcacgggcattttgccagtatacatataaactttgtatttcagaaatacaaagtttatacgtatgtatataaaatatatacatatttgtgtgtgtgtatatatatatataatttttgtgtatactataaaattgacgtataaaaaatgtacatatatgtgtatgtaaagtttgtatacgcatatataaattttgcatatgtgtatagaaagtttgcatacacgtatataaactttgtatatgtacatattaaaaaccgagagaaaaaaacacgaatacaaactttgtatatgtacaaatacaaaacttggtatacatactagtacaaacatcgcatacatataacctaaaaaaactggaaaaaagaaagagaaaccgaaaaaaccaggaaaaacccgaaaaaaccagaacagaaagagaacagcaaaacggaacaaaaacagaaagagaaaaaaaaccggaaaaaaccaacaggaagagaaaaccgaaaaaaaccggaggaaaccaacagaaagagaaaaggaaaaaaaaatgaaaaccccgcggggcgccgtccgccgccccctttccgcacgcgacacgtgtccaatcgcacgccctccccgcgcgactgatcgctagataggattttggcccccccccttcccactatgtatccgttccccttcctctcctctattctacgccagcatcccgattcaccgccgtacccttccgcggaggagcacaccctctccagcgctggagaaagagaacaccagagctattgaagtagcacttaatttgtagccaactaattaattagtagcactaatagtactactggatgactatatcaccatactacctcatgcacgtgcagcatgcagctgtgacatgcttgatctgaagtttctgaacttctatctgaaccggccagattttattttagaaaatagattaaaacggggcctctacatataaaacagatgtacacagccaatctaaacattattcagagttgcagattaaaatgaggtgcgagatgccaaaagcgcaagcatatctctccattattcagagttgcagatgaggatgaggtcatgaggaggagaggatcctgaattcctgattcctccagccttggagattgatgcacgagggaggccaccatcgccatcgctatgctttgcttggctgcaggaatgtgcacgacaggaatctccgtcgtcctcctcctcctcccctgcgtcatctacgtcctcttcgttgccgttccggtaggacgcgacagcgcccgagagggcgagaggtcgacccaggagcggcgtctgggtttgagagtgaaaaagacaaaaataccccaacacatataatttttcttggactaaaatatccctccacaattctactaccatcaagtgtggtggtagtagaaatacatctgaaccgttcgatcaaatgcgatcaacggttcagattattctctactacagatagaaagcactgaagtgggactccggaagttcacacacgtgacaccttttgagctagcgaaagtgttgattgagcattattagtaggattgtttcccttacaacgaaaatagtggttgcatgggggaacgagatgggaaagcaaccactttgaaaggagagtgccggagagacgacgagatcaccggagttttccgacgatcggggatgcgatagagcatgcgagtcgctgggctcccgcgggctggcggtcggcatgggcgaagacttcgcaatccacagagatttcgtcagatttcaggagggagacagggggggtgcagttcactagaggaacctcaacttaacaataaattttttttaatatcctttaaccacaaaatcagaaatatatacccctaaactcactcaaaccgtttcagggaggtcccatggcagtatcgactcaatttttacctttttgttaacataacatcctagtcaaaataaaataaaataaataaatatgtaggacccatatgtaagcaagaaaaaaaaagtgaggtcaacaatcctagtcagcaatctccgtagagagggagcggcactggcgcgcggctggaggcaggcggaacggcggtatcgacgagcgagcaagacggcggggcgtcggcggcggcaagcggcgggcaagcgttggtggagcggtggcggcgggcgagcgacggctccgggctcgggaggagcagacgggcttgggatgtggggggcgcggtaggtgagtgcggctgcagagggggagaggcggccggagcaggtgaagcggtggcgtcagagggcgagcgcagctgtgatggcggtgagctcgcggcgcgcggcgagatgcatgtgcggcggtgcagcacggctcggcaggcagcgctgcgaggtgcggcgacgcggcagagacccggcgcaggcgcaacggccatgcgggcagcacggcgagggggcggcggccgtgctggtggcgcggctggcaggcacagacgtcgcgctagtgcggggcacaattggcggtggttggttcttcggagcgacgcaggttaaggcgtgtgaaactctgcgtgggatggcgtcgctgtcgtgcagggtagcatggtggccggtcgatgcggtcgccgactcgccatgcgtaggtgacgcggtggctcaggataggggcgacgtcgtgcgcgaggctatgcggcggccgttcagcggcatcagccaggcgtcatagtggccgtgcataggtggctcgaggcatgacactgtgtagggtgcgtccgagtggcggccatgtgtggcagcgtgacggtggtggtggccatgtggggtgtaggcagcgcgcgggcacggctcgagcgatggtgtgcggcagccatgcgaggcgccgcgcggcgggacggtgcacacgggagagaagagaaggagaagaaaagggaagaaaaaagatgtgcagctgacatgtatctatattgttatagactttagtgcacgatttgcatgtgtttaggagtacacgtttctggttttgtataagggactaaaaagttgagggacctccggtgaacttattcttttccaggtcgaaaaatccccccagttgcgtctctcgtgagcgccggcgttccgctctgtcctcgcgactctgcggcggccggcggctccccttctcatgagccgccgccatcgctgcgtgacgtccccctcccacgagccgtcgctaccaccggcggcgcctcccctcctctcacgacgcatccatgccagtgccgcccccttgtcactagccgccgccggcgggcattaccctcccccgagccgtcgccaccgcagggcctctccctcccacaagtcgccgccatcgcagggcctctcgtcccgtgagacagaggtgtgtcttctccttctcttcctctccttagggcttgttcggcacgtggtgagcattttccccaggggaaacgccacctggggggtattggatgaatcccctcccatcacccaatcccctccatcccagggatttggttcccttggtcattcggaatgcaaatggcggggaaggttaacgttcacttcagacattaactcaggccaagcaacgttcaacactgatatttaaatttcatatcactaaaaatacaaagaaaactaaacatatagtcctgaaatttaaaaatagcattaccgaaaatttgaaatattgtaaataaaaaactaaaatttctggagaaaataagaaattctgaagactgtctaaaaagattatgaaaattctgaataccacatagaatgtactaaaaattgcttgcatcatatccattcagtcaccacaatcagtcacgcattcacaatacctgatttactcatttaaacatcatatccatcaccacaatcagctaggataagccactgaagactaattacattcatttcatacaaacagaaactaagagtcccaaaaatccaaattctccgtaagtgcaagagcagaagggcattactgcaaggctattagtagctccattacctgctgcgagtgaaaaatgagttatcatcagtgatctgcattaggcattaatccatgctatgaatagaactagccctatattttaattcaagaggcagaactgttttggaatatagtataaaaagtagcagaattacaaggaggaaatatacatcagtagaagagcatttccttgaacaatcgatgtcagaagggaactatttgtatagaaatatatataaatataagtagatcacattagcagtatagcatcattagcaaaataggatcagtgctcaagcttatactgagttcatggcaaagcacaaagaggccgaggggggctcctgagtatttactccgtacaggaaatgacatcgatctatctatgactagacctacagagattgatcgaaatttttacacattccatgtagtagtgcatccaattcatcccaatcctttgaattagcacatctaattaatgtcagattgctaatagtatggaaaaaagaaagaactaatcaagaattatgaactattttctccatatgtttgtaacattatgaactcttttcagccaatgaattaatcaagaacacactaaagtatccaatattcagtctaatgtaatatgcaggttgcagagtttttgagacaactttttacagaacattatctgaaatcaagaacaattaattttcttttgctagtcaaatcaaggccaaatatgataggaataggctcatgaatcatgataaagtactaataaaaagtgtctaaccacagcacaatgtataaagctgtgccctcctttgtagcaaccattattacaattatattgcaacagtgaattaggaaatttttcataaaatcgagatatccaatatatttgatcataagtcaattgttaatctaataaataagagggcaatgaaattctgttacatcactttgtaaaatgaaaattcatggttccacgtgtaaatgttaaatgagctaaaaagaacaaggatatactaaatactgctagtctgctcatccctaacacaagctctatggagaataatgaccagctattagcccagtgatttctttttttgctttaatacattgcaaacagctattgtgtttccgaagaccatatttgacaataaaatctcttaaaaatctgttaggaaacgataggcaaacaaacgataaaaaacaatagatcaatcacagaagacacgagatttaacatggaaaaccctcccaaaacaggagagaaaaaaccacgggcgccagccagcaaaatatcttcactatatctgggtgaggttacaacgccgcacggcgacttacaagaggtatatatatggtggaaccctaaaagggatgacgatccgtttcgtgggggctccgccctcgcacccctgggcgtccccaggtgcacgacccaatgggccagcttcagcctccgctccactacggcagaagctggcctttattaagtgcaaatgaatttggatcacaactcaacaaactccaccttgagacaaattacttcttatagcatgaatcaatccttcaccctgaacacaacaaagataaaaaacactttcggcgccaaatagcctcttgggctaaaccactatacaaactaagcttgagcaaagctcaaacttagcaacaggaacagactttgtcatcatatcagtaggattatcatgagtgcttatcttgcatacctttagcttaccttgcacgactacatcgcgaacataatggtacttgatatcaatgtgctttgtcctctcatgaaacatctgatccttagtgaggtatatagcactttgactgtcacaaaacaagttaatgcaagaatcaactccacaaagctcagcaaacaatcctatcagccaaactgattctttacatacttcagcaatagccatgtattctgcttcagtggtagactgggcaacaacaggctgcaatgttgccttccaactcacagcacaactaccaatggtaaacacataacttgtgagtgaccttctcttatccaaatctgcagcaaaatctgaatccacatatccaacaagccccttatcagtc

SEQ ID NO: 74989 - DNA, 2944 bp, Oryza sativa
catgaattgggccaaaattcacaagtctacgaagtgaagcaacggaggaggccactagccgaaatgtgggctggttgggtcagccctggatccctttgttgtatatcaatcgtcaacattgcaatctggaacaatatgatcacagcatacacatgtcttttcatccatcagcaattgtgacctccatatcagtctgctgtatatcaatgatgttgtgaccttggcttatcttctgccaacaggaaacaaatcctctaccgtaccaccctctagcatacggatccgcatatccatctgtcctataatataagaagttttagggttggatacggttattaagaaagtatatactcctttcgttccaaaatataataagttttagagtttgacacgattacttaaaaaaagtaggtagaagtgaatgatggaaaattgtgattggatgagtagtgaatgtaggtgagaaaaatgaatggtggggggttgtaattggttgagaagagaatgttggttgataagttgttatattttgggataaatcctaagggctaaacgttgttatattttgggacggagggagtacgtcaggttaaatgcatcagaagagactcaggattactgatgcactgtaaatatcaggttaagtgcatcagtaatatgacattcttttttttttttgagaaacatagtacaaacgtgcgcacactcacccctatgaacgcacacacgcacaccctacccctatgagcacctccgaaagactgggccggcagtaatatgacattctgatcaactgatttgagagtttacagtgctgatcgatgtatgcacactgcagatgcttcttttcaactccctgatgatttttgagcgaaagaagtgtgatgataatggatgtgatcgatgtggggaaaatgtggtgttcttgatgatactgaagctgatccattgacttgtgatgacgaatccttaatttatttttgatttgcgggtgcatggcttgtgatgatgccactctgcatttgttgcagtaataaggaacaaatgttgaaatggtcgtggcttcgtttctgaatgttgtagggttattagaaatctggaacaatattcaggggaattgttgctacacaagttactgcatacggagtacgagttaacccgttagcactactacaactaaaagcaacgatcagatgattcgtatgacaacgccgatagtattaccactgaatgaatactaacaagatacaaaaacgagcatgtgtgcataaagaatctaaccatttaaattaagctcacatcgtgtcaactcaaatttttgttactcgaaattcaaatagtaacatcaaacttcatggaaatttggtattcatctgtttcatatgataagatgctttaaaattttcaatttaaaaacatagtaacactatcaacataaaataaacgtactattaaaatattttcaatgttgaatttagtgaaactaatctgacgttataaatgttgttaacttttttataaagtcaaagcgtattatagtatgaaatggttaaaataacatacaactgagtactacttgagaagttattgattttaaagttttcaattttttttatcaaatactatcactgtagacatcaatatttataaccaaattgaacggttgtcaaatgagaaacactcaagaatcttccggctagctccacaaggtagtggactagaaaatctgagttcgaagactcacctcttctaatttttgatattaggccattcttttatattcgcgttttttaacggccgttaaaaaggataaaataatcccttgctttcttattatagggctgtaattcgtaaaaagtctgtgcataaacagcaaagtaggcccagccaaagcccaaagcccttgagggcccaccactgcaccctaaattgccatcccaaccgccgccgccgaaccccatgcaccctctccccccactcccctcgccgccgccgccgccgacgccgccgccgtcgccgtcgaatcgaaaccaccgccatcccgcatcccgcgtcggagcagcgcggggtgggcccagatctgacccagccacacccatccctgtgtcgccgcgcgtctccgtcatgcggcggggaggcggcggcggcggcggaggaggaggaggaggaggaggaggaggaggtggtcgtggaggtaggggaggccacgcccgccgggacgcgcggccgcgtgatgacaggggcagggacggcccccgtgacgatagggttaggcacggcgaccgccgcccccacgactaccgcccccgccgcaccccgtcgccgggccgcgaccaccgcatccgccgcaccccgtcgccgtatcgtgaccgccgccgcatcccggactaccacccgcgccgcaccccgtcgccgcaccgcgaccgtgaccgtgaccgccacgcggcgggacgcccgaggggccgaggcgacgacgaccgggaccgcgacccgccccgcgggaggtcgccgccgccgtatcgcggcgatgatcgcgggaggtatgacgggccgccagactacatgctccctgaccacccgtcatccctgcgtcctgcgaggaaggacggtgagttcttcggggaacccggcatgacactccgggtttgttcgacggagatgggaaggaccagctcgctgtatctggacaggaggtcgccgccgctgccaccacggccgccacctccaccagtgcgagtggcgtcgccaccgctgtacaccttagtgccacctgcagagactggattcctgacagggggatccgcgatgaaggccggcgagaactttggcacgggaagtagcaggtcgctgcttgacggcggtggcgagtttcagtaccgtgaccgtttggatgacccgtatgttgagaggagtagagaaagagagatcgacaggctctatgctg

SEQ ID NO: 74990 - DNA, 2626 bp, Oryza sativa
aagttcactcatatgtccaagacgcatatgccacaggttagtcttactaggttcatctttagaaacggcagcagcggtaacagaaccatgtaatgtacttcctctaaggacatataagtttgcagaattcatatcaccaatcatataaacgagagaaccttttgatacctttacaactccacctgaaccggagtatttgtatccttctgtatcaagtgtgctgagtgagatgagatttctcgccattcctggtatgtgtctcacatctttcagcgtgcatgtcgtgccatcatgtgtcttgatctgaacagagccaatgcccacgatctcatgtgggttatcatctcccatacacacaacatctccattctgcacagacttgtaagaactaaaccaatctctgttaatgcagatatgaaacgaacatgcagtatcaagtatccattcatcatgactagcaacacaaccagcaaaaacgacaagacaatctcctgaatcagagttttcggcactggtaacaatagaggccttaccatcagattttcttttctccttattctgcagcttccaacattcttcaatgagtgaattttctttttgcaatacttacagaactttttacttcgggacttagaacggcctctactctggctcttgtcacgatcattgctgtcgttgtaggttctttgctcagatctgcctctgacctgcaatgcttcgcccttagaggacgaggcattagactgaaccataactttcatcttctccttgttttggagtgcctcataaacttccgcaagggttagttcatcacgacttaaaagtatggtgtcacgaaaatttgcatatgaactaagcagtgagcataacactagaagacctaaatcttcatcatcaaaatgtacctccatcgacactaggtcggcaacgatctccttgaagaccgatatgtggttcaacacagaaccactctcctgtaacttgtgcgagaacaacttcatcttgatatgcatcttactggttagatctttagacatgcagatcgattctagtttgagccaaagttctgcaacagtcttttcctgcaacacttcttgcaaaatatcattagatagatgaagttggatcagcgacagagccttacgatcttttcgcttctcctcagcggtccattcagtcgttttcttcttcccgaagctttccagcgcctcatcaagatccgaagtttgcgccagaaccgcccgcatcttaacttgccacagcgggaatctcgtcttgtagtctagcagcggtagatcatacttcatcgacgccatcgtgaaaccctaatatggaaacaatgctctgataccacttgttaggaaacgataggcaaacaaacgataaagaacaatagatcaatcacagaagacacgagatttaacgtggaaaaccctcccaaaacaggagagaaaaaaccacaggcgccagccagcaaaatatcttcactatttcggcggcgtcaactttcgccttcttcgttgcccttgtgcgggcaggcggtggagcttggtgggaccttgacttggaaggtgctggacgaggagcttgaggaggagtcgacgcaggagcctgaggtggagacggtgctggagcctgaggaggagatggcggagccggaggagatggtgcatgagacgccgcttgtcgcctagggaggatgatgtaccgcttgcgccatagtataatggcgtggcttgtgtctcgtagatgcgtctcaccgtctcctccagggtagtccaactcgaggtccttgtacgcggttgccaccaactcaacttcgaccttcgagtatcctgctggaatcggcctgcagtggtaagtccccgaagggtccgttggaatagccattcccgacgccaccttcacgtggtgagaggttatctattagtaatcaacataagcagcaacttgcggaatggacaagtcaaaaatcataaaattacgagcataccttgattgataagttcttgaagggaatatgcagctcacatggtgtccgctgagtgatctcatcaacggggcaggtggtttcgtcctgagtttgcatggcttccatgctctgtgatcctacctgccccgttaaggcgcagctgctatgattgcctgatgggctgaccattgcaggaggaatgtacggctggggatcctgggaccgatatgcggacatgcgttcatccaccttccttgccacctcctcttgcatgctgagctcatagctcgataccctgtacttaagatctgcaattttcgcctcggtatctctcttgctcctcatccgactcctgtacgtgtggatgtcctccttgaatccaatcttccaaggaatcacccctttccctcgtgttcgtcctggatgctcgggagtctgtagggcaagtgacagctcgtccttctctctgtcgggtcggaacgtgccctgagaagaggcttccactgcgtccgttagtcgactggtagcctcgcgtatctgatcgctgaagaccagggagccatcaactgggttaagcgttccaccatgagcatagtaccagaacttcgatcgatccaaccatttagcggtggctggttcgatacccctctcaag

SEQ ID NO: 74991 - DNA, 10416 bp, Oryza sativa
ccctgccgacagttggtgttggtactgaacttattattgagcatttgatgcgatgcgaatggaggaacgctgtgagaaacggagatattcgaccaatgcatagtgtattaaatataaacgaaagaaacaaattacacatattatgtgtaaattgcaagacaaatcttttaagtctgatggtgccatgatttgataatgtggtgctacaataaacatttgcaaatgatagattaattaaacttaataaattcgtcttgcgttttacatgcagattctataatttattttgttattagactatatttaatattttaaatgtgtattcgtatatttgatgaggtacatccaaattttacaacctatctaaccacagccatatatgtgtgcgtcaacgcgtctaatcgaggaggatttggagctggagttgttggtgaggtggcgcctcttcatgccccctcgccggccaactactggactacgggagcaacgctttcagacttgtgcactaggcactgagacagtgactattaaatgaaaagaaaatacttcctccgtattttaatgtaacgccgttgattttttgataaacgttggaccttttatcttatttaaaaaaattatataattataatttattttattgtgacttgatttatcatcaaatgttatttaagcatgacataagtatttttatatttgcataaaatttttgaataagacaagtgatcaaacgttggttaaaaagataacggtgtcatacattaaaatatggagggagtaataatgtcagatttggttttgccacggtgagagattgtggacaaagttgtcactgttcgtcacttggacctgggctacaacacgacggggcctcgtgaaaaatgtttctcttgtgttttttgtgtgccctactactcttctactgctgccctgtgctgctgtgtgagctggttacaataagcaccatggattttgtttagagaaaaaagagtgactcatgtttacctatggcattttatatatttgagtgtttaccgtataaatcctaaaatttctctttaggttgttcagaacttcagattatgccattttaatccataccaatttttaataaagttgttaaagatgtgcatccatttaaattttttttaccaaattttagatacataagaaatcttgtcaaaacttgtcaatattgtcaagttgtcaaagtttgataaggtttattttggctataatctgaacaacccctatgctcaccaaggagatataatgaaattaataattgagcgaaatacatttttttcttactctatctgtccctctaaatataagcatgtgtaggattcaaattttatacgcatccttggaacactaatttcaatgcatgtgaatctagatatttttagccattacgatggagggagtggatgtttggagaagaaatcgaataaattggaacgaaattatttttccttaattttaatctttactaaataacctataaatacatatactccctccaatattcatattgataatcatgtaagtattttcaccaagaccgaggaatcattaacttccttatattttatttaatgtaagtatgtggtgggagaaaaaaaaatcaagaaacggtaccttgaaactcgaattaaatttaaaaatatcctgttcattcttttttctcaggaatattcgagatgcaaaatatttacagaaatatactgtcgatctcgcacaatcattacgcgtgggtgtgacgtcgcgggcggtatcgcacgaggaaaacacaagaccgcggtctcgtggaatggaagagcgggactgaatggtctcgcaaaatcaaacaacgacactatccaacggctccatttgattagtgattaattacttaattaataattaactaataataattaatgattaattatcctaattagtgattaatttcaggataattaatcgctaattaaatcggcattgaaccggtatcgatcattgcatgagcaagagcgctccgctgccgcgcggtctcgcgcgatactgcccgcgacgtcatttccacgtcacttttgcgcaacggttgtacgagaccgatggtatatttttgtaaaaaattttgcatcccgaatattcctgagaaaaaaaattgaatgaatagtatatttttaaatttaattccttgaaactctcctatgcaagaaacaagaggcttactatcccaaatgcctgcatgcatgcatgcaaactcaatttgcatacataaatgcaatgatgcagtacataccaatcgatggaactaatcttatatgatgatcaatttgaaatatctctttttagttattatgtaataattattataaaatagagggagtatttaagtactctatcgtattttaatgtatgacgccgttgatttttttatcacatttgaacatttgtcttatttaaaaaaaattatataattatcatttattttgttgtgactttatttatcatcaaatacggagggattttttttatctcatatactaccagccaaggttattgtgatataggctgtgtttagtttttttaaaacttccaaaaattccgtcacatcaaatatttggacatatacatggagcattaaatgtggacgaaaaaaaaccaattgcacagtttgcatgtaaattgcgagacgaatctaaacacgactctactacaggacgctgacgaaacttaggacgaagccggcatcatcgatcagtactgtaccctgaccatcgcatgcacgcaaacggatgatgatgttaaaatggagaagcataatcccacatggacgccacatgtgtccctcacattggtcgccggatagctgcagcatgacacgcaatgcattgtttgtccccccaaatcaaatcatcatcacctcccaaaaaaacaaatctctattaccattatcttaatatgcaactaatctcctgaaagcataaactaaaaagaaaagagtcatcgaacaacaagcagttccatgtgcaatcaattaatctgctacaatcactcatcatacaagcagttcagtttcatgtacaattaattaattacaaatcaacaagagcaagaaaccgcaaatcagcaacaaaatttgctcgaattggactcctaatttctaatttaattgctttttaaattaatttctcatgttcctgcaagctcagatctcttcctatcaccatttacaagctacagatttcccaaaaagaaccccaaaaaaagaaaaagagagagattttttttccctttctggctacgattctaccggtggtggatcggcggcgaactctccgacgagctccatctgatcctcgagatacttctgcagcagcatcccccgatcgccgccggaatcctccccctcccccttctccggccaccgtcctcctccccctccgccgcaccggcggcgaccacccgtcgccgccgacgacctcatcatcctcacccgccggaacctgaagacggccaccgcgcagcagagcagcggcagccagagcaccgccagcgacagcaccacggggaccaggcacagcgccacccacgccgccgccgccgccctccacgacggcagcaacggcgccgcgccgcccatcaccgcctccggcggcggcggcggcaagaaggggatcaagcttaatctgctcgtcggatttggatttattttcgcggcaaaagattttttgctccttccctttttatgagcgtttggttcggtttgcaccgaaagcaggagagtccgattcggaaaagtggttaggggattcttgtctgaattaagctgagggaggtgagatgagagaaaggatggggccctcgacgttttattgccgcgtcaccgtgggtcactttcgctttctcttgcttctgggagaggatcaggttaggctattctctactttcacttcaggcttccagccatgcctcacacagtcacactttgattgatttttttaaaagaaaaactgaattgctgatattttcatgatattttctgtgtctgtggcccacttaattactcaccgcgttccatgttcatattgtaatttgttttagttttttcataaattgtagaaaaacacaccaacgtctgtaacatccgattgatttcatcattaaatccatcatgaatatgtcttgatagcatatctatttgttactgtagaggttgatatattcattcttattagtggaggattttcagcacatgtaaaatgagaaaaaacttattagcacatgattagttaattgtttactattataaacttaaaaaatagatttatttgattttttaacaaattttatatttatttatttttattctaaaaagacataattgaaccatttgaaataactaaaaatgatgaaggtgaagtttgaagttgaagaaaagaacaaagcctagatataattagagaagtttgattcagagcaaaactaaaacgacataaatggaggaaataaagtaaataatttcaagaagaaggtggtagggaaatgagcattcttttacagttggtcaaatgatatggtatagaagtggttacatattttaatgtgcggaattaagagagaagatgggcttccgatcttcattactcctttcacttgtccttcaaagtcgtgaccactgaccacattatgtttctctgaaaaaaaactgaccacattatcaataattttccttttcaaaagaagtcctccaaagtagacccattcagatttcagagtcaactttagtccttttttgaaacatatttttacgttgatattaagacaaatttacataactaacacgataaattaatattttaagaaaaaaacttcctagaacaattaatttaaacaatatagcagaagatttttttttgagaaatcatatttttagaaacatggagcaaataacccgtgacaaaaatatgaaaaaaagacatgaaacgtacatgggctcagattgtggtgagtggatggtagcaatagattactctgattttgtgacattatttaagagtataaaagaactaattaaacattgaaagttaaaaaatatatttacaaagcaagacatttctgcataaaatatttttaataaaagttagaccgtttaacgatttaagaaaggtgggtagctaataagctaactgctcacaccggagttcgtcgccgcggccgccggtgacgacggcggcggctgcaagaaacggctcggttctttgcttgcttgttgctctggccttgaggtagtgaagcaatagcagtcgtaaaagcttgcttgcttgcttgtttacggcagtttacgttgcttttgcttctaccaaaagcgttcaattcgtcgccaggttcagactgacaggcgtgcccatgacgccatcatttctgttgccggccggccgaagcaaagagatggttttttaatggggaaaaaactttaccatcaccttggcatgttttatgcagtaccccatggttagctatatactactccctccatttcacaacgtaacattaaccacatacatataggccgtgtttgcatccccatgttcccaacacatcaccctcgttttccgcgtgcacatttttcaaactactaaacgatgcgttttttgcaaaaagtttatatgcgaaagttgctttaaaaaatcaaattaatctatttttgaaaaaaaattattagctaatacttaattaatcacacgctaatggaccgctccattttccgtgcgggagggattagttctcatcactggaatccgaacacagccatagatgttaatgaatctaaatacatacatatgtctagattcattaacatctaaataaatatgggcaatgctagaaagtcttacattatgaaacggaggaagtatatctgtttttaataaacaatatcattgacttttagacacatgtttgatcattcgttttatttaaaaattttatacaaatatgtaatatataaattgttcttaaaatatttttagtgataaaatatttcatagcaaaataaatgataattacataaatttttttaataagatgcatggtcaaacttgtacctaaaagttaacggtgttatctattaagaaaacggaggtaatatgtcattttcaattaaaaagctccggttactctgttttgagatatatttccttcaaaacaagacagtacatatgtgaccaaagcaacaaattatcataagcgttatatatatttcattactaaaaaaataagcgttttatatacctctacttttaatggttttatagtaaaatctgacgagcgacaaaagaaaagggcccattagtaagtaaaagaatcgggcttgtttatttactctctcgcggaaaatatattattgtaggtacgcttctcaagctcataaacgacacatgatttctcaattaactttcttcattagcatgtctgagaattttctttgaaaatcaacttactttatattatttaatccattcatttgtgccctcaaagaaattcaggggcgaagctagtatatgttagggggtgcccaggaacccggtcaagaaaattttttagctatacctcatctattttcaccatgtatgcacccctttaatacaaacttagacacccgtatcagtttaaactcgatctaaagtaaaataaattaagcaagtggcaccaccctctatttcactctagctccgcccctgcaaagaattatcataaatttagttttatccataatctatcctccaccaacactttaggacacactacttttcaaaatgtaaaaaccggttgcttgcgacatacatataatataagcaaagagaaattttatgcttctttagaaaatatcttgagttacctaaattttacactaaaatttatagtatctctgaagatattaaattttacactagaaaatatggtatctatcggtagtttcttaaggatgataaaattacccacaagcaaaggatcaaacaaagcacacctagctattagccaaacatccacatcactataattaaaataaaaataatttatataaacttgtacataagtgtacgtgtctatacatcaacgtgtatgtatatacctacaaatttctatgagatccatgcattaactgttactgtactagttggcattgatggagcgatgcatccatactcttgtgaagaggtacatgttggaggggccagcaagcacatggccatggagtaatgcattctattatttccttcttttttttaaatgtacgacaccattaatcttattatatgtgtttggccattcatattattaaataaatatatactaattatttattttattatgatttgatttatcatcaaatattatttaaacatgatttaaatatttttatatcggcaataaaaaaagataaatggttaaacattgataaaaagttaacaacgttatacatttaaaaagtgaaggtagtattttttttttcttttaaagagaaggggagaatataatagtggtacgttttaatgtagttatggacaatttcgtcaggtagggtacgtgcaaatatattgtcgtgcgtgcagcgtacgtagtgacgcagtttcatgtggcggttcgtcggtggatcacagcagtgtcgatcaggtacccatagcttcgtgtccactgcacgccaatgctaccaccagccttttttttttagagaagggtattttttatccggcctctatatccaattggatatatacgaccattgaaatagggaacttagccccgcaaacaacccaatctgaaattcgctccataggagatttgaactcaggaccttggggtactacttaggtcactgtaaccactaccagcctagaatacctagtagcatgtggcgttcttagagcaagtttaatagtatagcccactactagatccacttcatctatagctaatctaatagccaattcataccatagttgcttactatactattaatacctggccctatctgtcatacacacattatgttttggagtccgtgctgcagctggctacagatctgtagcccgatgttcttctctctctttctttatctctttaaaatatgtttatagcctgctattgtacctgctcttagctctaggccttaatcaattgacaaagctaaccatattaataagtagtaagttaatttagtaaaactgtaactaatgaaatcatcacaaatgcattgactaacctaatcaaattataaatcatcaaactgttgaagcaaaacttttcaaatgtatggttttgtgatatagagattcacatgtggtgatataactatgtagttttggggtagctagcttcatcatagctaaatatacaattttgcaatgtcatgagacctaaatccgtagttattggataaatttgactttagttttgtgatattgggccttcagttgtggttttgtcaactggcctggcccataattgttttatcataccataaaaagaagggagttattattattattattattattattttttgaaaacagggagtgtatatatgacactcgattgtactatctccatattttaatgtatgacgccgttgacttttttttcaacgtttgaccattcatcttattaaaaaaattatgtaattattatttattttattgtgacttgattcatcgtcaaatgttctttaagcataacataaatattttcatattttcacaaaaaaattgaataaaacgaatggtcaaacgttggtcaaaaagtcaatagcatcatacattaaaatacggagggagtaataaattacataggtttccatcaattttgtggaaattctatatatatatcgttgtggtgccagccaagaaaacctcaagttttattaatcctctggcaggctagagaagagctggcccattcaacctagacggcatacgtcttgggccaaatttcttagatcaattttcgcacaatcacgagcgcttacgtccatcatcctggcccaatctcctctacccaaaaagaaataggtgcactattcatccacagtacaaacgttgagtttcaatcacatccatcaactacaatactgggtagtaggcatccctcatcttctagaaccaatgcaaatgtagtcccaacacagtattgagtatggtttttgttgatttaccatccacgtggcagccaagtcactaaataaattaaaaatagacgtaaccccacatataagtgataatggaggacgagggagctcaggtcggcatcgatgatgctccgtcttcgttgcagggagagcagccatgttggaaaatgtgttagagtatatagatatgatcgtattgtatccagtttgttatggtagtataggattagattccatctctatctctttgagtttacttaagatccaatctatttaacctatatataccggcccccgaggctcaatacaacgtgtccaatattcgcagtattcttctctcatctactatccaacaaaagggaaccacgaagtgccactgtcaaggtcccctagcgccatttcctccgtgatctccaacttcttgagtggtgtcggcaaaattttgtggagctccacaagccggtgaccagggagcagcgacggaggagatgcaggtggcggccggcgtcttcacagccggtgagcctgtccatgggagaggaggtgcatgctgaccccacaaaaggaaaggagagagagagagaggagggagggagggagagaaggggcgtgcaaggtgccctggacgccgcgtgaacctcctccccctccattgctccctcattgatgcagccaccggtggagacagacgatgggagagataggggaaggggattagaggaggaagaaaggggatgccaatgagacgtgggtctcacaattttttttctaattgtaagcaccaaatgggcgccatttagaacaacgacaggatcaacatgacacgtaggcaccacatcagccaaaattattgtccaaaacatcgagggattacatttccattggttttataagttgagggtgctctatatccagttttatccagttttgcagttgagtgatgcggttgaaacttgacccctatttaagggaccttaagtgtacctttttcaaataaaaaaaatatggtattagcttttttcttctaggaaaaaatgcgttatattagttaattaaaaaatcaatatatatccatattcctatatttatttattaactagcataatgcacgtgcgttgcaacgaattgtaaataacattcattgacagtcccaatgaaataataagggtttttaatatatatttttttgcatttagataatttcttaaatatgtactttgtaacattaaaattactta

SEQ ID NO: 74992 - DNA, 732 bp, Oryza sativa
tatcagaggaagtatgacaagcagcaggagaagcattatgaagaacacgatgatggttttgatcctcattggggttgtgagttctttagattctgctggaatgaagggatgaggttactgtccatcgaaaactgccctgggtgcagtgttatcattgagagctcaagccagtcatataatatgaataatcggctgaggcaggaaagagtgtctgctcatcaaagattgggcccagtgaatcaaggtcgtggtcaggaggatgaggtagttaggacaaatcaatggtgtccttctggtattttcacgaagaaccagaagagaagggttcagaggttgaggaacagggagcattttcaagaagttgaacaggaaattaaccatcggctaaagaaagcaaagccaagacaggaatggcgtgttaagaaccaggttcctgtagccgatgatgttgcagccgaagaggcaaaaaggatggcaaaagggaagagtgttgtaacagcaccaattaacatggtctttacattgccagccgaattcgggattgatcaagtcgatgtagatgaggtagaagaggaatcggctaagttggttttgtcaccggagcgggcaatgttcgagaagcctgaggggacagagaatcagcatcttaaaccattgtatataaacggttatgtcaatgggaagccgatgtctaagatgatggtcgatggtggggctgcagtaaacttgatg

SEQ ID NO: 74993 - DNA, 1106 bp, Oryza sativa
gtaaattaatcttacaatacctgccagatcgtgcataaaatttaactttaaaaatgtttgaccaacaaatcttttaatatgaaacaagttttattttctgaaaataagattattgtatttacatttgtaattattttttatatgattataattttatacgagaaattataagtcaaagattaaatcttgaaggccatgcctttataatggaatagagagagagtagtgattaattaaattggcaatgttttctaaaaattactagccttcgtacaagtgcatcaattaatgcatacgccgaagtgtaaaaacattttcatatattgttaaaaaattaaaagtacaatacagttaattacctctcggttttcatgaaactattattgatagacctatgaaacaaacaaaaaaaaagtagtagtaaacacacttaagtaggaggaaaacataggcagtgtgactaaaaatcgacacatatgcctccagtcctacatatcacatgtcactatgtcagacactcagacgtcttgcagcatcgatcatgatcatgacgcatccatgaaccatgtagatgacttgtaatcacgagcctaggttaaccatggtgaggccggccagcagcagcacgaagagcgcgaagctcgccgccggtgaggctgtggcggccatgggcgcggcgagcgagcccgcggccagggacgcggtagcgaaccccacgccacgaaggcagctgcgacgaacgtgctcgccggcgctcgccgcggccggaggagggtcgacgccggcgccgctcgccgcattactgtccacgcgcacgccgacggcctcgtggtcgtcgtacgacggagtggtcccgcatgccgatcgagttggttgacgcacgaacgctgcactcgccaccgccggagtagccttcgccgccgccgttaggacagatcgtcggaggaggtgcgctcgccgccgtgccgcctacagctgtctgtcaagcaagcttccctgggagacgacgtcgaccgcgtgcccggtttaaatagaggggtttgagttgcgtgcatcaacagttcaaccaaaaatagttacatgcacaatcagattaattcagaatt

SEQ ID NO: 74994 - DNA, 1188 bp, Oryza sativa
atagccgatgccgtactagccgatagcgatatggtttaagcaatcggctatatgtccaatgtagataatgatataaaggcaatcggctgatgatgatgtaataaaataataatataatccagtataaaccaatcggctagcattgatatgataaaaaagcactaatccgatagttaaagcatacatcggctggaggtctgatgtcatgaaatccacaagattagattaaacagtgaaacatttgttgtcatcggctaaatccaacttatatgtatatgcaatccttatgagccgatgcaacgtccagataactcaccagctgaaacccttattggcagtcaaagagcaggctagagattatggttctaagcacgacttggtatatcaaacttaactgatgcagcactaagtatgaaaagaaacataatatctagacaatcaagccattgactgagttttcagggtggtagatgtctaagctaatctaatctagcaacgtgatttagccgataccggcagaaaccctaaaacgagaagcagccgatagagctaaattgatatgctaagactagattaacagagacatatgataaataggtaggcaaatatatcatccaaatcagagcaatccaacaggttgaatgccctgatgcagccttgaacaacgccgacgtagacgatacaattgcctggaccgacggaacattggacttaccccttcgccggagatcgaacaccgatttagccccgcgtcaggtgccaagtcccgccggtcgataaaataaagtagaaaaggtaaaaggtggcgatgcgccgaattgtattgatcgtgaggatagattacatagaccccgggtgtacatatttatacccatgggttgatacaagtccttgtcggacaagaaagaaactttcttaaagatagaaggaaaagataaagtccttataggacactaaacacactttcctaaagataaaagaaaactaacaaactattcctcattaatagataacttgccatgctgcattctctttgaactcagtctcttctggataagattcctctgattgatccgactccaccaagaacacgacatcgcggcaacttgactcccatcggctgattctaaaactttgaagtcgatactgactctaagccgatagtaattttgggcttaccaaatttca

SEQ ID NO: 74995 - DNA, 1350 bp, Oryza sativa
  unsure (1)..(1350): unsure at all n locations
atgcatgtctgccttatattatgaaataactttaaataaaagaacggtgtgccttgttttattgaatggagtattgaagttctacggggacatggaattaaggaagagactattcaattattggttttcataacccaaacagtttttttctctatcatgattttgaacaaagcccaaattttttttaatttcaaacaaaaacaagctggagtactagtaaaataaattaaatgggccaatgaccaaatgacatgccccattttcacccctcctattttctctttttcacgcatctcgacttcatctcactcttcccccttccttctttctcgctcgctgcgatctgcactggtactacggtaggtcttctcctccccccccccctttctcgagcggccgggggcaaccgccgtgaaaagccccgccggggggcgctgaacccctacggctttttccggggcgcgggccccgcaggccggccacggtgtcggggcaaaatgaaaccaatcgaatcccaaaggatttctctttggctttttttcttcccggggcccgtttggattgaaggctcggggtcgccgaagatagggaaatctgttcccgggttgggattgggttggggtaggaattttcttttcccttcccaattaacccccccgtccaagttgtgtctataaattttgggaagccgcttggacctgagggaaggtaagtttttggacaaagaaaaaactgtggggttaatttgaaaccctaatggcccccaggtttagggcaaacctccctctggttatcgccggttgctttaaggttaacttggaaaaggggttgggtggggaactctctccgggcttgagatttgcgtcaaattggaaaacccccatttcattgaatttatggacaatggttcttccattctttaagataatagccacgccgccccacgttggaaaaagaacccgaattcttgttttttcgccaacacgggccccatttcttagtgttgtgaaagcacaaggggcccttttatgggctctaccattcaatgaggttcaaaacaccattgggggggaccgtctcttatataaaacacctgatagacgtgtataaaaacggtgttctggaggggcgccaacctctttgaagggggggggtggggtggcgggtatatatggcactacatataacacacaccctcgtgtggttttaccccncacggagagaatatacaaacacntctcccgctccttacaataaaaaacacgggtggagagtggtgggagagctctcctctctctctccacaaaaagatgtttctgaatagtatgtcccccggtgaggacatacaaa

SEQ ID NO: 74996 - DNA, 1156 bp, Oryza sativa
tatgacgaataagagtggcattattttgatatgccatatttgcacttttgcagtggcatggatccaattaaccaaggcccaaaccctacccggccgtctccccatctcctccccaccgcgccccgcaccggcggcggggacctgtctccgccgttcgtcctccccacgatgccgtcgtccgctctccccccgccgccacctttcgcccttcccctgccgccttcgtgcgccatcccaccgccgccgccgtcgacgacgacccttctcccctccctctccctcctgcccgtcggagctcggcgccccctcccccttgtactctctcccttgtggcggcgtctgtgcctgcggcggtgtcggagtcggcgccggttcacccctattctcactcatctcgttgcgtagttcgacccggcgctagccttccttcctcttcagatctggagcaacaccggtggtgacggcggctaagaaagaggtgttacgggccggacgagtaggacaagcggtggggagtgggacatgggacgggcagatggcccggtgcctccttacccttcatatccccctaccttgggagagagacgggcgtagtgcatcctttccctattctattccagatactagacggatggtgattcttccggtctcacatattcacaacggcggcctttccctgcgggttcctcaaactgtgcgcttcgacttactttgaaacagtttctttttctactttcaagtttacggtaacaaccgcttctcccttttcaatattgggggtgatacccctggttgtgccccattcttctatggttcgggggttaacgttatgacttaacattcttgttaccaccggaaaaattttacatttatcaacaattttttaggcggcgcctttacccttcaaaagggggtgtttggcaaactaattacgcaggggttttattgcctctaaacggggggacaaatttgtgacaccaccacagggcccgcccatttccccatgggttaaattgaccggcctggcccgctaaaaattctttattttccgggaaaccttttaaacaaggatttttttttttagggaaagtggggttcccccgcgaaaaaaaaaaaaatcccggtattagccctaagtatccaaaaaaaatacctc

SEQ ID NO: 74997 - DNA, 3489 bp, Oryza sativa
cgcgaaatttttttttttgatgtcggaaggggttttcggacacgaatgaaaaaactaatttcataatttgcctggaaaccgcgagacaatttattaagccaaattattccatcattagcaaatgtaggttactgtagcatttatggctaatcatggactaattaggttcaaaagattcgtcttgtaattttcatgcaaactgtgcaattagttttttaatttatctatatttaatgctccatatatgtgtcaaagattcgatgtgactttttaggaaagagtttttgggaactagattgtagaggaaatttattaatccacgaagaatcacggcgtgacatgcaataccatactcaaatttcgacgtcgtctcaaatttctctgtactaatttcacatgcatttactcacgcttgcccaaaaatgaatggatgtcgatcgagtgcgtgaacgaaaatgcagctgatgagtgctacagggatccaacccgatagagctccaacaccaaactaatcaataattaaattaaacagcagcagcaaccgatcgatcgacaaattaaaacgttgcaaattgcgtgcgtgcgtacgtgagagagcccgcgtgctagcatcgaccatcattgcattcttgtgtaccatcacgaaaaagtagtggttaatcttagagaaaacgaaatggtggccggcactgctacgttgacacacatccgtatcgatctcctacgtatacggcaccacgcatatacgtatataatgataacaaagagaaaaaaacatggttttttttttgaatggttgaaaaaacatggctgttaatataaataatggaaagaaccaacaaattctaaaaagttattcataacttcaaaagagaagtcaatgtttatccctaaactttctctgtaccgttgatgtgggctaaagataagttctttttgggctaaatggttcaatggctgaacagctagctgaacttttttgtgataattagttgagagtaaaataaataatgaattaactattataaagttaaaattgtacccgagatagttttctaataaattttatactaaaaagctttgaaacaaacagtattaccgttttactcatgaacgtatgcatttatccatcaccacaccaaacataatagaaaggataaagaaaacaaactaactcttaattgttctaggcttgtcttgtgagtactcttattcaattctctcacctcctcttcttcaaccccgtggaggcatcgaggtaggaatgagttgcaacaaactaattaattgtttgtttattattgcaggggctattctttgatcatcaaacaatctaaatgtggatttaggactcggaccgcctagactggtccatgacctagaatcaaaagtcgagtatgtagtacatgtaaccatgtaaattcaagcttagttcatagtgcaatgggctggcctgagccttaggccaaggctgggtcccctgaaacagtccaaactcgatcaaagatacatgatcaataacaatcaacattaatataatactcaagcaaggatttcacctctaaattggcaacgtacatctcggaaacagatcctctggaaaactgctgatgcagtagcaaattagcaatggttgaggacccacatgttcgtgtctgctactgcaccagtagtactgcagacaatcctcactagttcacttcacactactaaattgatatagatgcttagagttccacttatattatcatatcttcctatatagttggtacccactaagaagcatttactcctataaagcaagatatgcaagaagccacatcatcaacaattttaagctattggattgcattagtatagagttatcagccgttggatcaagaagctagctactcatccatctaaattaatcattgattatttaattactcatccatttacctccctttagctcataatcatgcgtgacattgttatccattctgcacatccaaatcctcaaagatgataataatctcttttttttttctaaatacaactccaattattacataagatgtgagctttgttttgttataaacaattggataacatacaataattaggtatcattaatccaaactcatttttgaaacatgcttgagatgaagcaaagaagtgctacactacctaattgtgacgatatccaaattgtgcatgaaaattactttcatacatcataacaatattcaatgacgtttcaaaaaataaaacatgaattgtattgtaataacagaagctatatatgaagccatattttcatctattttgtatataccaagagttacatctaatcatttaaaacattgattttattcgatgataaaactagcaaatcccgcggcaagacatggggtgccaactagtttaatagtacttgtgtgtgccgtaaacactagtgaggcagcaataatttgccacatcactggctatgtcattgtgacgcgacgcgaatgacatgatatatagtccttgtcacaatatgatgttcttctacttaatacttatatactccctccgtcccgaaaaaacgaattaggacttgatgtgatatattctagtacaatgaatctgaacagaggtatgtccagatttgtagttgtagtactaggatatgtcacatctagtactaggttggttttttatggaatggagggagtaattgtgtatcactgtaaaactatcacaacaataagaataaagaatatacgtgacttaattaaagacatcctaaaagtaagttttcaaatgatttattttaaaattatatttggaagtttaaataaaactggggaaatgatgtgaccatcaagtatatgcatacaaccaagcatgagaaatataaaacattgccaaagaatacattggatgaatggaggatctacaagatattaaagtccaatgagttttggaatccaattcggtcttcggagacagcactgacttcaaacagacctagcgccttcatgccaactccgatttgggtgatcttggattttgtggaaagcttatctcgctacctttcaaacgcatccggtctcacgtccaaatttatctcaagtcaacgggaatcgccaaaacaagacaatgctgttgctgaaaccgaacttgggccttgggccttgtaatagactaggcccatctcggaagtgtctccctccacctccacgaattagcacttaaccctagctttattttcctctataagggcccctttgaatcgcaggattgagaaaacataggaataggaaaaacgtaggattttgataggaatgtaagtgtaaaacagaggattgcaaaacgcaggaaaaacacaggaatgaccgtttgattgaaccataggaaaaacacaggaattggatgagagagatatactcaaaggaaagttagcaagaggttgaagctcttgctaaatttcctccaaaatctctataggattgtccattacat

SEQ ID NO: 74998 - DNA, 1470 bp, Oryza sativa
gtttcaaagggcttcataggaaattttcctataggattgaaatcctctaaaattcctatatttttcctccaaatcaaaggggccctaaatagctttgttcattctcaaaaacaattgggttttgtttagttgaattttgccaagtgccattcaccttgtctatagttctatcgctcgattagtcggcgactattgattcagagcccccaatagctggtgtgttgatttgccgggtcgattagatctaccacttcaatcgcaactattcctttgtgcttaatcacctattcgcaatatttagattgcatcttatcttgtttttgtagtgttctctcgtttgcattgcaggaatcatcaaccgtgcgtcatggttggtacgacatcgtttgtggtgtagcgattgcacggtgtcctggacttgttctggttggtagccacgtcacaaacgtcgcactcgaccaaagcgagagttatcccctcaccagaagatcgggccacgagagagcgtcatcagaaaaaatggtttataccgatccagcaccatccatatatgcttgcagacttaccaaccaagctactcctacataataacatcgaaaaccaaaaaaaaaaaaagggtcgatcgtctacttgttgatagccgcagcttttagcttgtaaccgttactcagtcatactggtcgctggttgttgctccaccaaaaacgttacagcataaagctgcagatcggaggattttgcctcacgctagaggaggcacctgcaactgcactttgctatacccagctgatcaagtatatacatactgagcatagtagagtgtagtaggaagaaatcctcagcaaataatgcttcagcagtaatgcggcagatatgtggaccccacttgctcaaggggccacatgtcagtgactcctactgcaggagcaacgatggagaggagctggtcaatatgtagggtgtaaactatctaacgttattctaatgttatagtgttaagattgttgttcgatttgtcggttacttgatattggactagccgatacctttgaatgactccgatcggctcaagattcctgcaatgataatagatactgcatataaatagatcccccaattcatagtgtactcctattgctatcttttcttgagcttcactgctgtggtgagaacttttgttgttgtccgccaactcctcactggtctcagtgtctcacctgctgaaagttgaagatgatagcacgggttgttggattatgaattatatatatatgatgcattgtccccatattagcaatttggtgaggtgtataagtgttatttccccaaaaaaaatctctccaattattgagcttaaaaggtttaaataatgaacctacaatgttctaaccaattaccacaaaattagagtatccaatgccaaatacatgtttttaagtgttgccttataaattgcaatgttatgtagca

SEQ ID NO: 74999 - DNA, 3536 bp, Oryza sativa
ctaaaaaagctactgtaatgccgaactcgaccgagggcttacgtgtgcgccaagggggagggggggtgagcccgaactcgaccgaggctgatgccgacgctgaccgccaagacgtcgacggtgggagggggtggggcccgatccgaccccgaccgaggctgatgccgacgccgaccgcgaagaggacgacggtgaagccagccgcctttacccagctgccctgaggcctcatccaatcaagtgcttggcccagtcagtgccctgttcagaatgacgaaaaattcaaacaaaattcgcagaatttctatcgaaatcggtgcaacctgtgtgttggatggagcagtcaggcgaggtgaaataaggagtactgtcccaaaataagtgcagccatagatattcgtgtacagcgctttgaccatctatcttatttaaaaaatttataatttttttaaaaaaattagtcacacataaagtactattcatgttttatcatctaataacaataaaaatactaatcataatcttttttaaataagatgaacggttaaatgttgaacatgaacaatgctaaaactgtgcttattttggtaagtgtgtaccaccccttcatggtgatggtgaattccggattcgttgcaggaaaagaaataaggaaagaaatctgagcgactagacgagactgcaatgaatagtattttagtactcactccatacagatttgatcatactctgtttgattcttaaaaaaaaaaagttgtttggatggaactaaaattaaattttttagtccctatcatatcggatgtttgacactaattagaagtattaaacgtagattagtgataaaactcattccataatccttgactaattcacgagactaatctattgagcctaattaattcatgattagcctatgtgatactacagtaaacattctctaattatgaattaattaggcttagaaaatttgtctcatgaattagctcttatttatgtaattagttttataagtagtatatttttaatactctaaattagtgtcaaacatccgatgatccaaacaacacctaagcaaataacaccaagacatccatcattctgaaattaagggaaaagaactctgctttgggaaaacgcccacagatctctggttagctccacaaggtggtgggctaatattcgcttctttttttaaactctgctttggaaacggaagggtgaagcatggaaacactagttgaaagatccatccattatcttattttcatctccaaagacacatcggccaagtcacctatactgaaagtgttttcggaacgatcaggtctaaaacatgaggattcagtttagaaaatccaaaactcacatcacatgagccagttcagttctgaaactcttaataaaagttaaaattccaagaatctgtgtgatggccccatccacaatcttgaaagtgcataaaatcaacttaagagtacatggctgataaatccatttgtgaaactgtgtcctggtttgctgtgccaaaacttttcttcaccatattgctaattaacttatcttggagaacaattaggaaacatattcatcaaatagatctgcgtgtcaggatccacaaatagaatagtacatctgaggagtttgtcgacagtgacaacacctaattaagcaagacctgactgtagttgtattacgtatgacaatggcaaggccatgattaatataatactgcagaattaggctcactaagcttgcgctaagcacattgtcaaacataatctaatcggtgaaacaaacccggcatggaattaccaccagcttagcaagttcttcaggtttcaaacttgaaggttccgttctaaaatctgaaactcacattattagttattatgctatacgggcctgattagattccctggcaagttttttcaccttgtcacatcgaatatttggacacacgcatgatgtattaaatatataaaaaaaattaattacatagattgctgaattgcgaggctaatcttttaagcctaattgctccatgatttgacaatgtgatgctacagtaaatatctgctaatgatgaattaattagacttaataaattcgtctcgcagtttacaggcggaatctgtaatttattttattatagactacatttaatacttgaaattgaaatgtgtgtccgtatattcgatgtgacacggcagaaaattttacccctttatcctaaccacatcctacattatcgatatctctgtttcgtggcagcggtactttgttgcgtctgcctgagaaggatgaacgagacgttcaatcacacaattggctcaataccctttcgtgaagtcagcagtgacagtgagctctatctagcctctagctaagcaagctgaccttatcgtgacgacaccaggtttaccacaatagtactacggattggactaaagtcgaaattaggcttattaagcttccgctaagcatcacaaaaacatcgtgtaatcggtgaaattagtatctattaataggacaagatgaacaccaaggttacgccgtgtttaataccaaagttattctttaaacctccaacttttatatcacatcaaaacttttgaacacatgcaaacttttaactattccgtcacattttttcaatttcaactaaacttttaatttttatgtgaactaaatacagccttaattaagtttgtttctggtaatcatctcagaactcaaaaaaaaaaaaccgcctttaagctctcgacatctcaatctgaacaggacgaatgggatagccacttgcccatttctatcacagaacagctggaatgtgcttctgtctctttattggatttttcctctgtaggcagaccaaaccgcaaatgttgaaaaatatggcgtgtgtgttctatatttattcctgttatatgctttcgtacgaagaaatccttttcgaggagattttatcagaacgcaatacaattctagtaggatcatgaaagagagaaattctggagcgtacatatatcatgaaagagagaaatcctgagaatttgaactttcagcaaaattcgccatgagcatgttaaaaatcatcccacacgaaacctttaaaacatccatcgatcaccattcaccatgttgaaacctaccatttcctcccagattatttaatcgattagccacagacaagagggagttgaccccacacactcacacatgctccatagcctattgacgatatatccctttgacttcacacacggggaacgccggaggccgccagcgagagtccggcgatcatgaggacgaagagcccgaatgccaccggcgggctgacatcgccggcggcgaccatggtgacggcagatgaggcggtgacaatccccaccacggctgaagcaaggttgctgccacggccgccgactgctcttttcgcctctatcgcttcagcaacgaaatccacatcaattgtaacctgcggggattgagaataattgaaacgtgttgaccacaagaacattagttaaaaa

SEQ ID NO: 75000 - DNA, 8416 bp, Oryza sativa
attcctgcagcccagatttcgtcttgttttttcttgactttgttgctatattggcaagaattctctcacttttatctgtcaactccttaatggtctcgccttctggatgttgaagacgatagaaagggctgttggattatgaattataatgatcaaatgccccacattagttgaccatcttaaatctcagtcttccaaagagtaaaagcataatcgtagagtacagcaaatgcacgactaattgtattaagagatatacatatacacatacatcgatcgattgatacatgaaatcaattaataagtcagttggtagatgatcacagtcgtacattctgcacaaagaagaagaaaaaaacagatcattcagccaagaatttaaaggcactgatcgagaaagtgcgtgggaaaacaaggacgaacatgcgtgaaaaggagatgatcgatatgatgcaaagatggatggatactactccagtctagtagagagcaacctccatggacctaccacttggaggtccacatgcatggaggcaggagatgcagtagcaacgaacagcaatattgcaccaactgcacgcccttttgatctgccatgcactctcctaccagtggatcagtgcttaattcatctatccattcatttccaagaaaaaggaaaaaaaacaacctatttaatatcagtatgattcctaaattaattttccgtgtttaaggttccggagtcgaatagcacgatagacgtggggttcttcggagatacttcctgcattcggtgatatggtcatactaacatgtggaacctattacccatagactcacataatagacacccagagaattctgatcccacaatgtgacaatgatacatgggtgcatagattagattcactattgtgcaaagttgactacaaactaaggatacatttataattagattagttggctctacataagtgtagagtccaaatgttttgatatgtttattgaaatatatattatttaaaaattaactcacgtgctgataaaagtatattattatgcatgccacatagctcggaaattggcataattattatatctactcccttgtcccacaaaaaaccaacataggaggggattgacacatactaacacaacgaatctgaataactctgtccagattcgttatcttagaatgttagttcagattcgttgtactagaatatttgacatcccacctaggttgatttgtttttggtgcgaagggagtaagtcgtggaaaaattgcccaacttaactggtataagtcgtgcaagctaataatgcaactatttatagcttttctgcccacaacccacacatggtccatgacttatttgtaacacaagaatttatataaatctcacgtacgtgtgggctgatataattttcttgaagaagctttttcaaaatagtcctacgtatatgttatacgacatgacttcaatttcaactctttttgcatgcaatctttaaaggagcacatcgggttcaccaatgatggagacatgatgaaggaaggtgcaaactagcttttggaagttagagttttgcagttattttcaaagatggaatggaccttaagagcaggtacaatagtaggctattagccagctataaacatattttaatgagataaacaatgagagagaagagcagcgggctatagatttgtagccagctgcagcacggactccaagacgcaatgtgtgtatgacaggtgggaccatatattaatagtatagtaagctactattgtatgaattggctattagatcggctatagatgaattggagctagtagtgggctatactattgaacttgctctaaggaaaagacccctagtttgttttccttgcttttgagtgtttgtgtaagaagttgctttgaacttgtaagggttctgagtctaagtgcttgtttaatattggttgaggtaaaccttttgtaatggagtctatgtactattgtttcgttgttgactgtgtacacccactttggatatagaggtcgggttttaacctttttttttaaaaaaaacatatggttaactttgtagcgatttcagataatttcatcatctcgatgtgtgctcaaattctcatgatctggcagatatggtggtcatcttcattcttctatgacgaaggcgagcgatttggagccaggttgcaagacaaaccataccgtatttgggtctatatatgaagggtgatggcagatgctactaatattgttttggatactaccattggtgtctttgactacgactttatattagaagataagtttaactacatggttttattctttctagctatagaggagaccatgctctggggatgcttattattccttttgtcttcaaataattgtcattaaatattattcattcttaaactttgatcgtttgtttttctttcacgaaaatatataagaacgacttaaattacttcgtattaacaaagtgtgttgcatcataataataattctgtgtacatcacgagctaaccatttaaaatttattgatggtcaaatttcaaattatactgttaacatttgaaaccgaatgaagtacagttttgcttggtggtttgttgctggacatgtgctccttgttgtttggcttggtccgctagttcctaacatcatgacagtatttttaaagacaagtttacatgtattatttttatattttaaaactactataatttgacctcacgcccttgagttcattgaggatctatgctaccaccacaccatacaatttttacgatagttttattccagttacatataagttacatacgtcgtatacagtgtaattatactctagctatatacgagttacaatatacttacactatagttacatttgaaagttttataaccaaaaaacttgcgacggtttttttaggtagtcccttgtgacaatgtgatcagatggagtaccgcaaacataccacagccccccacaaatcacaactcttcaccgtcaccagtatatattgacgatttagtctctttcaaacatgaggattaggtaaggctgtacgagcacgtaaaacagaaaaaacattcacgtatgattaattgagttttaattattataaaattttaaaaatagatatatttgatattttagagtaacttctatgtaaaaaagaatttcgcacacaacgtaccttggccatttaaaaatgtgcaactatagaaaacggggccaacgtccgtctcgtcgctcaaacctacaagtaaaccgcaactatccatccatcccactgtcactctctctgtctccctcccccgacgacctaggcatgccacacccgctgccgccgccgccgccgacgacgacgacgatgccgctgccgctgccgccacctcccctcccgctcccctcgccgtcgtcgccatcatcatccaccaccatccctcgtcgccgccaccaccgccgcctcgcctcctcctcctcgacctcgtcttcctccaccgcctccatattctccacgtcgccgtcgccttcccgccgttgttcgtcgtcccgcgccgccgtgacgagcgacgtcaccacgaccgcctccgtcgtcgtcgtgcccttctcgtgggagctccacccgggcatccccaagaacggcctcgccgcctcgtcctcatccgccgccggcgagccggcgctcccgctcccgccgccgatccgcgcgtccccaccacctcgccggcggcgccagcaccaccgtcgccgccgctcggacggcgtcccggcgcgttccggcgccggcgaccccttcaccgcggccattgccgagtgcaccagggaggaggatagcgccgacgatttgcccggacgccgccgctccgacgccgccgccgccgccgcctcatccgagcatcggtggcggtggctcgccggcggcagcgggttcgtcggattcctcgacctctacggctgcaagagcgccatggccgtcgccgacgccgccatcttggctcgccgccggccagtcgtggcacgttccaagccaagccgagccacccggagagataagtaattatatttgatcaaaattttaattactactaagccgtgtgtatatatgataattaactaagattagattaggatggatttgatcatttctatatctctctcaaaaaagagggaggattatattgcttattctctgatgctattaagcaataatcttgtgtaattttgtttcattttgatcatcaccttatatgtattattaattagtgcatgctagtatgatcaatttgttgtggcatgtgctgcattatgtattcttctatgcctactatattgctgttggtgacagtggttaggctctgtttcttaattaaactagcacctaattatacttatcttaatcaaggtcactacatatatatatacacaaaggggagctggcaattaatatacaatgtagttgtagaaaacaacatagtgatgatgtccctacctagctaattaacacttaggtgctacatgcatgtcacctcataactcaacaaattgatgtgaaagtatacactatagatgttcaaaaaaaaaaagaatacaatatagcaccatgtatgtaagtgtgtatatgtatgcaccatttggcacacaatgttcctgtcaagtgctacacaatcatgaatactttgtaactaagctgttggtgccactggattaatttcatgatgatgctccctggccttgtatatagttagtagtcagttgtttttaagtcttaatggcaggttatgttcatggcatcttcctccttgaaagcactgtggatgtatataaaaaaaggtgacaagtggtcaaaagacagcttgattgaatcctgcagaaagtggtttcatgtgtttatgcatgtgagcatcatcttcttggcacatggtcgaccattatatttcttcatatatgcatgccactagatctatttatatatggaagagtgaactgtcacaaccagaagccgtagtactgtcctagctatcttgcagactgattaattagaagagtgttggtacgaatgaaatttaaaaaattcaggattttgtcgatatatcgtattgcttcttctattattgacgttaaaatacagtgaatatatcaactttgagccttcgaaaaattaggagtggatatagaccttagacaatgtgggccatgactcgtagtctaggatggaagctaggctcattgaggactttgattttttttttcatcatataaatttatgttgagtcaaaacatccatgaggaagctcaggtcttggcctctttctgaatccgcccctggataggatcctaaccatagtgaagccagctgaaaatatcaccgtagtcatctctattactttaacatggtaaactttgaattaaaataatgttttacattcgttcgggttggctgaccttaggtgatgcagtggtgcacccagtccagcgaatttatattttagatttgccactaatgtattccaattttaggagtatatatatatgcccatatgtatttcacatttaaggctaactcatggagtcgtaaggaaatatccttttgttttctaaaatagggcgattcgatgatctatcccagctctaacgactccaagattttttttttttggagacacgcataattaactaacttttgaaagaacgtgacatcgtagctgtagcaactcttacgcattagttggagaccaaattaagaggcgaagaggggatcattaatttctgaactgaactggaactacaaagctgatcaatatagggtcagttacaaaagtgctattttagataagctaaattttgctagaggaaatcgtgacttcacagttttagctataagacactacaataagtaacttttggcgaagtcactatgtaaaacgtgaaaaattagctcatagacactacatccatagaaatattcatttctacttgaataggactctactaggaaaacgattttcactaagcaggcgggcatgattttcaacacaacatgtccgcctgcaataagggagatggaaggcgagattgttgtctacctatgaaaatacatcttcccaagcgaacaacttaagattcccctacgaagatatatctttgcaggcggaggcttaagacgtccgtttggggaaatagtgcattatcccaggcggacatctccacaggtggcaccttaagacgtctgcgtaggaaaatatacttctttcttcctgagccctgtgcagttaacccgaagtttctctctccaaaaacaagaaaaatagggggaggttttgaactcaaaatcttcgacggatttttctacagtgcttagatctatgcattccctctcttgttacaatttttttatttttgtagtccttaattttgatggatctatacatgcaaaaaagttaaagcagcatgtgtaatttttttttgctttttatgcctttttatgcattgattatgatggatctatgtatacatcaaggtgccatattgtcctctcatcccttatggttaaatgtgatgtttttattagccaaaatatgtattatgcccacttttccaattccctagatctagataggagagattaaataaatatgtattttgcccattttccatcccctagaggtacatagtagaaaacatatgtattttgtttacgttacttttatagatcacaattctacagttattaatatttctctttcccatagcgagccaagttaagtattttataaataggtatttttatgcaatttaaatttgttaatataattataatgaaatattctcagagatatgggtaggcaatggatgtatcatacgccaagatatatgccatcatatacaaatgaagtatcaaaatttactgatattattaaggcgcgtgcagcagcaacaacacaacggagatacattgttcatatgataactgtaaaaatgaaaaagtaagagagaaataccactactacttacctatttgtaactatgccattgcaatgcctctaaaattgtatccatgccattttatatgcagcagacgtgttttttaattatttctctaccgtatttttagatgaatcaaaatacccaatcagcatgtaaaacccatccgtcagttttccatctcttttttccttttcctcccctccactctcatgcatggggggccatgaattatgtggcacaatggcgacccacgttgaaagggcgagcggcagggacgggcaatggttgtgcatgggcagcgagagggcgaggtgatggtggcgtgccatggctgtgtgagggcgaggtgtcgttgagaggatgaggcggccatggcatctcctttccccgtcgtcgacaagctttttcgacagatccggttccttctcgtccatggcgcctacgaggccgctgaggagcagctcggcgacgcctatgaagtcggcaaggagcagattgggctcattgacaggatgggaaaaatctgcttagggagattaggcttgccgatggcttcatgctcacgaggtcaccgtcactactaaaaaacccattttcacaggcggccaaaaagcattttcacaagcggatagttgctccgcctacatgtaatcgactgtgaaaatcaatcattttcgcaggcggggcctgcgaaatcaattttttaacaaaaaaaaaaacctcacaaaagtcgttccaccaaatagcagcagaatggattagaagatttttcttagattcactaacaacagccagcatcacaatgaaaaacagcagcagaatggtttagagaggatttttcttagattcatcaacaaatgcagctagcatcatgaattcacaatcaccaacagcagcataatggttcagggaggatttttctcagattcatcatcaacaacaactagcatcacaatctttcatcaacaacaacaactagcattctcagatctggttcgtatgcgtgctcaccagccggcgagcatgcttgcagcagcaacagcctcgcaccgctgctgtcacggaactcatccctgttgtcgtcgcggttgtcgtcattgtcgatgaggccctccgtcgtcacggtcgtcgttgaagtcaccaaggcccctcccttgttgtcgtcgtcgtcgtcgccgccattgcagagcccggcccctcgccgccgccgccccgcgcgtcgtcgtcgccgcccggcgccccgccggtcacgcacctcgccgtcgccgccctcccccggccggatctgggagggcagccgccgccgccgcgcgttgcgtcgtcgtcgccgctccgccggccatgcgcctcgccgccgccgccctcccccggcctccctccggccggatctgggaggggaggggagggtagccgcc

SEQ ID NO: 75001 - DNA, 7448 bp, Oryza sativa
ttgccggtgaagtcgttccccccgccaaggccgccgccggcgtggctcatgcgcagaaaccaatcagcggatggcgcggcgagctcccgcgtgtagccggtggcgcggccgtcggccaggacggcatccgccatctttgattgcgccattaatttggctcttgatcgggcttggtggcgtctccgagaccggggggactggaacgagaccggacgaacacctgcaagctgcagctagatagcgctcgagctcgcgatgctttgcgaggttagccatggcatcgcatcgctttataatataaacggggacagcgatccctaccacttttgacacattgcaactttcggaatgagacagtttattatcaatcatcttcgtatgattccgaatttctgacaagaacagcctttgaatttttagccaagggtcacttgcagaatcccatcaacactagtactatcataatctttatatccaaaatagggtgctttgtttcagctttgttcggctgcagcttacaataatgctacttctgatgttattattcaattgtagaactatacaggagtgtctctcttttctcgagttatcaacaacaggaatttcaaatgaacagaaagtgggggagagatgtatagacaatttctctcgtgctcagtcaaaataggagaaagcattatttgttccatacaagtactcctcggtgtaacaatatataattgtagtgccatgttctctcagacaaaaattagtagcagcaatatacagtatatagttcgatgggcaatcacttctggattttctcaaatcgcatatcttcgtagagctatcacgatcaaaagcgaaagataacggatttgaccgcctgctccaaattacgagtatatcaacaatccctttcgaaattgcaggtggtagaaagggtggattataagccactccagctagctagcactaattaatcgtcgatcattgataattcagcacttgtatgaatcttatcgtcgatcaagtatactaattaatcgctccctgatttttaatgcccttggagccagcataccttgaagggtactagagactagacttggcattttgccaattcgccatgcgttcatcttcatggatctatgcagcttgtatatatgcatttgggtttatgataccgttgaattccttaactgtgcatctggactatatataaaaagttcaatcacgtccttgcagcccctctatctcctttcattttcttttaattttaatttcccgagaattaagaaaatgtcacgtcaaatcttgttgaactagaccgcaatgcttaggcccggtttagtttctaactttttcttcaaactttcaacttttccatcacatcaaaactttcttacacacacaaacttttaactttttcatcacatcgttctaatttcaaccaaacttctaattttggcatgaactaaacacacccctactcacacaaacttccaacttttccatgacatcgttccaatttcaaccaaacttccaattttggcgtaaactaaacacacccttactctcttaaataacttggggtcctcttgacgttcaaaagaaaatgaaaataaaatctgtgctcttcttgtaaaactaaatcatcatttgatccaatcctctcttttcttgttaaaagaaaacaaagttggacaaatgttgtttatttgcctccctgtatgatatctccagataatactgcggcgcgatactgcacacaaatgctttcccttctttctttaaaaaaaaaagaaaaagaaaaggaaagtgttgggatgaccgaaatagaaagtttatttggaccaatcgacgtggacagtcacatgtctgtcttcatggcatattacgttggataaactaatcatttaatcatctctttgtctagtaagtacttatcttttctctaactgctggcagtccagatcaaaatgacattttcccttccttttacctttgttcttttcctatatagcttgtgaattttgtggtagactaatcttatacttcaatataagccagtaaaagctggatctctcaaaacgaaattgtattatctaaataacatatacatcatcgtcaactagttatatagatgtcgacccccctgcaattggtggtttgatcttaagttctgaactgttaaggctgtgtttagttcacgccaaaattaaaaatttggttgaaattgaaacgatgtgatggaaaagttgaaagtttgtatgtgtaggaaagttttgaagtgatgaaaaagttaaaaatttaaagaataactttggaactaaacacggcgtaagtctctctatacatttttaattaatgaggccacaaaacgatattaatttgtttagagcagcaatagagattttctttactgataaaattaaatttcatcagatttcacgaaccctacgcgttgtttcgggcgatcggacggcaccagccggtccctttgacgacacgcttcagctgaattcaattgtaatctgaacaattgcagcaaaaacagcagtatgttctcccaaccgctgagtcggttccaaggagctaattcgtactctctctccgtttctaaatatttaacgccgttgacttttttaaatatatttgaccattcgtcttattaaaaaaatttaagtaataattaattcttttcctatcatttgattcatggttaaatatacttatatgtatacgtatagttttacatatttcacaaaagtttttgaataagacgagcggtcaaacatgtgctaaaaaatcaacagtgtcaaatatttagaaacggagagagtatttttttttaatcccaaatgtacatcacggagcatgcgaatataatactagcaccacaacgtcgttttaatcagcctgtgtcatggtcatggtctatcttttcatccgcacaatctgaacctcgcctacttgttggcactataacctgaagaaaacaccatccatcatctcccttgtttttcccatgaaaagaacactagtctttttcgtggaaattgtagctgatgcgtccgtctgccgctcgacaaattttcaatcagcaacaaaaatgatttgatactactgaaattaaggaactaaactttcatttggttggactattgcagattgcattgcgtgtagaatgtatgctgaattgtactggattaaaggttaaattaggattatcaagattcggctaagcctcatctaatcggcaaaattaatctctgttaacactgcaagatggatgccaagctaagtttatttcgggtattcatttgagaattcgagaaattttggcgcaagacccatttcacaacgaaacgaaagctttttttgttacacgtgaacacaacgaaagcttttgacgactcaactaattaactagctatgagactgaggacaaaacgtccttttctattcttcttaaaattgacttgaagagctcaaatcggataagggcacacgcattagcctcttgccaacttgcagtactagaaaatgtctgaaatgttcttctgcctcttttcttttggacttccacggcagagcagacaaaacctcaagaattgaaacgtgttgtgttcatcctattgatactatcagcctatcaagatggagtactatgctttggtacacacaaatttattttcgacaagatcgtataagatacaattcagttcctcataaattaacagcaaaattcagcatggacttgtaaattcacctcaacactacattctgaaacataagatgaaaaacatttcggaaacatcagatgaaaaacatttcgtgtagcaccaattgatcgatcacaccaacatccattattgctaaaccgcagatgaaggaactgataatctgagatagcatctgatattattgcttcattaacatatataggacaagatcttgtacaagtggcgttggatctgacccatagtttgacatgtcgcatcactgtaattgttaatgaagcaccatgtcatgctatgaattcggtccaaattcatctgtaaaggatccgaatcctacaaaattattccccaattttcgtcagatatcatcaaccagctgattctcaagaacacgggagacagaaactaagaggccaccaagcagcaggagaaaggcaccaaacgccaccggcgggctgacggggccggcggcgaccatggtgacggcggttgaagcagcgaaaatccccaccacagttgacaggttgccgccatggccgccgccggaatctgcaccggccgctaccggcacctccttggcaccgacaagaacatcaatggcaacctgcaaaatttgaacaattgatggattgattctttgtagaagagaagcagctcgagagtaagaaatggtggccatcgaatttggctcgctagtctacctgctccgagtgcggggcggaaggcgccgggcggagagccttgtcggtgcgcgcgccgtgctcgtcggccgcgacaagcccggcgaagggcggcgcggctgtcttgcgcgcgaaggagtagtcgtcggagaagaatttctcgtccaggagaggtgtgtcgatctcgcgcagcccagcggggtgattgtttcccaggagggcgtcgccgaatgacatgccgcgttcacgcgcgaacacgtcgcggtgcttgtcgaggaggaggaggaggaggaggagaggctcgccggtctcacgcgggaggaggtcggactcggacacgccgcgctcgagcgcgaagacgtcgttggcgttggtgccacccacggtcagcccgccggcacgggccatgtccactagcggcgcaccggtctcgcgcttgaagaagaggtcggacacggccagaccggccggaccgttcttgctgaggagggcctcgcgggaggacacgccgcgctcgcgcgcgaagacgtcggcgccgtcggtgtcggccacggttaggcgtggccgcgcgtcgcggtcggcgaacggcgcgcggtgatcgcgctctaggacgcgcgccccggcggcggcgcggtccttgtccgggataaaggcattggtgacaggctctcggtctgaagcgctattattgggatatgccccgacagggacacggacaaactctccggagatttcgcccatattttggggcacgatcgagcacagcagcaggaaagcagtttgttttgcgtggtggttagccgtggtgagctggggacttaggatttgggggctaagaaatagtaggggggacagccggacaggtggccccgttgaattgcagctcgacaagtgtcccggcggctgccaagtgacacgtggtggtgccgcctgtcccaaaattaggatgcaagtggaacgagcaagcacgttttcttacttgcttatcgcacttaaaagattttttttttaagaaagaaagtgtactctcacatagacagtgaattagtaaacgagcttttatataggtatataacgagattgtccacttgtatatctctagtgtagcttcctcttcatttagaattgctatatatcttctttccgataagatggatggtagaaaatcgattttcaaatgtatcagaattatgtttttaactttctatgaacacaaagcaataaattcatgaaggaaggattggaatcctgcagcaaaaaacaaaaggataaagacagtattttgctttcactgttagagaagtcggctgtatgcggtgatctctcttaaaaaactgatgatcaggtgataggtgacatgatgttaacctaattaaaaagaaatgaagtaccaaggtggaaggagaataagattaggtagctattttaatctctctgaccaaagtagttcttaatccctcggtccacatatatagggattttgtgttcaatcttatacgtaaatataagagattttaagtattacttgttcgatctaatcacccttcacttaattttcgttcagtcgtattcccagtttccaaactatcctctcacccttcaactattatcttattttttgaggatcatcatagttttttttataagtaaatttcactttaggccacttatattgacctaagttgcacattgggctaggggtgggtcacttttttcactttacaccacctatttttaccatcctttgcaagttggaccaggtttactgattgggccactaggctgggcttcagcccacgcaagtaggtgcgtttaccagcggtcggcagtcctcgtctccgggctccagcgagggctccctcgacggcggttctgcctccctctctagtacgagtacttccctcccaacacaaaaaagtctctgttcacacacggctgttgtgcagcggcgtgaactcaacaatcgacacacaaacaccaccgtctaggtccaccgtccaccggcgccaaggtggagcaagtctcgtcatccggccgtgtcgccagcgtcaggccaaagggcctctgcctggtggacgcccatgccacctcgatcgggaagctgcttcccgaggatggaatcactggggtcgtcagctgcctcgttgctaggatgcttgttgggtttatgaggtagacaggtatatgcatccgcgatttgatcatggagtaatccatggaggaaagttttgaccctgggacttgggagagtgaaacaaagcaacgcattcagtaattcctatgagatttgggttttgtggggataatcaatattcctcttctgctcttcgaaaaaactagagtaattaatctgtgttcctcggttggtaaccagaaacatgtcgaattttcacaagaaaattaaagagaagatcggatcttgattactgctaaatggaatagttggtcttttttttatttcacatgcatgatctgaatgggatagttctagtatggtctcagatcttgtcaacgtaatcagatgtgccgtagtattgttttgagcgcgacagggccgagcgtgatcaccacagggtccgcgtccactggacgacaacatgctcgccctcgccgatgaccacaccaacgcgtcgcgcgcgctcctggtatcgcgcaccactgccaccatgagcgaacaccagctgctcgcgtggattaggtcgaaacgcagcccatgccgtaaacctggtccaacctggaaaagattgtaaaattaggtggtgttaagtgaaaagagaaacttagccctagcccattatgccacattggtcaatataggtggttcaagatgaaatttactctagttttttcacactaatcttaatatttctaaaagagcctacgatcatttgcatttatggttggggagggagcaattaggagtagtttaggggctgtttggttttcagggacttattccaagtccctgtcacatcggatgtttggccactaatttagagtattaaacatatactaattacaaaacccattccataagctcggg

SEQ ID NO: 75002 - DNA, 938 bp, Oryza sativa
gcatagcgcccgcacgtgaaaacaaaaaaataccaaaaaaaatttcccaaaaaagacctaagcctcgccgccgcccgagctcaccgcagctgctcccgtcgtcgccgtcaccagccaccaatggatccgctgacggctgacggatctgctgccccacgacctccggccaccgacatcgaagaagaagagggagagagggaggagaggcgacggaatccgggaggtcggagactgagcccgccattgcccgagctcgccacagccgtgccgtcactcccaccgtcaccgtcgcctgaactcgctgccctcgttgctcaccatcattgcctgccgttgccgtagccactcttgagggcggaagatccggccctcccgagggtggcaccgctggatccgccacctgtcgtcgccgcagcctctctctaccgccacccgctcccgatcgtctcctcgtcggtggcggcggcccaccggcgctcactcctgctcaaagaggaagagagagagaggaggagaggagaggaagagagagagggagaggagttgaaaaaaatgaaatggtggtgccgcgtggcgctcactcctgctcggagaggaagagagagagaggagaggagaggagaggaagagagagggagaggagttgaaaattttgaaattgtgggagggaaaagagagtggacgggagaaaaaaaaagggtggctatctggcatgcgcgcgccagctggcaccccctgcttcgtgattctcttttttttcacgattttctccgattttggcgccactctcccatcggcgcgtttttcctttttcactttttttatttgttttttaaaaatcttcagtacacgtgttttcaaatcttttagttaagagataatccatgaaatgccattgacaagcgtctaagtcccagaaatgctatcgacaagtgtga

SEQ ID NO: 75003 - DNA, 682 bp, Oryza sativa
agttcacacggagataaaatgagcagatcgatcacgccgtcacggcagccggagagaggcaacggcgaggtggccgttgagtggtgacgctaattaacaacagaacggagcagaggatgaccgatccccttcgacacactctctgtgtgtgtgtgcgcgcccgagtacccacccaatataatttttcctcgttcttgcaatctcgcctcatccgtccaggcgtccggctcttatcagtgctgaacgcgtcggatcatgaaaccggttgcatcgatatacgtgcttcccttcggaaaatagggtgcactaaagatacggtgagcccataattatctttagttttttataataggtagagatacggattatgtatcaaaatcatgataaaaatatcttcaattttataatattagagatttttactaaatgttttataatacacgaatgatcatatatatttttaaaaggagggagcaggagaagtcaataggtattctctaattagtgctattctgtgaaactaaaccatttggccctatctttttttatcattttccctttttttcttttattaaaaaaataaatctcctttccatgatttggcaccaaagaaacaacgggaggacaaagaggggaagggtgtggctaatgggcgggtgatcactgtgggcgatcacccgcc

SEQ ID NO: 75004 - DNA, 4282 bp, Oryza sativa
gtaacggcgcggaatagacaaaaccctaacggcgatggcatttttgggacaaaatcgtttgtatgatggtatttcttggaactcatacttgtcaatggcatttctgggatttggacgtttcaatggcatttcatggattatctctttagttaaaaggtttgaaattttgacttgaaagttttcaaatctcgagttgaaagttttcaaatctaagtcgaaagtttttaaatttgggttgaaagtttttaaaatttgtcttacaaatttaaatttcgagttgaaaatttacaaagtttgagttgaaaattttcaaaatttgccttcaaagtttaaatcttgagccaaaagttttcaaatttaacttgaaagtccaaatttcaagttgaaaattttaaaattttgagtttagagtttcaaatttttagttgaaagttttaaattttatgtatcgcttttaatatttcgatagaaagttttaaattttatgtgaaagtttgtttcacatattgatttatttcaatctgttagtaaaacaaatctccaaaaaaaaaataaaaatcttcccttagttactgtcattatcctaaactaactcggttagctagctttctcaggaaaaaaaaatctatggagatgaggggtatttttacatacagaccacttaagagatccgcatgcgaaaatgccccttaagaggcccgcatgcgctcctctgaaggaaggagccgtatgtgaaaatggatggttgattttgcaaacgcgacacgttacggtctgtctgcaacctataaggatcctcatatagagaaattgtttttaagtaatatatcttattactagatcagatattcatttctatcttgctcagtttgttttatattataagtcgatttgacttttcctatagttaaacttgatcaggtttaactaagtttataaaaaaatttagcaaaacccaaaataccaatttatttttattaaatctaacattgaatattttgataatatatttattttgttattttatgttgataatgcaactattttttttctataaatttagttaaacaaaaacattggttagaaaaaaaagttaaaacgtcttctaatatgaaacggagggagttctatctaacgctataacggagcgagtaacaacaatacatgcgcgtacgggggtcggaacagaacacacacgaccgtgttgatcgatcggatcggacggcgtgtgacgtactacgtgtgatgcgacccgacccgaccggcagtggccaccaacccccactaacgacccaagcccatttcaccgtaggttggcaaacctggaagtcctcgacaatgggattgtttagatcccctcttagaatttttcatttttttcatatcaaatatataagaaaaaaactaattatacagattacgtgtaaattatgagacaaatcttttaagtctaattgctccatgatctcacaatgtgatgtcagagtaaatatttgctaatgacggattaattagacttaataaattcgtctcgcggtttataggcgaaatttgtaatttgttttgttttcagtctacgtttaatactttaaatgtgtgtttgtatatttgatatgacacgctaaaactttttaccccgggatctaaacacaacctcagtcattctattgacttggggtagaccctgccatagtcttctattttgttttcatacaggaacggcaccatcttctaaaggttgaagacatcgtgcaagaacggcaccatctttctagaggttgaagacgtgtgagctagacccaaggctccacctgtgggttgggccaaagagaggtgcccgagtggcgggaggtagcagattgggctggggctgaaaaagaagggatgagcttccagcccaaaactaagaaagtagtataacatatactccctccgtcctaaaaaaaaaagacaaactctggtttttcgtgtccaactttgactgtccgtcttatatgaaatttttttataattcgtattttcattgttgttagatgataaaacatgattaatattttatgcgtgacttgtctttttaattttttttcatatttttttcaaataagacggacggtgaaacgttggacaaagaaaccagggtttgtctttttttggacggagggagtattgattaaaaacatattacccgttgtaacacacgggtattttttttctagtcaatatctaaaataaaacaacgtaaaaatgattttgcattagatttctatggtctctcatgaaaatgggacaactatactaatttctcaacatcttcgtggattataaaatccaaatgtcgtcgctcgctaccacatcatgaacacaataatgtcgaaattatgcagtatgtgcttgataacaaggaaaaacctagtatcgaatatttaaagagaaaatataagcgtgttatatatgaaacaaacacatgaactcgggttggcaaacctcaaaggtcctcaacttttttcctttttttttgagaacacaaagtcctctcaactatatgtatgcttttcaattacgtactccacgagacatccgaagatgtgatgcgccgaaaatgcgctcacgagtacacatgtagaaaagcaactccttctagatgctatacacacagaaacactagggacctgatttaagcaagcgtctgacaactatagtttctcataaaatctctagaagcttctcactagaagcttctcaaacaattcagattttcattcagattttaaaaagttgtagttatagaattaaaaaataaactaaaatctacaagctatatttcctaatttatatagtactcctatctcgtcagctgctttttagaattttagggcccctttgaatcaaaggattttatgtaggaatttaatatgattcaaatcctataagaattttttctgtgtgatcatttgattcaaaggattgaagctttccaaatcctatgaaattcttatggaatggttaattgcatatggattttggaggaatcttagcaagagctacaacctcttgaaaaatttcttttgagtttatttctcttatctgattcctatgtttttcctgcggtccaatcaaacggcaatttctgtgttttgcaatcatctgttttacacttgcattcctatccgaatcctatatttttttttcttatttctctatttttctaatcctacgattcaaagaggcccttagctttcccaaacgagacctcctcgtcctcgtctgcttctcagaattatttccaccgcatttccaaggctcctcgtccatgtcctcgtcttctttcttccacaccaaacgaactcgtcaactcatggtggaagcaacaagtggaggcatcggaccaaacatttcatccaacgcaaccaccacaacacgccatgcatcccatcaaaccggaaacagatcctctgacgtgaacttccctcgctaacatggtcaccgacaagtgggcccacgagcgatggggcctacatgtcagtcatgaagtcagggagggatcccaatccctccaaacctacataaatacatacctgataccaccaaccttcctcgccgcgccattgccaaccaataatctaacagttaattagccatggccgccatgctcatctcgcgacgcagcatccagctcgtcctcgtcgtcgccgccgtggtcgccatcgccggagctgtccatgctgccgcgggggagacgacggcgacgacgacgcacatcaaggtgtactggcacgacgtggtgagcgggccgagcccgacggcggtgcaggtggcgagggcagcgacgaccaactcgtcggcgagcttcttcggcgccgtggtggtgatcgacgacccgctgacgtcgggccccgacctgaacgcctcgtcgccggtgggccgcgcccagggcacctacgtcagcgccggcaaggacacggtggcgctgctcatgaacatgaacttcgtcttccagtccggcaggtacaacggcagcaccgtcgccatcatgggccgcaacgaggtcttcgccgccgtccgcgagatggccgtcgtcggcggcaccggcgtcttccggtgggcccgcggctacgcccaggcccggacccacaccctcgacatgaagaccggcgacgccaccgttgagtacaacctctacatcaaccactgaactagtcatctttctcatgagtttttttttaccttttcagaaattatggatttagttaggagttaatttttacttagcaccaaataattg

SEQ ID NO: 75005 - DNA, 1622 bp, Oryza sativa
ttgtattaaattcctatttgcaatatcagattgcttttatcttgttcttgcttgtttcttcgatttgcttgtaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcacatccaaacttgatttttggatatattggagtgtattgggtgcgttcgtgttaaaaactcacttcgtgattcgcacggcgaatttttgtcaattactgtcaattttagcacaaattggcccccacgggtgcgatgtttttgaccggattgaataagttcaaaaagcatccaaacatgatttttggacatattggagtgtactgggtgcgttcgtggcaaaaactcactttgtgattcgcgcgacgaacttttgtcaataagtgccaatatttagcatatataggcccccacgggtgcgatgtttttgaccggattgaaaaagttcaaaaatcaccaaaacatgatttttggacatattgcagtgtattgggtgtgttcgcggtaaaaactcacttcgtgattcgcacgaagaacttttgtcaatttatgccaatattggcatatattgagcccccactgatgcgatgttgttgaccggaataaaaaagttcaaaaagcacccaaacatgatttttggacatattagagtgtattgggtgcattcgtggcaaaaactcacttcgtgattcgcacgaagaacttttatcaatttatgcaaatattggcatatattgagcccccacgggtgcgatgttttttgaccggaatgaaaaagttcaaaaagcacccgaacatgatttttggacatattggagtgtattgggtgcgttcgtggtaaaaactcacttcgtgattcgcgcggcgaacttttgtcaattaatgccaatattggcatatgttgagcctccagggttgcgatgttttctgacaggaataaaaaagtttaacagcaccaaaacatgatttttggacacattggagcgtattgggtgcgttcgaggcaaaaactcacttcttgaatcgcgcggcaaacttatgtcaattagtgccaatattgggtacgttcgtggcaaaaactcacttcgtgattcgtgcggcgaactttcgtcaattagtgccaatattggcacacgagggtgcgatgtttttgaccggaacgaaaaagttcaaaaaatgccaaaacatgagctttgcacatattctagtgtattgggtgcgttcgtggaaaaaactctcttcgttattcgcgcggcgaacttttgtcaattaatgccaatattggcacacgagggtgagatgtttttgaccggaatgaaaaaagttcaaaaaatgtcaaaacatgatttttgcacatattctagtgtattgggtgcgttcgtggaaaaaactctcttcgtgattcgcgcgacgaacttttgtcaattagtgccaatattaccatatataggcccacaccggtgcgatggttttggccgga

SEQ ID NO: 75006 - DNA, 6651 bp, Oryza sativa
gcgtccgcgcgttcgcggcgtacaaggacgcgaaggtgatcgcggcgccggagtcgtggctggacctccgcatcaagggctcccagctcagccagtacttccgccgcaagtgcaagcacgcgcccaaggggctcttcgcctaccccgtcgtcgtctccggccccggcgacggctcggcggcggcggcggcggcgaggtactcgctgcactgggtgtcggaggcgcaccggaacgggtggcacgtgctgctggacgccacggggctcgccgccggggaccggctgccgctgtcgctgcaccggccggacttcgtgacgtgcgcgctggacgacgcgcgcgcgcagccgccgtcggcggcgacggcgacggttacgtgcctgctcgtcaggaggaggtcgttcgacgtcacctccttaaagggagataattgaaacgatatgcagagctaaattactttgtccgtttcaaattataaaaacattttaggttttgtttcatgtatgtgcttcatttatactatgtgtaaataatttaaacgagggataaagaagccgaaacttatctctatctctatctttactattataaaattaaagatgtttttgccatgcgctttggtacgtcgtgaatccgtagcttagtttctgcattttccgattatgtatatctttctttcgtgtttcttattctattttcttctaccgagcgcaacgcagatgatcgatgcaaccctggggttgttctaccacacagctgacctctgggccgagcgtcgcggccaccacgggcggaaaaagtacaccgaaggtccctcaacttgtcatcgggataaaaaatatcctcgaaccgcaaaaccagatatacgagatctcttaactatacaaaaccggtcacaataggtccctcgacggttttgatcccggttttgtcctacatggctgctgagtcagcgtgggacccacatgtcagcctcctctttctttcccctctctcctatcccttcctcttctctctctcactcttctctagctctgggtaggctggcgccgctggccgacgggtggggaggagattgacagggcgaggcgggagaggaggtccggcggccggcgacgtggtagcggagacgacgtgggatcaggggagcaaggtggcggcggcggcgatgacgcgggagcaggggaggggcgtcggcgacggcgaggggagcaaggcagtggctgcggcagcctccattgcgcaggcgcagaggagggcattggcgaccgacgaagggaagacggtctttcttttcagcacgtcgccccaaacctttctccgcgaccaacgattggtgacgcggcggcggtggcggcgacgcaggagaaggagaggtggcgactgccgccatgacctcgccctcctcgacaagttccccttcaatgttgacttcactagcggcagtgactttcgttggtggcggcggccgacgagcggagagaggagtggcggccgaagcaagaaggacattgccaggctcgctgcatccatgcgcagggtggggagaggagcagaggtggagatggacgcgacggcggtgctcaatcgaccaatcaaccaagctgccgccgacgccgactgccagcttcgcgtcaactccttcctgcgtccaccaccggccccgaggcgacgcccttccttgcaggccgccgctactcccccgctctccgccgctggcgcgccagggcaagcgccgccgccaggatgctgaccccagctgcggcctcctcaccctcatcgccttgctcccctcgctgccgccgatgcccctcccctgctcctgcgtcgccgccgccgccttgctcccctgatctcgcgtcgtctccgccaccgccgccacgtcgccagccgccggacctcctctcccgcgtcgccccgctggacctccctcgtctcgccctagcgtcggcctgcccagagctagagaagagtgagagagagaagaggaagggagagaagagggaaaagaaagagcaggctgatatgtgggtcccacgctgactcagcagccacgtaggataaaatcgggttcaaaactgccgagggacctattgtgaccggttttatatagttgagggacctcgtatatctggttttgcggttcgaggacgttttttatctcgatgacaagttgagggaccttgagtgtactttttcccaccacgggctgagtgtccctctttttaactgatgggcctcatctgtcttgggtcacataattcttagtaaattatttcttggtttttctttttctattggctcagttcggggtcctcccctaatttttctttattgcttcaccccgtttcttccgaatgcatgtacactttttaaaaaaaatcaaaagatattataaaaattgaaaatgtttcagctgatacattggtacgttgtttgtagttgagtcggttttcaagtttatattgacttttagaaatacataagaaatcttttaaaaaaatacatgctaacttgggacgagattcggataactaattgtttcataattcttgccagaccattagaaagcaacatacaggatatggcaagcgtcctaataagaattccaaattagatataaatactatcaaaataaaaaaccccatagactttttaaatagaaaaaaaatcctaataatagtacgattaaaatagttttgacccgttgcaacgcacggatatttttttctagtaatatgaaatattgaaacggacggagtaagcactgattgccaagggacataagtgatcactagaatttgtgtgtatttatagatgatttatggagagaactgcagtgatgttttagactattcccaactcaatgactaggatggtgtatacaatattaaataagctgccacttaggataaaaaataatgtgacaaatgaataaatgaaaaaagagaagaaaaccctgtcttgcatgagacatggtttctacacaacatccaagacatcatgtgagataagtagcattaaatttaagtatagaatagtggtgtttgcattggaaaagtagtgtctagtactagtttcttgatgatgtggagtttatgaaactacgtctagtgtcttgggttgagactggcgttagagttcaattgcgagtctgtgagtggcaaaagagaaaatttatttgctttgatatctactctcttcatccataaaagcaaccatggctatctatctggatatgtaactcatgtccatatacatacccattgttgttttttttttctttttttttacgggtggaaaatgcaattaatttgggtgaattagtaagcttggagctttgctagtacatcacagatggttatgttggacgtcacatgtatacacggatgccggtgtaattagttaagatagttaaacatgatagcttacttgccatgttaagatcatagtactaataattaaaacttgtgttttgagtttaattcggtttgatatatagatcctggcaatggcattgaacgaagttggcgaccgaactggctcttgaaaagctgtctgatttcggcgacatacgacggaagaaacacaggccacatacattgcagggctgattttaggcgaggaaattaagttggaataagtccacattacgtccctcaccttcccatcgagttcaaatcacattcacctccaacttacaaaggccttgtttagttccaaattttttcttcaaactttcaacttttctattacatcaaaacttttctacacacatgaacttccaattttttcgtcacattgtttcaatttcaaccaaacttttaattttgacgtgaactaaacacaccctaaaccggtttaaatcagtagtatgcatggccagtttcgctgacgttacaagtttaccgagtctacctgtacgtgctgaataggtatttacgtgacaaataaaactaaaactgggacccacatcaatcggccggcttcggcgccgtgcactttgagaatgagcgcgcgctgccgcgccggaccacctcagctcgtcggcgacgagcggaggatcttccatgtcctgctgcacatggtcggcgaccctgattggccagaggtgggatcggattcatggcgtcctactcctccccagttggcaaatcctcagtggagtttgccattggtgtcagtctagcggcagcagaacggcgacaccgctctcgccgagaccaagtggaaaagggccattgattgatctcagacttagcttcagcatgtgcagagagtgttaaaagaaatttggtcataattcggcatatttaaatctaaaatattaagacaattaacatgacatttgtaatttgagtagatctagtgacagtgctagatgtgtacaacataagcatgcttaatatagaataagcatcaacatagacaagagaacgcaataatattgcgacagacagttgtagaaaacgaagaataaacggtaatagtaaaacgttataccccgagaatggccctccgctagagtttgaggcagtattgcctccgttggtgttgacgagaggctccttctccttgtttccagtgttgttgttgtcaccggttgtcgacatgttggtgaagatgatgcagagcagtcgcgcttgaagcgctatctaaaacttgatcgctcgcctacccgtgcatgttctcaagcggacggagtttcggaggcacttgctcgttccgatcacccgtgcgcgcgggatgaacagaaccggggaaacagagagacagcgcaggaacagaaggagagtatcgccaaggaacaatagtaggaggaagatacacactttgagagcctctgccttgcgttatatgtagagagagagatctccattaccacacaaataaatatcatctgttgtgatggttaccacaaaataaatctcatttgttgtgaaggttaccacataatgaatctttcatttgttgtgaaggttacaacaaataaatctctcatttgttgtggatgttacaatataatgaatctctcatttgttgtggaggttacaacacaatgaatttcatttgttaatggtgactttattctcatctgtttcaaaacggaagagcagcaggcaggctcggctcggtcggccgccttgcctcgctacgcccacggccgaggccgactcggcatgcgcgcatgcgtgtggcagtccaaccatcacctcaactggtcaacagggaatctctaatatcaccctatttaatttgaggttcttccacctaaattttcaagccagtgttattctctctaacattacttgtgggctcttgagatattaattgaattaaattgggcctagcccatttattccaacaatccccaccaaatttcatggctcacaggaaatgttctcaaaactgaacctgttagttataccggtgtttcgatggagactgttaagttgaacttccacctaggaaaagagctacaccagatcacaactgaacaatggactatgccttgaattatcagtcttgtgcgattcaggtttcactcaaacccttaactggtactaggctgtcgtttgcatcccctctgtttggagcgtataagtcatactcctggccttttcatgagtatctagagatcacccagatctcatagactgtgactaacagtcggactcatataagtgtgttccttctaaaatgttctgtaggccaacatctctgctttatgaaaagccactcggatcacattaaggtgtataccatcctaccatacagattagaagtgaagtgcatcatgaagataggctcattttagggtctcttctctcagctacacaatagtttgttttgccatctaaattcacgggatctccgatcacaatggacaggtttccactattgtgcaactctaagtgggtctcaagcccatctccctcgatgcacagtctatcacattacgtggtagccccttggtaaactgatctgccagatttttagccgtctggacatagtccaatgctatcactccggagtttttctgctttctgatagacttcagtcttcttttaacatgcctggatgacttcatgttatccttcgaactgttcactttaataaccactgtttgattatcacagttcatcaggattgctggtactggtttttcaaccaccggcaagtccatcaggagctcacgaagccattcggcctcaactgtggcagtatctaaagatgtgagttctacttccattgttgacctcgttaagatggtctgcttgcaagacttccaggaaacagcgccccctccaagtgtgaacacatacccacttgtggcctttatctcatcagcatcagatatccagtttgaatcactatagccctccagcacttttgggtacccggcgtagtgaattccatagctcattgtcccttttagatagtgcattactctttcaagagcatgccaatgatcatctcccagatttgaaacaaaccggctcaacttgcttacagcaaatgagatgtcaggcctcgttgcactagctaagtacatcaatgaaccaatgatctgagagtatctcaattgatcccttgctattcttcggtttttccttaataacacactgggatcataaggagtaggagctgcct

SEQ ID NO: 75007 - DNA, 6897 bp, Oryza sativa
aagtgatctgggtggggatccctgattgggggctgtcatttgcgatgtttgcgggatttttttctatcagattttctggtttggaaatccattttggatactgtgctgattttagactgtcgaatttgagcttggacatgcagtgagccaattagtctgttaggagcgaaagggggcatgatagaacagagcaattaagttgtcaaaatttcgctgcaatgctattgacgctttatgttatgtagtaacagaataagttgttgctttgggctttttggtctctgcttttgggataggaaatttgattgagtagattggaggatatctccactggaagaactgtcactattggctggttgcttatcactgccaaagcatgagttagttatagccaattcactgtgctggattgaattgtttctggaaaggtgaaaccatggtccatgtgaattgagctgatgatttgctattttgttcatatgtgcagacttatcccaatccactacaagatcatccagcctattcaactgtcaagtaaggctttgatcttccactttttttcttcttctaatatctgagcttgtaatttgtgccatgtgtaatcctgaaacttttgttcttatcgttatcaggcaatattttgttaatgaagatgacactgtaccccaaaaggtaaagcagtgttaattatggtttacactgtgatgttgtagtcgatggtgaatttacaggtagctatttctgtgcttacaggtggtcgttcagaagaacagccggcggggggttcacttccgtcgtgctggacctcgtcagaaggtatgatatgctgccccctcttttaactattgaaactcatcacttgcgcgtgggctaacagaaacatttggacttgaacctttaggtttattttgagtcagatgaagtgaaagcatgcattgtaacttgtggaggcctttgccctggtcttaacactgtcatcagagagctcgtctgtggtttggcgcacatgtataatgtcagcaaaatctatggtatacaggtgtgggcccttctctaaatggttacataatacttcaatagatagttaagggcttgttcactttgctaccattttcaaccttaccaagttttggcattgttaaattttggtagccaaaattttggcaacatttcatatgcacttactaaaatttggcaacaaactaaacgtagccaaaattttggtaactttgccaaaaaatagtatggttaaaaatagcatcaaagtgatcaggcccttacagtatcatattttttcactgagaaagacagcttgcgcatgttaaggacctgttcactttgatgctattttcaaccttaccaaattttggtaaagttgccaaaaaagtggctacatttagtttactgccaaattttggtaactatataagaaatcccgccagttgctaaaatttggtaaggttgaaaatggcatcaaagtgaataggccctaaatactctagttaaatactactcttgcattttccagacatgcttgatccatctttctaatttttctttggtccagaaaggatatgccagcttaccataagatcttcagattcttatcactgcttatcaatcattttgtattgcataatgtccatttccataaatattcaaaccttatagtattattctactaaaatagtggcaaattgaataagctgctttggattgttttagtaaaatgcaattataaatttgtatacttgtattataagtttagaacaatggatatgtgttctgacaagggcttgccatggcaactataaacatgaatcattactgcgttcagttctcattatatttccagatcttctacctcttaataccttatattacctatcatagaatggatacaagggcttctattctagcaattaccttactctgacgccaaagagtgtcgatgacatccacaagaggggtgggacagttcttggcacatcacgaggtggccatgatacaaaaaagattgttgacaacattcaggatcgtggaattaatcaggtaaatgcggttgtttgcacctatgtgatatagctcttctgattggtcattgtctcatgtgcttatgtacattacccaggtctatatcattggaggagatggaacacagaagggtgcatatgagatcttcaaggtaatttaccactgtggtacaaccgtacaagtgctatgtatgctgtttgctgaaagaatgtgataatagatcctattcatcaatgcattgcagtagcatacggtatatctatttaaatattattttatcgttacctcattgttttcatattggtggcaggaaatccgaaaacgtgggctaaaggtttctgttgctgggattcccaagacaatagataatgacatagcggtattttttttgtgcgatgtgtctatttttgtgtagaaatttgttgtacgcatgctgttcagttgacggttcatacgagattatgacttattgcttatgttacctttttcttgattcttagatcattgacaagtcatttggttttgatacggccgtagaagaggcccagcgtgccattgattcagctcatgtggaagcttgcagtgctgagaatggaataggcttagtaaaactgatgggccgttatagtggtacgtattttagtattccttgccatctctctgagtgtaatgctgttatgtttcttccattgttgaccttgctgaaagcacctatcagtttaaaaattacaagaaaaaacaagccagcattttggccttttgcctgtgattgtactcatgcagaagatctcttgatttttctgtatttcaagcttgaatgcttgattactctgctatctgttctctagtatgtatttcagtctattgcccttaaactgttatattcatcttgcagggttcattgcaatgtatgctactcttgcaagtcgagatgtggtaagcagatgcaaccattctgtctaattcctgtatattttatcccccctcttcatacagtagtgagattcctacttttctggtttaccccacaaatctacttctacctaagagtagttttttttttccgaggtctacctaagagttgtacttatttattttttggatctcaaatctccacaggactgctgcttaattccagagtccccattttatatggatggtgaaggtgggttgcttcaatatgtagagagaaggctgaaagagaacaagcacatggttattgttgttgctgagggagcagggcaggatcttatagccaaaagtttatctacttctgagcagcaagatgcatcaggaaataagctactgcttgatattggtctttggctgactcacaagataaaggtacacaaaacacttaattttgcttctgaattcaggtctgctgctcttgttaatataggtaactaaaacactaagcaattcccactgaaaactgtgatgacttttgccatacagttcactttgactttcaagtatcactccttttactcacttcttgcatgcatctttttcttctactcactattcataacttctattgtaggaccacttcaagagcaaaaagatggagatgactattaaatatataggtaactatgtttgcttcacacaggataaggttgttacacatcttattactggtctctattgtactaagttgtgaagttccctattattatttgcagatcctacctacatgatccgagctattccaagcaatgcatcagacaatgtctactgcacgctgctggcccacagtgctattcatggtgcaatggccggctatagcttcactgttggaaatgtcaacggcagacatgcctacatacctttctatgtgagtaacttcaagtgatcttatttgttcacatggaaaatgcagaaatgtagtgctcgttacacccgggcatcccatttttttcctgattatccaagagctgttcttactgcattctcatactaagcatcagttccaacttaacgtgaaatcttcccttgatggcagagggtgacatccacacggaacaaggtcaagatcactgataggatgtgggcgaggctgctatcatcaaccaaccagccaagcttcctaagccagaaggacatcgacgaagccaaagagaacgataggacggccaacaagccaccacttcccaccggcctcagccatcatgtggcaaactctttcgaccagtctgcatcatcttcgtcgaacagccagatatgaactccatcatgtggcaaaccctttcgaccagtctgcgtcatcgtcctcgaacagcgagatgaatccaatctgtagttctatatagaagctgttgctattcccgttgagaaacctgggccacgctacgcagttttgatttaatatgcataatatcacctgtatgaatccacggatactctcctggattgctggtaactacaagcgtaataagaaaagcgctattgatgaagctatttttcataagcaacactcgtgttgtgtcttgtatatgctgctgatctgaagatatgtttcgtcagctgatcgtatattgaccttttctgtctctgtcactgcagtgcaatgcgtttatgttgtggtacccaaattaggcctgcttggttactggaatactataccacttactactaagtattctgcgcacaaacagcagatcaggagtttgtcagagaatatcatcatatgctgcgtgtctcccgtcagtcccgtgccgaactgccagatgtcccggataagattcagacgaattctgggacgagccacaagatcaacaaccaacccggcaaaatcgttgatgataataagaaaccaattaccagtacgcagtacgcaaaatgcagaacgagctctcatgaaatcatggccaatgatttgatctgcacgaactgcccacacagaatgctggtcgcagtttccggcgcggcgaaaaagtcaagagtccactggccaatcatgcgcccagctgcactgaagtcaactccaacccatgtgaatatgtgatttgctcgtcaattccccagttagttgcagggtcattttatttgggtaaaaaaaattccagggccatagagggtcgaggcattgacaaagaggtggcctactgccctactggccttggtaaattcagaataggcccacccgtcagaggaaacagtccatacatatgcgacgcgtcgactacggcgctcgacaattggcaagcgacgactggacagatgtgctgagtgctgacgtggttaaactaacctcgatggtgtgataaaaggctagttgtagtaagtgatattaagaatgttaaatttgatacttatttactgggcagattaacgctggatataaaaagagcacgtacgtccctattattatgcttcagtagttcagttagctcgctgctgcctgcatgtgcaatggagcgttcaacgccgggaacaatggcggcacggtcgtggttgcttctcctctgcttcgtcgccgtcgccaccgccggagtgctccaagctcgtgcccaacctgacagcaacggtacattccaccatgtcctgtctttcaagttttgatccgcaactaggtagtgctgcttcacaatgaaatcaatgtgctagcgtgtgtaatatgcttggctgcaggtttcatcagcgtagactgtggcctcccggggaagacgggcttcgtggacgacaagaccaagatatcctacgcggcggacgacggcttcaccgacggcggcgcgtgccacaacatctcggcggagtacatcacgccggggctcgccaagcgctaccacaccctgcgcagcttcccggacggcaagcgcaactgctacacgctccggtcactcgtcgccgggctcaagtaccttttccgcaccaccttcttttacggcaactacgacggcctcaacaagctacccgtgtttgatctctacgtcggcgtcaactactggacgatggtgaacatcacgggccccggcgacgcggtgatcgtggaggccatcgtcgtcgtgccggatgacttcgtgcaggtctgcctggtgaacaccggcgccgggacgccgttcatctccgggttggacctgaggcctctcaagaacacgctctacccgcagtcgaacgccacgcagggccttgtcctcctcggccggctcaacttcggcccgaccgattacaccgacgtcataaggtaaatccaagcctcaatttaaattcatatcttacgttaaccatttccattatctaaaaaaaaattaagatcttagctgatcgattgatcgagctgcattgctgcaggtacccggatgatccgcacgacaggatatggttcccgtgggtggactcgaccaaatggagccagatatcatcgacgaagaaagtgcaggatctagacaacgacatgtacgagacgccgacggcggtgatgcagacggcgatcacgccgcggaacgcctccaggaacatcgagttctcctgggaccccgtgccgctgcccaacgacccgacgcccgggtacatcgccatcttccacttctccgagctgcagctcctccccggcaacgccgtgcgcgagttctacatcaacctcaacggcaagccgtggtccctgaccgccttcaagccggagtacctctacaacgacgccaccttcaaccggaacccattcctacggtacccgcagtacaacatctccatcaacgccaccgccaactcgacgctgccgccgctcatcaacgccgtcgaggtgttctccgtcatccccactgccaccattggcactgacccagaggacggtacgtgcgtgcgtgcacattggttgcagacacatgtaagattaattatcaagcatgtcatgcgtgtttg

SEQ ID NO: 75008 - DNA, 38224 bp, Oryza sativa
gaatggaacatcgacgatatccaagcccaagaaggatcctaatgcggccaaatcttgtccttccgacgagaatcacgagccgacaagaaccacttctgaggcaacaaggtcttggtgtcctatccacaaaaccaggaagcacaccttgcaagcttgctgggtttttctcgacgtacaagctgagatccgtgcctgcaaaagcgtggaattcaacgtacttctccaacccgtgatgtctattgtcctattcacaagacaaagaatcacgacctctcaagctgcaaggttcttctcagcgccatgaggacgtcacctcctaaggtccagcagtcatagatctctcttagagatgcgcacaaggaatgaggagcagcagttatctcagatcgattcgttgggataatcgacatcgatccccacgagccgtcagttctacacttgctcgaagaccaggcctcatcatcgacgaatacaccacgcgatgtgtttgctatcgatgggaccaacacgtctgtgcacgccaatgcagaagtggaggatcaagtggttacaccagcccagtacatcagggctatcaacgcaatactgagagaaaccctttatgatcccattctggacgatgatctcgcacagtggacagaacgactatgggaatcagtggctaacctcagtaacgcgttcgaagaggccgccgccggagtactgccagaacaaccgccaactggcggtgccaatggcgaactacctgagcagcgggcatcacctcgtcaagcccctactccacctcgtggcaccagtgatctccgtgaacatttgaatggccgccgagaagcatgacgcgcacgagacaacgaaaatcgttcccgacatcgcgtctcttcacgacgtcgtgaaaacgaagagcgaggaggacacccgagcgaaaaccaagaccgtggtaaccgccacaaccgccacgatcgcgacgatcgcgaacagcggatgccgggcgatactggtcgaggacgctgccataacgatgatgatgatggagatcagcgccgggacaacaacggtgggcgacgataggattctcgagaacccggacgtcatcctcgtaatcgtaccccggaactaagtcactcatcatcatcgtcatcatcctcgtcatcagacagacatccatggaggacatacgatcaccaacaacccaccgcccccggcagcggatgtagagcttttagtcgtgccctacgagatgtccgatggcctgagagattccgaccgggagaatagagaagtacgatgggagaaccgaccgagaggagttccttcaggtctactccacagtactctatgctgccggtgcagacaacaatgcgttggcaaattatttgcggcggcgttgaaaggatctgcacgttcatggctagtccacctcccaccatactcgatttcttcatgggcagatctgtggcaacagttcgtcgctaacttccaaggaacatacaagtgccacgcgatcgaagacgacctacatgcgttgacacaaaatccgggcgaatcattgagggactacattcggcgcttcaatgagtgcagaaatacgatccccgagatcaccgatgcttccgtgatccacgcttttaaaactggtgtcagagatcgctacaccacctaggagttggcgacaacacggatcacaactgctcgaaagctattcgagattgtcgatcgatgcgctcacacggacgacgcactgagacgcaagaacgataagccaaagacggcgggagagaagaaaccagccaaggacgcacctgagtcaagcaagaagaagagtcgcaagagtgggaaaaggaaagctcaaacggaagtcatcgcagcagaatacgcggacccgcccaagcacctagacccacagagcaacgacacgaagaaaatatggtgccctatacacaagtcagacaggtactctctggaggattgcttcgtcttcaaaaagtcgctcgcaaagcaactggcattggagaagggcaagcgagtacgtgtagtcgagaaggccgctgaagcagctactcaggactcggactcagcatacccagattccgatctccatgtctcgcacatcttcggaggttccacggcgtactcctcgaagcgagagtacaagaaagtggagcgcgaagtttgttcgacatggcagggggctgcacccaagatgaagtggtctgagcagaagatcgagttctcagaagaagaccaccccaagactgctgtcaccccaggacgatatccgatcatggtcgagcccactattcggaatatcaaggtcgcatgagttctcatcgatggcggcagctccatcaaccttctcttcgccaacaccttggacacgatggggatcccacgaagcgagttgactcccactgatcaaccctttcatggaatttctcctcggtcgtcgtccaaaccattgagcaagatcacgcttcctgtgacttttggccatgcaaacaacttccgaacagagcagatcacctttgacgttgctgagtttgacacagcatataacgccatcatcgggaggactgcactcgcgaagtttatggccgcatctcactacgcgtatcaagtgctcaagatgctcgggccgaagtgaacaatcactattcagggtaacgcaaagctggcggtgcagtgcgacaagcggagcctcgacatggtcgagcacacacccaacccacccgccacagccgagccacccaagaaagtgagcaaaacaaacaaaacgccgcagccagacggcgcaatcaagatcgttccgctttccagtgccaaccacgacaaaaccgtcaagatcggggcatcactggacgagaaataggaactcgcgctcatcgccttcctccgcgacaatacagacgtgttcgcttggcagccgtccgacatgccgggggtccccagggaggtgattgagcacaaactcatggtgtgacccgatgccaagccagtaaaacaaaaactgcgaagatttgtaccagaccagaaacaagccatacgagaggagctcgacaagcttctcaaagctggcttcatcagagaagtactccatccagagtggctagccaatccagtcatggtgcggaaggccaacgggaagtggaggatgtgtgtccacttcaccgagcttaacaaggcgtgtcccaaggttcacttccctcttcctcgaatagaccaattggtggactcaacagctggttgtgagttgttaagctttcttgacgcctactccggctaccaccagatcaacatggcgaaagaggacgaggagaagacagcattcatcatgccgttcggtgtattctgttacattaagatgccgtttggactagtaactgcaggaaataccttccaacgcacggtccaaggggcacttaacgatcagcttggaaacaatgtcgaggcctacgtcgatgacattgtcgtcaagaccaagacaagcgactcattgattgacgatctccgggaaacgttcgacaacctccgacgatatcgcctcatactcaatctagagaagtgcacgtttggagtaccattgggcaagctgctcggtttcctcgtctccggaagagggatcgaagcaaatcccgagaagatcaaggcaatcgagaacatgaagtcgcttacaagactcaaggaagtccagaagctaactggatgcatggcggcattgagcagattcgtcgctaggatgggagaacgaggacaacatttcttcgctctgctgaagaagcaagacaaatttgtgtggacacaagaagcggaagatgcgttcatcgcactcaaatactatctgtcaaatccccctgtacttgttgctccccaacctaatgaagaattattcctctatattgccgccatgcgaatattttgtgagtactgtcattgttgtcaagaaagagaaggtgcaaagaccagtctactacgttagcgaagctctccacgacgcgaagacaagatacccacaaatccaaaagctgctctatgcagcaatcatgacatcaagaaagctatgccactacttccaatcccacagagtcacagttgtttcgtccttcccacttggtgaagtcatgagaaacaaggacgttgtcggtcgcatcgcgaaatgggtagtcgagctaagccagtttgatgttcactttgtgtcacgaacagccatcaagtcccaggtcctcgctgactttgtagctgactggactatgcctaacaacagggcagacagtcaggacgacaacgagacatggacaatggcatttgacggcgcactcaatagccaaggagcaggggcagggttcatcttgacatcaccttcgggacatcagttcaagcatgcaattcacctcaacttcagggtaaccaacaacacagccgagtacgaaggactactcaccgtgataagagcagctgctgcactaggggtcaagcgactaatcgtgacaggggattctgaactagtcgcgaaccaggtgcacaaagattacaagtgctctagccccgagttatctaagtacctcgcagaagtcgggaagctagaaaaaaggttgatgggatcgaggtccggcacgtgtactgcaaggacaacatcgaacctgacgacctagcacggcgcgcgtccagacgagagccactcgaacccggcaccttcctggacgtcttgacaaagccatcggtgaaagaggcaaacgacgaaaatagcatagtcgcccccgacatcagctcgggggctacagaggtagaacgcgccgttgccaacattgagaccgcatacgactggcagaccccactcatcaagttcctaagtagtgacgagttacccgaggacgatgcagaagtcgagaaaataacccgtcaagccaaaatctactgtatgatcggcaacgatctatacaagaaggtgccaaacggggtacttctcaaatgcgtctcgtccgacgacggcaaacatctcctcctcgacatacacgaagggatctgtgggtcacacgccgccagtcgcacattggtcgaaaaagcttttcgacaagggtttttctggccgaccgcccttaaagacgcttgcgacatggttcagcagtgtgaagcctgtcaattccacagtaaacacacgaagctaccagcacaagcgctccagactatccctcttacttggccattctcgtgctaggggctcgacatacttggaccattccgacgaggacagggcggctacaggttcctattcgtggtgatcgacaaattcaccaagtggatcgaaacgacacccacgggggaaatcaaggccgacaacgccatcaaattcatcaaagggatattctgcagatatggattgcctcaccgcatcataacggacaacggctcccagttcatcagtgccgacttccaggactactgtattagattgggagtcaagatctgcttcgcctcggtttctcatcctcagagcaatgggcaggtcgagatggcaaacggcatagtactacaaggaatcaagacccgtgtctatgacagactgatgtcacatgacaagaagtgggttgaagaactcccctctgtactatgggccatgcgtaccacaccgacaacatccaacaaggagacacccttcttcctcgtgtacggctcagaggccatgctccccactgagctacaacatcagagtacacgagtacagaagtacttagacgaggaccaggaggagcagcgaaacgacgacgtgaatctactcgaggaacatcgagaaagagttgccgtcagaggagccagctaccaacaggcccttcgctgataccacgagaagcgcatcagagcacgcacgcttttgatcggcgactacgtcctccgacgggttcaaagccaagcagggcgtaacaagctctcacccaagtgggaaggactgtacacgatgacgcaagtcttgtggccaggtgcattcaagattgcagacggcgatggacgcgagttagcaaattcttggaacattgatcaattacgtaaattctatgtataaatcaatagtatccatacttgtaagacatcttacagcttcaataaagctcattttcaggtaaagatcgcaatcaaagtgttccttcccgacgatcccttaccacgacgatacctagcgttgaatcctatccttatgtccttttacgccgtcttgataaggcctctgaggaacctaagggaactttggctggggacgcccagagcggataaggccttgtcggatcatgtagagacaaaagactatgtaagatctggttgtgtaagagttctcgccgtgcgtattaaccaagccgtgtaatcggaaaccgagttttccaacttcacggctgggggctaggatcagtgcttgttcaaccaaggcaggtcaagagtccaagagcctcatcttccaagaacaaattctccgatgacgaggctgggggctagggagagtgtatgactcaagcgactgatcgaagtcgtgaagtgagaaaacactcatacacagcacatccagagtaagaaaacttagttaaatagatttcttttctatttcgcaagtacttcttacaatttgtaaatattccaaaatatgttacatatctccttgagatatttgtcacaggatacaaagactacaaggatggccaacgccagtccatagactgaaagactttctccgcaagtggcgccatcgacttcgccaaattgtctatctctacgggagtcctccgagaacgtgaaaacccttcgtggaggaactcgaggtgcagctgcgggcggtgatctcggatacaggctagcacgtgtctcggatacaggccagcacgtgccctccggcatatcggctcgatcgacgacactcctgcttcagggcctcatcgatacgcttgccgatgccttcaagctgagcgtaggccccattcaaccacgagatgtatcaggccgctgaatcctcgggattcctgcgaggtactcggagttcccagcagactctggccattgccgtacaacagctcctgaggtacgagttgaaccacaccttgcgacctcggagtgcctccacggctcggtccttcttcacttccaccatagtcctctcgagttcggccacctcgaatttcgtcctccagtattggattcgacgatctcggtcggccagcacactctcgaggtctgctcagcacggaaatgactaagtcaagttgttcttctctctcgagaacacagcaaattaagtcaatccgagcagaagactgaaggagacaaagaccaaagtaccaacgtaaggatgtcatcgccacgtccgcctccacggacaggctttgatcgacatcgtcccgcggcacgtatggctcaagcgcaagtgccggaacgactaccggcgacttaggctacccgcgctgctggacatcctcgatatcgacatctctacaacgacaacaaaatactcggaatcaacatggtaaggaaaacgaaggtgacaactgcatacacaaaggcagtctgaacctataaaagttttacaagcacaattgattaaggagtacaaggggaataaaatcctactcttcaaaaagggggagaacagactcccccaagtcaccgacttcttccatcacgcccttacgcgcgctgttggcggccccctgatccagaatcttctggaggtcgagatcagggcacgccagtttcacgcatgcgaggacgtggcacgccctggtatagatcccgttcgacatctcctcgccgatcctggccgcatgcttggaggggatctcctccattgccgccgccagctctgcgagcaaggacgtcagcgagaactcgtcgggggttgccgggatggtggtcgtgacgccgcactccccgacgagttggtgtaggccagtgtaagacacccgcagcgagccgcggatctccgacaagttgttctcgagctccgacatccggtgctcgagcccttgccgtttcctttcgttaccggtcaccaactccctcatcttgagaaggtcctcgtgggtctccgccagatcacgcgctagctgctcggcgcgtcggcttgccgatgacgccgttgccctggcttcctcgatcttgtggcccacgccatgagcaccagcctggaggatgcgctccatcttggcttggagctccccccggtgagggcatcaacaggcgggccccgagtgggcacaaggccgccggtgggcccacttggcgtcgcctcccgttccctagtcgcgaccacgacatctgtcgaagccgctgcaggagacgcactggaggtcgcaccggacccgtcttgcaccgccttcgcccgcaccgccctgcgaaggatttccacggtttcataaagtcaggcgacgaaggtttcgtgattgaaagaacctcaaaatcatctacttacttttcgccaagcgtcaccagcctttgccgtcgctgaggcgggggggggggacgtgtccgaggcctaagtatgataagcatggtgtgaggtcaagatcttccgactacgcgttaggagacaagagaggcttaccgatgggttaggcgccttccggcgggtcccaagtacagaggagaatttcctctctctcttcgggacattgctgccactcgtcgtgggagcagcaacaacgtcgaacgcctccttcgcgatgccctctttcaacgacgccgccgcctgatggtccacgagcagcccgatgacgtcagtcagagggagagcctgcacaacatgaagtcacaacgcgatcctggaagaaaaagataaaagggtcgttgagtacactcacgttgattgcagcttcgcgttcggccgtcccctcctcgcaaagggggacgacgatgttgctcgccgttgtggggccgctgatcattacttgaccgacgcagcgctccacagtttcgctgttcaaacctgtaggatcgagaagcagaactcgataagtcaggaggaacgtgcacgtaaagaacgaaatctgatatacgagaaaaataccccgaggagaaacccgggccgtgtcctctggcccagaatagtcaaaggctgggtggactcgagcctggagcggctggatccgcctaccgatgaagtcggcagcaacttcataccccgacaaccctcgtactcggaggtcatcgatgatatagatgaaagactgaagggagggagttagggcctgtgttaccctgatacggctgggaaggagcgtatccgtatcagatacgtaataggatacggatacgtatcggatatgctccgatacgtatcccgtacgtatccaccgtttttccgactttcaaaaaaataaaataattaggatacttctctgatacgcgtcagatatggcccaatctctccttctttacgggataacaaccctagccgcctcccatctctttgcgcacaacggtgccgtcgtccttgaccgcggcaccaccgcagcgtgcatgctgccgctgcgtgctgccgagcacggacaccaccggcgtgcgctgcttggctgctaagtacgaaatcaccgccaccgtcaagcgccgccgagaagggaatcgctccgccgccgtcaagtgcagtcgagaagggaatcgccgccaccgccaagtgattcctgtggttgctaggcacaacaccatcgctgcacgggttggtgcctcggtggttcaagtgaggtaggcatgagtactgacagttgagttaaatcacttctttgatctgcaatgattttttttgtttcttgttctcctttcttattttcggaacaaacaactgccatattactatttcagagatccgatagattatgaaattggaaactcaggagtactaagtgcatccaggatcttaatgttgggcgataacatcattcttttttattttggccaccgcatagtagccgtaagtgacttttacagatccagtaattactagtactgccgtacttgaaagctatgctcgatatatctgtgtattgcttcctttagttatctctgaattattggcatgttcattattttgggcttaatcagttctgctattttctttcaggagttcattgatttttattatttattatgtatatatagacgtatccccgaatccatgatttttgaaaatagccgtatcccggtatccccgtatcgcgtatccgtatccgtatccacgtatccgggtaacataggttagggcgggtttggcgatccacgccgggatcttgtctggttgctcctcaggaacaacaaagactggatccgaatcttttatctgaagatagaaccacctcgcccgccatttgctacgagaagaggggcactagaaggggatgtatcgcaacttcaggccatcccgaagcaggaaatcgacacatccggatatctttttaggttccatccagcgcaactcatagtagaagcggaagaggtcaagaaacgactctaccccaatgtaggcctcacaaagataggagaagatactgaggaaggagatggaattggggttcagatggagcaaggaaaggccgtagaaattcaagacgagaagaaggaagaaaaccgtaaagaatgtaatcctcaaccgcaaccatgcggcccaggacaggttcaggttcaatacctcttgtttctcgctccatggtcccgcggccagggagagcatcgtcgtcctgcagtttcttcagggacgcatttgtggaggtggacttgtcgagatccatccccgccggagatcgccggagatcaaaccgagatgaacaaactagggtttttctataggagcggagaaggcgaggggcgtgtggaagctggaaagtctttgctgcaagcagacttcaaaatggatccctaaaactcccttaaatagacgcactaccgacggtgcgaattccaaggaaaggagagagatagccgccggaaatttctgggtccgttacacgcagcagttttcggacttcaatttaaattcactcatgaccgttgaacttcacacggcgttgtcgattactctttgtctctacggttctcacaccgagatcgaccagtagagaacgacaacgactccgacatcagaagtcgcgatcgctcacatgagttcatttaagcagaagtcgggggctactgtcagggttatggataaggtataccctttacccttagatatacgttgtacactgatatggtatacctgcgtgtgtgcggatatttcctgtacacgttaagtaagttcattatgtaaccaaaacggagtccacggatggaatgagtcctactcgggtagaactgggtcattactgtatcgtgtggggtccgatgtctccgagttctacttggagaccaactgacccgcggtataaaatggaccccccgggaggacctaagacatcgaatctcaccgccaacacatccaccacagcctatgaagtcggagcctacaggagccaagtcgccgggtgatctagtcgaacctactcgactacggtctcatcagtatcatcgagttttgctattccctttgtaatctgtggttatcatcatataatcccataccaattggattagggctattacctttctaggggcatgaaccagtataattgctgtttcctgtttgcttgatgtcgtactagtagatcctcgtagcagtgtaccccaataccctctatatccggtctacgggtatccaccatcgacaatgcggtcctttctcctgcctgaaaaaactacttttggttgtctaggaaaacaattttcctagtagtgaatccaatgcaatgcgttctgatatgtttggcgacattctcatctctttttttcccttcacctccactaaatctggctaaacgaccatttttttttcatttcgataagtattcgatggtaatcataaccacctctgatatctattactcatgcatgatgcatgacgatgcgaacacgcatttcatatactgaagatttaaaatttagacttcgtcaagaaaatggaaccattgcatcaggatatgccatgcttttcctaagcttaaccaaatcgtcgcaaccgttgccggctggtatgctttcacagccatatccatgtgtatgctctcccgcataatcccatctgtcgaaacaagatttcggcaataataaaagggagtggctatcaagctagaaaagtgtatgggtttggagacaaggaattttatacaggttcaggccttcttattaaagaagtaataccctactcctgtccggggatgattccgccgagtgtgttattgattgtatgattgggagaaaaaagaatcgtgccccaagaagcatacggaccctccttatataggggaagggatccgtaatacaaggtacagtccatatcctaacggaatatgggattacagataaaatacaattgtagccgactaggatcccgggtattttcttgacacacaagtttagagcctaccccgagtcctcataaagatattctatctatatttagtaccatatatccaactaaagtataactgtcatgcagatatggggtatccataatctccacagtagcccccgagaccttcgcagttgacgaaacaaaaaccagtagtccgagtgcttcaattcaacttgctccagcttgctgagtactaaaaatcaaaaactatgaagggcgaaaataaaacatggtgcatcgagtagatgcacctaattaggtgtagcccccgactatgtgattagttgaaaaactaaacatatagtcaagcaccgagtggttttatagcgaagcacgcatggtacttagtaagatacccagccgactgcttctcaactttaatatatcaaggacaaaaaatacaagaggggccgagtgacaaacactcaaaaggcccaaaaatagatatatttgataggaatccgagcaagaaactcttaaaatgacccaccaaacatgacagaaaatcatggtaattaatgagtctaacagccgaggctgtgacccttaccatagccaaaataagcatataacatgctaggagaatgactactaataaaccagtcatctcaaattaacccaagagctcctgtagcctaaaaaagcttacaaaaatggtataacacctttctgttgggcaccttttcatgtgcatcataataattccaaagaattattgaatcgcgttaaaaatgattttaacagcatcgggccgtgtcattgtgagcacatattgccaaagcaaaaagcgcctaagtccctagggatcacaacgggccacgctgaaaacataattgggctgaagtactgtacaggcctaggcccattagtactcccgataccctaaaaataccgaagtccaaacgtcgcttcgtcttccccgccgagactctcgccattccccactccgtgctacagtacagaaccgcgccgacgaagttagggttcatcaatccgctccaatccatcctcaaaaacttcacaaaatttctccccgcatccaccgctccgagtccccatctcttttcagccatatctcgaactaaatcaaaccatccagttcacattcatggcggaagaaagagaaagcttcgagagtcagtgggcgccctccgatgtgacagaagacaatctgaaggagatggtggcgcacagcgttcttccagcaaaagagatcatcgggtggcgaccagcatttggtgaggcattcccgacccccgacacacacgaaatcgtggtattcactcatttcttctacggcggattttctcttccaacctcaagatttttccggggcattctgaacttctacgggattagcttgcatcacttgaatccaaactccatagtacatattgccaattttatctacgcctgcgaagcttttctaggcattaggcctcatttcgccttgttccgccgcatcttcttcctcaagccccagccaaacaaaatcaagccgtgcgttgttgggggagctggcttccaactcagaggaaccttgagccaaaaatatttctccatgcccttcaaaacctcaaacaaaggctggcatgcgaactggttctatgttcagaatcctgagcccgcactccccgagtattgctgtcttcctccggtttaccaggacacatggagctcattgcctataggagatgaagctgctcaagcagtagaactgatggagaggatgataaagctaaaagaatagggtcttcaaggagagcagatcacccggcactttatcatgtgtcggttagctccaatcaaagaaagatcccgcacagcttttgagttcgatggcaagcatgatccaaatcgggaagatccagattctcttgactttaaggtcatgaaagaaagaatgtacaagatcttctcaaatgctattgttgtcagctattcacatctgctgcccgtcgtgccattcaacgcattcaaccctcctccaccggtatgcactcaaacatttcaacctccctcaagatatgatcttgtcttcctgttgaatcaattaacaatgaaagatattgcacccaggaatttgctttaatgaagtcggatcccccaatcgctcaacgccgatctccccgccaccaaactgggcaagggagcggaggaccaagaattcggtctgaaactcaaccaggtgcttctgatccagttggccagtcagactctcgaaagaggaaactggttctgagtgacgacgaagccgatgatactaccaggaggccttgagaccgagagacaaccaagaaactaccaaaacaggctactctaaggaagaaaacatcagtcgccccgcgccgaagatcaggaagtcttccaagtacaactcatacaacgatctctcttgcattgatgcgcatccattgcggcaataatactgataatcaaacttgcaggaaaccatctgccatagatccgtctgggaaagactctgacccgactagtgtggatgcaagttcttccaaagaaaccaggccaactgccgaggaccgtccgagtgacaatcagccgacaatcgataatgtagaaaccggtgatcaaccaccgactgggaatcagtcggctgaagccgaagccggggttaatcaggagcccccgactgaaaaccagtcggacgcagggccaagccaagagattccagaagttagagctcaagcagacagccttcgcggacaagacgccagcaataaccagagatctagatctcctttaaaggcatccgaacccactcgtcctcgtccaaaaatcattacgggtaaaacactttgtctgaaaccatgtcgacccaaataactctgaccaattgtctaacctctgtcagtggatacattagggccaatgatcggtgatgaagaagaaattccccgcatacaagcagctgaggattcacaccctccgattctggtcaagtggtgggatgacaacatgcagcctcaagggatcatgataaataagcaaaaagaggacgaagagttatgcctactgaagaaggcacttggtcaggcgacccgcattgtaaatgtaagccctctggcacctgatctcaaccatcttgtttgccatttaattcatgcgccaattaaactgtcttgcagaggattcatcttaggaacgaagctaaaacagaaccttagagaagctggtccctcatctcgggaccctcgaagccaccaggagtctgctgcacgagacaaaagagcttgccaggaaaaatgagcatgatctgaggaatcgaattactgagctccaggaatccaattttgaactgagtggctcatcaaaaggtttgcgcaaactctgcccaactgacttgtgctgttagctctgtaatcctgattaaccgaagttaatatagtgcaagctgccaagatatctcagctagagaagcagatccaaattctggaaaatgacaaggcagaactggcaagacaaagagacctggcttcaaaggaagttgaaggtatcaacaatcaatacctcaaaagccattatcctccatatgctgacttattaatgtgaatctgtcgatgcagaccgcaagatcaaatctcaagctcaattcgacgtcctggttggcaagatcaaaaaacttaaaggagcccgggatgaggttcctaatgctgctgccccaattgttcaagcgatgttcctcaataacaatggcccgagtgcacttgatgcttctgaaatttttgacaagctgagagttgcttcggatatatatttcaagaacatcaaagaagctggaagtatgggagcaagtatggcgttggcgatgactaaatccctttatccgagagttgatattgacgccattgatggctttgcagacgggacgagcgaagaagctgctcttgacctcatcagtgatgcgaaaaaagcggctgacaaaattgctgctgatgtagttgagagatttcaggacaacgatcttcgaccgactggtcctgaaaattctgatgatgaaaagactgatactgattaatgtaccgataactttgatgattaacgatgatggaggcacaatttgtacaatactgatgaatttatgctgtgcttgatatcttagcttagctcctgatttcttaaaagtttttgtcaaaccttgttgagcctaaaacccgcaaaagttgttaaaaaactttcagtcctcattgactaagccaagaaatcaaacagggcaatgatacatcaagtaagcaacttgaatggataaaaatcacactccatttttattatagtagccccctgactgaaaacttcgaggaaaaacttgaagttagcagtcaaagaggaaagatacaaacgaaatgcctaagcgtaaaatcgacgaaggtgttcaatattccaagaattgttaatgatagtaccatcttcgtgcttgagtcgataagaaccaggccgagtgacttcagcaattatgaacggtccttcccataaaggagataatttatgccgatcctgtgttgtttgaattttccgtagaaccaggtcaccgactaaaaaggctcgcgatcggacattccgattatgataacgacgcaacccttgctgatatcgagtcgattgaattaaagctgcctctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggccggtagcccgactaggagtagtacgtaaagaccaaagtacggacggcagctgatctacccacttgccagcataggggagtagtcggtcgaaaactcgtgctttgatcccttgtagtatcatgccgttagcgctctcaacttgtccgttactcatggggtgtgccacggaggcataacaaattttaatgccgaagtcttcacaaaagtctttaaatgctccaccggtgaattgagtgccattatcagtgatgatccgattaggtaccccaaaccgatgcacaatgttgatgaaaaaatctctagctttatttgctgtgatcgtgatgaccggtttagcctcaatccacttggagaatttgtcgatagccacaaagagatgcgtgtaaccgccgactgcccttttaaatgggccgaccatctcaagcccccagaccgcaaacggccaggacaacgggatggtttgcaactcttgggctggcaaatgagtttgtccggcaaaaaattgacaaccttcgcatgtccgcacaatctcgtccgcatcagacacagctgtaggccagaaaaaaccttgccggtaagctttgctgacgatggtccgtgcagcagcatgattaccacaaatgccagaatgtatatccttcaacaattgtctcccttcctccaaagatacacagcgctgcagtattcctgatggacttttcttgtatagttcagcttcgtgaataatgtaaagtctgctgcgcctggaaatccgctcggcttcatttttgtcttgaggaagttcttgtttggtcaaaaattctatgagaggttatctccagtcggcttcaatcatgcttacgccttgagtatccatggcttcagttgtctcttttctgggcatggtcggttcgtaaagatgttcgacgaatacatccgaaggagctgcttcccgttttgaaccaaaattggctagtctgtcggctgcctcattgttatgtcggaggacatgggtgagctcgagtccatcgaatttgtcttccaacttgcgtacctcttgtcgataagcagtcatattatcatctagacaagaccactctttcatgacttgattaacaaccgagagtctccacggacgattaatcgacgaatgcttaaagagattgcaatccttaatccatggagtagcgcctcgtattctgccacgttatgggacgcagaaaaatgtatccacaatacgtagctcaatctttctccagtcggggaaattaagacgaccccacctccagtgcctgcaagcctcttcgacccatcaaaatgcatagtccaatattccatttttttcctctggcatatcttcttggcactcggttcacttggcaaggaaatcagctaaagcttgtgacttgatcgaagttcgtggtttgaaagatatgtccaaagacatcaattctaaggcccactttgcaatctgtccgtttgcttcgcgattatgaagtatatccccgagtaaaaacgatgtgaccactgtgaccgagtgactttgaaaatagtgagataattacctgacggtaattaagacaccatataataacttttgaacctgaggataccttgtcttggagtcggctaaaacctcgctgacaaaatagattgctcgttggactttttgaatatggccttcctcttcacgctgacaaccaggaccgtactcacaacctgggaggttgccgacacatataacagtagtggctcttgtggatgtggcgaggccaaaactggtggagtggtgaggagttccttaaagtcttcgaaggctttctgtgcttcgggtccccactggaaattgtcagtcttcttcagcagcttgaagaaaggcatcccccgctcgccgagtcgtgagacgaaccggctgagcgccgctatgcaaccagtcagcttttggacgtctttttgggagcttggtggtttcatgttgaggatggcattgattttctccgggttggcctgtatgcctctctgagataccataaatccgagcaacttccctgacggtactccgaagatgcacttttccgggtttagtttcatcttgaaagcacgaatgcttgtgaaagtttcttctaaatccgcaatcaggtcatccttctgcttggtcttgacgactacatcatcaacataggctttaacattgccctgtctttttccgaaccaggactgggttagccagccagtcgggatgaaggacttcctttatgaagcctgctgctaacagcttggttaattcctccttgatcgcatccttcctgtcttgtgcgaaacggcggagtcgttgcttgatgggtttggcgtcttccttaacatgtaaagagtgctcaatcacctctctggggataccgggcatatcggatggtttccacgcaaaaatatttttattattctgaagaaaggtgatgagcgcgctttcctatttacaatctaactcagcgcctattacagcagtcttatcaggatcggagggatctaggggaatctttttcgtcttggcatcactttcttcggtcttcgtcagcttggttgcaggtacttctccctcgcttgccgtggttgcagccagtcagatctcttcgcgagcaagagtagtctcgtgggtttggaccatctcgcagctttctttgtcacatgtgacggcctgcttgatgtcgctccgtagtgatatgacccctcgagggccaggcatcttcatcatcatgtaggtgtagtgtgggacggccataaatttggctaaagccggtcgtccaagtatagcatgatatgctgtctcaaaatcggcaacttcgaaacaaacattttctgtgcgaaaactttctcgagtgccgaaggtaactagaagagtgatctggccgagtggtgtagctgacaatcctgggataacactgtggaagggtgcattactcggctttaattccgtgcgaggaatctgcatatcgtccagggtcttagcgaaaaggatgttgagtgcgctgccaccatcgatgagagtccgttggagcttgacattgcgaaccactaggtctagtaccagggggtaccgccccgggtggaccactcggtcgggatgatccgagcagtcgaacttaattgctgtttctgaccaccgaagatattgggacgtgttaggctgaaccgcattgatctcccgctctgtgagcttctgttttctcttggactcataagccaggggtccgccgaagatgtgattaagttctttgcgatgatcttgaaaaccagtcggggcatcgtcttcatcatctttcttctttgatgtgccctaatctccgtctgcaggtttgcgtgcgttcttgacgtattgctccgcgaactgtttgtagacgaagcaatcgttggccacgtggttggaattgggatgatgcggacattgagagttcattatcttgtcgaaggtgttgacgcggggacgttgtcgggaagatggagaggtggtcaccacaagttcttcgggcttacgcttgggatccttgtggttgttacttccactccctcctgtagtcgacgtgtccttctttggcttccaagtggtgcccgactgtttggacgcggtgatagcatcctcggctttggcatactcgttggctttttcgaacatctgcttaaccgtcctgggaggtttacgtccgaacttgccgactaggtcctcgtggagaatgcctttagtgaaggcggcgatgatgacgttgtcggtgatgtcggagatcttgttgcgttgttcggagaagcgtcggatgtaatcccgaagggattctccagacttctgaacgaagttgtagagatcaaactgtgtgtcggggcgttcaaaggtgccctggaagttggcgatgaagtgatcacgaagttccgcccatgatccgatcgtgccacggggtagtccgtggagccaggatcgggcggagtccgctagggccacaagtagatagtttgccatggccttgctgtctccacctgctgcgcggattgcgagtctgtagacggtgagccaagactccggattggtggtgccgtcatacttctcgattccagtcagtttgaagctgactggccaatccactcgacgcaggtcattagtgaaggcagctactccatccacgtcatcgtcataacgatttggtgaatgacggtgacctcgtgctgcacggcactggttgatcatgtcacgaaggtcgacgggacgctgacgaggtggagaacgaggtcgttcagctcggcgctccctgtgacgttcgggaagcgagtgaacagatcgttcgtcgtgacccctgctcctgcgactagatcttgtgccagtgacgctgaggcttggctgatgatgagggactcggctaccagtcggggtgcgggtgcttgcggagttgactggaaccgaggcagcgatcatggtcttcgtctggttcaagatgttgacaacatgatcggcttgattgagtgcgtcttccttgaggagggtgtcgaggagagtgattgctgcaaccgcgttctgctggggggtgcgaaagactgctgtcccgtcgacgtcttgttgcccaatgagctctctcgctcggcgcccagattcccaggcgcggtgctgtcgatcttcagcttcctttgcaatccgttcgcgatcttgttgctcccgctgtagtcgttctcactcctgtcgctgtcgctcttcctccagtcggcgacgttcagcttcttgccgtgcgcgatcttagtctgcttctcgggctcggcgctgttcttccgtttcgttgtcagccatgaatacgccgaagaagaggggtgtgtagttatcctcgtagctgtcgtcgaagttgtcgaagtcgccatggtcgtagtggtagccgaagtcatcgtagtcgaggatctcggttggtcgagaactgacgccgggggagctgaggtagccatccaactcttccgtcgagactgtcccaagaggttggagtataacgccaacctccctggatctagactggatcggggccgatgccagagctcgcctagatctccgagtgggagatgttttggctgtgaagacggcggccaagtcgtcaggaagtttcatcaagattgagggataggacccatcgtcttgatcggatcgtggaggaacagattggatctcatccgagtggcttgaaaccaactcaggagagatgatcttggagtaggcctcggccgagttcggaataccaaacggcacggggacctggtttctccccgactggtttgaatccgagtcaaggagagagatcttgccgaagtcgttggtgatgaagtcgaagctgccgaatcggaacgcctgcccgggagggaaggcgaagtcgtcgatgccagaaacgaaacccatcgtacttagtcggcgagaacttgacgcctcccctacctggcgagccaactatcgaaacaagatttcggcaataataaaagggggtggctatcaagctaggaaagtggatgggtttggagacaatgaattttatacaggttcaagccttcttattaaagaagtaataccctactcctgtccggggatgattccgccgagtgtgttattgattgtatgattgggagaaaaaagaatcgtgccccaagaggcatacggaccctccttatataggggaagggatccgtaatacaaggtacagtccatatcctaacggaatatgggattacagataaaatacaatcgtagccgactaggatcccgggtattttcttgcacggatatatcattgtagcatttcgcccgaaagtattctaagggtatcatatttatttaatcccgatggaagatttatgagagagaactatgctaataatttatatgttacttgtaataatcagtcttagcagtagttaatttaattcatggtagagtgacacaaagcagaagcactaaacactctcataaatactaaaactaagctaactagagaaagaataagaaaagaattcatccctatacctctattatacataaaactttagtatgtactttctagtatacaatcatatagccaataccccatgtcgagttccttacgacaatcagtcatggccatccaaccgaggctaactacggaggagtaccctccctaggaaagtaacttcggattatatactaacgtggaggaatacccgtactgagctgtcatcatcagcggcccacctctactgtcccgcagtatataaccccaaataatagtattcaataatttaagcaccacacttaaattactaaatactacccgacaatcgccgtcaccacttagaccaatcattaacatgatcattatacacacactaatgcatttcgcaggtaagcgagctacacaattataacaagataaatatatcgtaaagtcggtactcgaatgattcaaatgaagtaaagtaccgcaattgtatacaaaagaatattctataaatcgtataagtcttacaaaagaacaaaaagctactagagccatacccaaattcttctcaagactccgaggactaagaaaactattctactcctactccactagctctagaacactaactaaacttgagagagagctttgatcttctttcttaagtgtgtgatggagtcaagaaggtgagctccttaaatagcctcccaatgacggttatgatggttggaaaggtaggaaatgccctccatccgtcattggagttgaatctttgccgtccacccaaaaccttgcatccagcggcacttagttcggccaaaccatgggctggcccaaccggcccagattttggttggtggatctcttgttgggctttattccttgtgctgtgaattttgggctcatttgcttgtgttaattctgtgttgtcagcccatcatccctcaagtctgattctcgacagcgtataattgattgtttgtccattttctgtcgatcctcctccattttgtgtagcattctctgcaagcaaatagaatacaagttcaagtggaaatacattattccaaaacaaatatgtattgcaggtatagctagttctcctttattttagtaatattgatggtcgaaattggtctataacgaccgtcaacactggcggcaacgcggttgggagcgacgaacgacgacaacgatggaggacggcgacgatgttgacggcgacagcgaccacgaggagggcggcggccgacggcggttagggttagggtttcgattttgagtactttttttgcgtgcaggcgacataagccacccgcacgcaaaaatcggcgtcacccgcacgaaaaaaccatgatttttgcagacacttcggtgtagacgggcgggagatccacacgcgaaaacccttttcgatcgcacggaaaaatcgtttttgtggtagtgttctttttaggaaaatgcatgtcgatcttattataggttatttagcacgctttgggtcctctaatgtataggtatgccctaagaggggtataaactttacaaatgtaacactactattaataataattaagcatttgagcatgcaaaataataagcttgtattgcacataatagatcactgcatatacacaaatttaggaaccacatagtataaatggcagcctgcatgcagcttaacagatagacggggagaggggggggttgtcttgagatgaaaagtgtggagaacattggagtcgttgattagttggccacataaggaaattaggggacgtgatcacaatttgagtgctaatcacttgttttaaaagggagtaaccatattatatttgacgatcatagttttagtgataagctttcaaatctagttgtattataatcactactggaaaaacacttcttccagacgggctaaacctattttcacaggcggaccggtccgcctccaaccctacgcttgtaaaaataagtgattttcacaggcagacaactggtccgcttgcgaaaatagtttgcagtgttaaaaaacaaattgggtaccctagcttcccattcccaatccagacccattcccaatccaatccaaccaaatcaaattcacagaggcatcacaaaatcaaattcacagaggcatcacaaatttgaagcatcatagttcacaatcagaggcatcacaaaatcaaattcacagaggcatcacaatgaaaacaaacgaatcacgaattaacattcacaaattaacaaattaacttcggtggaagccgctgaagtctccaccctccttgccggtagccgccaccgccctccatgcaggcggtgccactggatctaggaggagggaggggagccgtcgccgcatccaccctcctcgccagcgccggcgccaccgcaactgtcacgtcctgataaattcatcctgaattaaaaatcattctctaaaaggaataatagaattaattaaaattcgaaaagaaattggcaaacactaaaatacgtactagaaaattcgaatgttgtccggagattttttgttaaattctccatggtctaaaaagagccctaaaattttacttgaattttcagagcaccaaaaatatttattaagcaacaacaacaattaacaaagtttactaaaaagaaaaactaaaaataaatcctccttcctcctttggaccaagtctggcccaaaatcctcccactctctccctcggcccgcggccaaagtcctcccttcctccctctctttctcttcctctccttttctccctccttctcttgggcctccccttccccctcggcccagctccctcctcctccctctccttctgggccgcccctcccctccctccttccctctcggcccagccgcccggcccaaaccaggccgagccgagccagccgcgtgcacgcgcgccgcacgcgcgctgaccgcgcgccccgcatgggtcccacccccaggtcgtcttcctcctcccgcacggcctcctctctctctctctcccggaaacctagcgccattgctcccccaaatcagtctcattcaaaccaggaattccaaaattgattagggggaattaatcctatttccctcctctctctttcccccttaattcccccttgattcgtgcttttaatcacccggaacgcccgcgccaatcccggccgctttccatggccgccggccgacttttccgccgccgttcccacctctcccgtgcccggctccctcccctatcctataaaatggaaccccctcgctccgttctatcgttttagccccttctcgagctcccccgcggccacaccatctctccccgcctcctcctcctctttcctcggtgccggccaccctccagccgcccctaccgcctcgcccgcgcgccgtccggccgtgccgtcgcctccctcggctctgcaacgctgcccccttcaccggcctcaccatcccctctcctgaagctcgccggaacggtgtcctcgccgacgtctagtggtgtcgccaccactccaccgcctccggccagctactattccttatcggtgcggcagctgtcgtcatcttctccttccccggctccacggcatcaccctccaccccgaccgctgcccgtcttcgtctggagaccgccgaccgccgcgccggcctctccatcctcctcgtcgtcaacgtcgcctccggcagccccttccgccgtgcccgtgcgccggccgacgtcgccatctcctcctccggcatcgcagcgtcaaggttgccctcggccttgcctcccctccatctgaacccctccgctatccgtcgtcgtcgtcaccgttcgtcttcgccgatcgacgtcccatcggtcgcccggctcgtcgtctcgctgcgccgccacagtcatcgtcatcacagcggcgtgttccacgccgttctcgtctcagtgcagccgctgccggctgccctcgtcgcctcctcgccggccccggtcgtcgtcgtcgtcgtcctctcgtcgttcccggtcgtcgtggtgttcgtccctccgtcaagccgatcgcgttcgccgcccgcgtttcgtcaagtgtgcagcagccccgtcattgtcttcgtcctcggccccgcgtcgtcaagccttgtgccggccgcgtctcgccttcgtccaaggatcgcctccgaagttgtcttctcaccgttcgtctcagccgcgcccgttcgtcgtcgtcgttcgcacgcctcgtcgcgtggtggtaaggatcaatccttcgctgcccgcccttgtccttttggtgttgccaccatgcccgttgtgcggttgtcggccccggtacccgtgtaccggtgtcggtagtcgttcgtgtgtgcgtgtggtgaccgtgttagtgtgtccgctcggtagccgcgtggtgttacatgtgcagcccgcgtggtgtctagtggagtccacttgtcggccactcgcctcggttgacacacggggtctacttccgtcgacccgtggaccgtctctgtgtactcggtctaccgtgatcctttaggttgacatgtagagtctgcatgtcaacaagcgcagccttcctgtcttttccaggttagcgcttacacatgttttataattgcaaaacctaattataataatccgcaaatctccagataacagcattaaacttcggatgatcatatcttggtcatacgaaccccgaatcgacccgttcaagtctcttaatgtttgttataacctaaagaaccatgtgctttctttttatgtattgttatttcttctttataggcttgtagctttgcttgtgtgcttcgcatagcttttgtcgttccggaggttctcgaagcgtgggtcgcggtcgtcgccgaaggttcggaaggccgttatctctgagcaaggcaagtcgcatcacccttgagcatattgaatcccagtttatggctaggatgggttgggaactatgtcacgtattccgtctgtatgccatggtggtatgtggcatgtggttacacatgaggaagatgtgtcttgtgggtaaagatgtacacttctgatcagagtaaatctattcgaatagccgcgccctcggttatgggcaaacctagcaatgtacccaagttagtggtttacttcttaaaattttcttaacaactaaaatatggaatggttggcctgggttggcttgggacgagctgggacccaggtcgagttgccagttcggtctgaatcatcgtaggccttggattaaggcaggttcgtgtgggttcacggccttgattaataacactgtgtagctctaggatcgtctttataaatagctttgggcaactaagtgacttttaaatgccgtttactgcaaaacctaatcccctatattattaccccttgtacccccttacattaatcatgcatctgccggtgtggcttgctgagtacggtggttgtactcatttttgctctatctttccccccttcagtaagagaagctttggagaagaagtcttaaggtggagtactggcttataccccagttgagcgcctgtgaagatggagccgtaggcccgctagtccgctgctgtttatttctgtttgtcaggccttaagtgttttttaaataatgtaaacattattgatataataaagatgtgccttttgtatcatgtttgtttggtgtaccccggcttttcctgggacggggattaatacactagtgttcgggaaaatgcaaattttctcggtcgcgacagcaactgccctccctcggccacccttcggccagatctggaagggtggggcgctgccaccgacaccaccgccctcccacggcctccgtccggctggatttgaaagggaggggcgccgccgccactgccctcccccggcctcccctggcctccctccggccggatctgggagggaggggaggggagccgtgcagcgctgccgggggtgggggccgccgctgccgaccccgcgtgtcgccgtcgccattgttggttcccgccacctgagggagagagcgctggtggtgagggagctgagggagaggacaggtgaggagggagagagagcttcggtgagggagagaggagactgagacttagaaaaattttgatgcctatttatatgcacgctaatttttgcaggcagacaacgtaagaggtccacctgcaaaaataaagtggtccgcctgcgaaaattgatttttgcatgcagatagcgcgtttcaccagtttacatttttatatgcggccatttggctccgatgaccaaacttgcctgtgaaaaatatactcaacatcggtaaaaatgttttttctagtagtgaattataatgtttacatagctagtatagaatatagaatcaaccaaaaatcaaacatgcccagttagctagcctcacacactctcgcctgtcacccgagttggtggcttcgaagccccctcagagccaaaaaaaaaaattctcatgcccttgcaagaatctcactacaatccgatggttcacaaattgaaagttctagagtcaacattattttttagcaaatctggttttcaaatggccgcaattcataatctcttctcccaaaagaaaaggtattgataatatctcatctatctttttttagaagatcaatctctcataagtcatcctttttggggggcgatttgtcatctattaaattagcttgtatattggtcaccatttagggcccattttgtgaaatggatcccataatgtgttggccgggcccctgaacataagcattcccttaaccgtaacaccagaaatgttgaacctcaaatttgcaaaaccggattaaattaggtcctccgtcagtataagtatccggtttcgtagatgtggcaattttttcttgctagaaatatttgacgtgttaatttgacctggtccactcgtgctaactagacatgtggcaaaaagaaagtgggccccacgtgtcatcttcaccatcctcccttcacatctctctcctctgctttctctctctctcacctcttctcccttcattccagatgattcagatgcaatgtagtgatctgtggcggagccatcaagtgtgacggagggggccaacgccctcctatctgacccccccttctacgtatgaggccatgtaaacattcagtcagctcattagcaaatctagaaaaaggtcagccaagcaaaaaacatatctataaaattaattaatgggatagattagggaagcaacgatcaacgcatcatgctcaccacttcagtttctcacgcatatgcaacagcgatgcacgcgtgtctccgtcctcccatcgtgtcttgccgttgggcatgcaccgacgaatgtggcctgagggctgatctctcttgcaatatggcaatacctaaatacatgacttttagttttttttctatccttaatccattagattgtagtcagactgagtactcggtttgtaatttcccatcttttcaaaataaaatacaagattcttatttgtaagattactagtagtttacgttgaaacggtttagcaataactaaagactagtttcaaattgccagtgatattattaaggagatagaattgaagttttttataggaccagtttatgcattgattgttatcgacagtgaatatttggcctcctttgctgccgacactggttaggtcttatggcttatcctccaacacccccaacctcaaatcccggcttcgccactggctgtagtgcctcctgcacggcgccagatcagcgacgggacatggcaggcattcactggttgtcgaggtgaccgtggcgcagaacggcagcaacaattattggacgattgttgttgccttggccgcagcgcccaagagcaagaagaaggcaaggttgtcctacactatccgtatcggggaggggacgtacatcgagtggcggagccatcgggggtgccagagggagccagcatcaccatatccagtagcggagccatcgggggtggcggagggggccagcatcccctatccgaccccccccctctacatataaggccatgtaaacatttacaaaaacgtcagctaagaaaaaaacatatctataaaattaattaatgagagagattagggaagcaacgatcaacgcatcatgttcatcacttcaggttcgcacgcgtatgcaacaacgatgcacacgcgtcctcctatcgtgtcttgtcgttgagcatgcaccaacggatgtggcctgagggctgatctctctggcaatatggccataactaaatgcatgactttgagtttattttctatccttaatccatttaatccattagattgtagtcagactaagtactcagtttgtgatttcccatcttttcaaaataaaatagactattcttatttgtaagattactagtagtttacgttaaaacgatttggcaataactaaagactagtttcaaattgccaatgatattattaagtagctaaaattgaagttttttttataggactagtttatgcattaattgttatcgatagtgaatatttggcctcctttgctaccgacactgattaggtcttatggcttattctccaacacccccacctcaaatcctagcttcgcaactggctgtagcacctcctgcacggcaccagattagcggcggcgcacggcaggcgttcgctggttgtcaaggtgaccgtgtcgcacaacggcagtggcgattacaggacgattgctattgccttggccgcaacacccaagagcaagaagaaggcaagattgtcctacactatccgtatcgggtaggggacgtacatcgagtgatagagccatcgagggtgccggagggggccagcaccccctatccactggcggagccatcaggggtggcggatagggccagcaccccctatcccccccccctcttctacatataaggctatgtaaacatacggtcagcccattagcaaatctagaaaaacgtcacccaaacaaaaaaaacatatctataaaattaattaatgagagagattagggaagcaacgatcaacgcatcatgttcatcacttcagtttcgcatgcgtatgcgacagcaatgcacgcgcatctccatactcccattgtgtcttgccattgagcatgcaccgacggatgtggcctgagggctgatctctcttgccatatggcaatgcctaaatacatgactttagtttattttctatccttaatccattagattgtagtcagactgactactcagtttgtgatttctcatcttttcaaaataaaatagaagatgcttatttgtaagtacgttgaaacgatttagcaataactaaagactagttttaaatttccagtgatattattaaagagctaaaattgaagtttttataggactagtttatgcattgattgttatcaacagtgaatatttggcctcctttgctacagacactggttaggtcttatggcttattttccaacagccccccaacctcaaatcctcgccaactggcagtgataccagggcaaaatttgctacgggacacccaaaaatcgtgtaattggctgtgagacaccgcaaaatcgtgacactgctcacagacactacgaaagttgtgaaattagctgtaggacattggagacaatattttataattttcgagacaaaaaaggtcagagaaatttctaaaagaccggattgcccctacgcgccgtagcttgtaaacccgactgggtctagtcgtcgtgtccatctcccccacccgattttccctttcctccccaatccttaaccctagtcgatggtggcggcagcgccgacgccggcggcgacagattcggcgctggcgacagcggtgacggcggagacctcaatggtgcaagcctggtcgaaacagatgcagcagagctccatgtcgctcacctgagcccaaatgatcaacacagaaaactaaattacataatgtgtttatgggagcccaatctgaccgataacactgaaattgttcagcactcaagtacctctgagcatgcatcgtcattggtactgtcatcaccgggcaaaggggatggcagggagtactttgtgtcattcaggattttcttctccctctccctgttggcttccatcagagctgcttccaggcaggggcagatccaacgtgggtgcagaggggactcaagtcccccctacacccacaaaactcatggatacctccggagcacctccttcaattttttcaccatgaatgataaattaaaggttcctaaatggctggaggttgaagaaactatgtaattgagtcccccaattttttgttcctggatccgcccctgcttccaggagagccttagcttctgattcaagctcaccgatgaacttaagtggggatggccacaccggctgtgctgatgtaaggttcagtggcagagcatgggcaattcagcaaaatgacaagtcaagtttgagaaaaacagcaaacacctgtgaattcgcaaaatgtgttgatcatttgggcacaggtgagcgacatggaactctgctgcatctgcttcgaccaggcttgcaccattgaggttgtcgccgtccccgtcgtcctcaccgtcggcgcctgtgccgaatctgccgccgccaacaccgtcgactagggttagagattggggaggaatggggaagtcgggtgggggagatggacacgatgctgactgggtctggtctacaagctgcagcgtccaggggcaatatggtcttttagaaatttctctaacctcttttgcctcggaaattataaaatattgcctctggtgtcctacagccaatttcacaactttcatagtgttcgtgagcagtggcacgattttgcggtgtctcacagccaattacacgatttttggatgtcctgcagtaaattttgccaatgcggataaacattacctgcacgagctttctgttggaataaatgggctaggcccaatttaattcaattaaaatctcaagagcccacaagtaatgttagagagaataatactggcttgaaaatttaggtggaagaacctcaacttaaatagggtgatattagagattccctgttgaccggttgaggtgatggttggactgccacacgcatgcgcgcatgccaagtcggcctcggccgtgggcgtagcgaggcgaggcggccgaccgagccgagcctgcctgctgctcttccgttttgaaacagacgagaataaagtcaccattaacaaatgaaattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgatatttatttgtgtggtaatggagatctctctctctctacatataacacaaggcagaggctctcaaagtatgtgtcttcctcctactattgttccttggcgatactctccttctgttcctacgctgtctctctgtttccccggttctgtttatcccacgtgcaagggtgatcggaacgagcaggtgcctccgaaactccgtccgcttgagaacctgcacgggtaggcgggcgatcaagtttttgggtggcgcttcaagcgcgactgctctgcatcatcttcaccaacatgtcgacaaccggtgacaacaccaacaatggagacaaggagaaggagcctctcgtcaacaccaacggaggcaatactgcctcaaactccagcggagggccattctcggggtataacgtttcactattaccgttcgttcttcgtttcctacaactgtctgtcgcagtattattgctttctcttatctatgttgttgcttattctatattaagcatgctcatgttgtacacatctagcactgtcactagatctactcaaattacaaatgtcatgtttattgtcttaatattttggattaaaatatgccgaattatgaccaaatttctaacaatccaaaaacttgataggtctttttcggtagttggctttgctgcattcctaaaaccacatgcttttgatggttcaaattataaaagatggaaagcacgtacacttttgtggttgacggcgatgcattgtttctttgtctcatggggcaaaccgagtgaaccgcctctctcacctaaggaggaggctatgttcgaggctgcggattgcttgttccatggagcattgatcagtgtgctcaccgacaatattgtggacgtgtatatgcacatgccttcagggaaggacatgtgggatgctcttgaggccaagttcggggtttccgatgccggcagcgagctgtatgtcatggagcagttctatgactataagatggttgatgatcgttctgtagtggaacaggctcatgagattcagatgttggcaaaggaacttgagaacaacaactgtgagttgccggacaagtttgtggcaggtggcattattgccaaactgccaccttcttggacggactttgctacttctctaaaacacaagaggcaagagttcagtattactgatcttattggctctttgagtgttgaggagaaggcgagggcaaaggacaactggggcaaaaagatcgagggaggttctagcgccaatttggtgcagaagaagaccctcacgcatcccacaacaacaacaagaaagtcaaacccgacgtcaaacccaaggctacaaccaattttaagaagaaaggcaagggaaagacaaaaggaggttgctttatgtgtggcaagtctgggcattgggccaaggattgtcctgagctcaaggacaagaagtctgcaaacatggttattagtgcgggctgaggaacatcgaggtatggtaaatttttacctacagttctctctgtctatcactcacctgattggtgggttgatactggtgctaatattcatgtgtgtgccgacatttccctattttcttcttatcaggtcgggagaggttcctccttgttgatgggaaatagatcgcttgcggctgttcatggtgttggtacggtcgatctgaagtttacttcgagaaagatcgtgcagctgaagaacgtgcagcatgtcccttcaataaagaagaatctagttagcggctctctattgtgtagagatggttttagacttgtgtttgaatccaataaatgtatcgtatctaaatatggaacgtttattgcaaaaggttatgacagcggaggcttgttccgcttttccttggatgatatgtgtaataaagttgtgaaccatgtaagcaatgatgatgatgagtctaatgtgtggcattcacgactctgtcatgtgaattttggttgtatgacacgcttagccaacatgagtttaattccaaaattcactttagtcaaaggctctaagtgccatacttgtgttcaatcgaaacaacctcgcaagcctcacaaggcatctgaggcgaggaatttggcaccactagaacttgttcattccgatctgtgcgaaatgaacggcgtgttgactaaagggggaaagaaatatttcatgacactgatagaagattgcactagattctgctatgtgtacctattaaaaacaaaggatgaaacattacattgcttcaagatctataaggctgaggtagaaaaccaattggaaaggaaaatcaaacggttgaggtctgataggggtggagagtatttttccaatgagtttatttctttctgcgaaaagtatggaattattcatgagaggatgcctccctattcaccccagtcaaacggggtagccgaaagaaagaaccgcactctaactgagatggtgaatgccatgttagacactgcaggactttccaaggaatggtggggtgaggcaatattgactgcgtgtcatgtcctgaatagaattcctactaagcataagaaagtaacaccattcaaggaatgggaaaggaagaaattaaatctctctcacctgcgcacatggggctgtttggccaaggtaaatgtacctataaccaaaaagcgtaaagttggaccaaagaccgtagattgtgtgttccttggttatgctatccatagtgtgggatataggttcttaatagtaaattctggagtacccgacatgcgtgttggtacaattactgagtccagagatgccacattttttgagaatgaatttcctatgaaaaatgcacctagcacttctagtcaagaacccattttatcccctaagcactttgtgccgatagaacatattgatcaaacgcttgaggaaaatcctgaggaggataacattgtagcaactcgaaagagtaagagacaaaggactacaaagtcttttggagatgactacattgtatatcttgtggatgatactccaagaaccattgaagagacatattcatctcctgacgctgactattggaaggaagcggtacgcagtgagatggactcaattatgtctaatggtacttgggaagtcgtcgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggactttttcgacacttattcaccggttgctcgcttgaccatgattcgagtactactcgctctggtagcctctcatggtctactcgtccatcagatggatgttaagacagctttcctcaatggagagttagaggaggagatctatatggatcaaccagatgggtatggactagaaggtcagaagggaatggtgtgcaagctgttgaagtccttgtatggtctcaaacaagcgcctaagcaatggcatgagaagtttgcaatacacttacatctgctggctttgttgtgaacgaagatgacaaatgtgtgtactatcgctatggtgggggagagggagtgatcttgtgtttatatgtcgatgacatattgatctttgggaccagcctc

SEQ ID NO: 75009 - DNA, 551 bp, Oryza sativa
cactaccatgtttactgacgatgcataaggattaattagctaaaaggatgtaaagaaacctttgcaacgccagtaaaatggtgatttgaatagactgcatgaaaatgaaacaccatatacctctgccagcaagataggagtgcattgtcaaccacaacagcctcagagtatgtataaaacagacaggaaaataaccaattaaaggtgatatacagtagatagcattctgatagcattccaggtttcctctgtagataccagctatagaaaaaaaaaactagcttcttaccagcacagatggccgtgctactgtgctagaagcctagaaatgaacgaccaagggaatgtaactaatgaaactggacaatacataaaacttatcaatttacataaaacaaaaattatcacaaaagtttcaagaatcacatacattacattaggggggaaaagcaaaacaaaaggtaatgtggctaaaaaaataattcagaacttgaactaccgattgcccctaacgattttagctattgacttgggtaaggtcccgtgccaaa

SEQ ID NO: 75010 - DNA, 585 bp, Oryza sativa
agcttcagtaggtaaattagtttaaaaactgccgaaatctatcctagcaattgaaaaatgatgaaggttgaaagcacagacaacatttaccagtttctaaatcgttgtttaccatcctaacagatcagtaagcatgatagtgtaaatgcacatcatacaacacacttgacaggagcctgtcacatacctggatcttgttgaaccctagcacgccgcttatgtgcaacaacagaacgcttgaactctgaaacagcctgtgccttcttttgctttggtagggaaccgtctacagcttggagaagaccattagctgcgcttaacgcatatcctgtctgtacactaccgggtaaaatgagttaatacaagctcctgtgtgccaactgccaatataatagaacaatgacattaagccagaaacatagcatgctaagtgagcatttgcgtgccattcgtctttagttctatgccttctataatagaacacataatcacaagtcctaaccagacatcatgaatttatgagcgacaagcacgacacatttccaaaaaaaatctaacaatgcatgacctaaaagtacacaattt

SEQ ID NO: 75011 - DNA, 27438 bp, Oryza sativa
gttatacagtagaggtatatttatgcaaatatttttcatgcaggtatataaatgcaaaatattaatgaaaatatatattttctttttttttcttgttaagtactcgacaggatcaaacggacgcaattgaccacgcatgacacatataaaaccaacactacgtgaacaaaaactatactacaacgattacgacggtttgatatctctccctcgttcggcgaacaaacctgcctgaaccctacacgttaattacaaattacaccacgatttagtttaaccagtgcgtgcgtgcgtgtgcatgtggacacgtaatgcaaaacgtagtagttttcgtaaacaatcttttaattgcggtctcgtgccgttgacgacgccttaatctgcacacgcttatggggagagagagagagagagagagagagagagagagagagatcagtagatcggcagtagttgaggtggttgatcggtctatggctgctcactcttctctcagcttggtgtacacagtttgagacgcgggagaggtgaaggcagcttgcacgcttgcccacccccaccttccccgctcacaccgcccttcaccttccacttccagtcgcagctaaccctcgcagctgcacctgcacacgtacgcctatatatactcaccgcgcgccgccgccgtgcacctgtccgtccgtccgtccactgatcgacgacgacgttaacctcgccggccggcgctaacaatggacggactagaggcggcggcgggcgatcagcagcacgggcgcctgctgattcctcagctgccggccgcctacctcgcgtcgtcgtcgatggcggcgcttagccctgcgggggacgactgggcggcgtcgctgatcctcccagatggggggtcggcggcggcgggcgtgggcgaggatgatcttggcggaggagtgatggcggcggcggcggcggaaagcagctgcggagggagcagcaccgtcacgagcagtggcgttacggaggcggcggcggcggcggcgacgaccacgcggcgtgggaggggcaacgggaagaaggcgggcggcggcgggaggacgccgaggttcgcgttccacacgaggagcgagaacgacatcctcgacgacggctaccggtggaggaagtacgggcagaaggccgtcaagaacagcgacttccccaggtatattatatatacattgcgttcttaatttctagctagcggctaacgtgtacagggcctacaggctactcatgcatgatatatattgcatgaatccattcatggcttgtgcatctacacgtacgtatggacaatattgacgttgaaaatgcattaattaatggggctactatacctagaaggctagaacaaaggaattgctatgaattttagttaccttaacctggcactggatttaggagcgcaaaagagggaggaggggcaaccttccggtgaagattacgacgacgggccatcttctcttcaattatagcgacgacgagctccttctcttctctgacgtcgacaacacccaaactgcaacagagaacctgcgttttatacccctcggcagggtttacattaccggttgaccactaaatttcgaaccccatcgatatcacggttttcgataaatttcgatcggttttcgataaatttcgaccaaatctattgtttaaccttcgaaattccaatcgaaacttaattccgagccgtatcgaaacgtcgaaattttgtagaattcaactagttttcgtcgaattgtgaaccctgccgctcggtacttgtaccacgcggtaccaaaacccatccggccgttgatttcgcgtgggtaggattggaaaagggaaagaagcgttgtttgtcctcctcatctatcccgtagcgtgattttctctcccgcaagagcgccgccctcttcttttcggactcgagagctagcgccgccgaagaaacctcgaccccaaatccgaaaccctagccgccaaaaaatcgcgccccaaatcattcgttctgccgtcttggccgacttgagtgaagcgaagctttccatcccagagggggaaggctgtcgcgccgtggtctgaatcgccggagcaaccaccatacatcgccggaagcaaactgccgccgtttcagtcttgcctagcctcgacagcatctgccggcgtatgcgccggtgttgccgcaaccgagggatttgttagggttaccttcagatcgatacagaatgatgtgaaaagacctcgctacccttccaccgcacctggcgaagcggtaccgtgccagggataaaaatggtaccgcaagctactgtgcaatcatatccgttagatctcaccgaacgaacggcctagatttggtacctcgggggggggggggtgctggacgataaaaatttcctacagattatggtttgcagtggggtcgaaattggaggggaggtggaggggtgtttccctttatagtgatgattgttacttgtgagtggtgaagaaagacagttggcgagacgttccagagccacggagttggagaagggtagtggcctagtgggtacggttggcagcgagggtggggaagatggtggcgctagtgcacctcgccactgcctcgtttggggagtaccagaggaggagatgggaggggagggaacggagaggaggcccgtttgcttgtcctagcttacaggtgttgttggcacatttcggtgtcatcaacgttaggggcggtactttaacgtaggggagacaatggcgctcaataaggaggcgtgatcttcgatgtacaccatttgcccgtacatgactcacattagtgagtgagttgtggaatagtaggaaatgggaatatgataaggttagtgtagcgcacaaatcttttggctcaatttaggccgtcaaaaactggtcgaaatttgttcatatttttcaagtgcctaaaaataaatagttccataaaactaatgcagtttataaaatgaaaacaaatctatactccttttaaaagagggcaatgctggtggcagtgaatctgccatcaccaccaccacctcatttattttttttattccacgcctacttcatcatgttttctaccaactattcatgtattttaatgttatagaataatccatctatcatatttttcatctgtacaatataagatctacagggatgaaattgtcccaaaaacctttaatattattttgttttaatccgtagtgtatgagtatttggctagtaaaataaaataatatatttgagaaaatctgtcacctatatatattacggatccaatgaaaatacagacatgtgtcatggactctagcctatgtatgaaagatatggagagatatagagaagaattacagatgatcaatatttaatgacttcgaaaatttaccagctggattagcttattgagattggggtggctagttttgggatagggcaagcggattcacaatgaaagccttgatggcgaaggcaacaatgggcacatccttggctgtgcaagagaatgaggctaatggataatgtcaatatatagtacgtttgagggagttgattggtgagtttagaggattcaatagtgtgtgagccatcgaagggcgaggcaaaacatggtgaggatgcatggcttgatcgcacgggaggcagcgagcagcagctataggagagagggataggagagagggaagccctgccgatcgatgtaggcaagctggcaaggtaaccatgcaatattggggaaggccggaagggtggagggggttatgtgatgagaggcttaattagggccaaaaacagttactacacaaattcttgaggaactataatattgcctgtgtgctgcaacgatattttaattgatgaaatgatcattaacctagccactattatcattatttttttatacatcatttcttaaattttacatatatttatgactaatatatgggtcatacagcttcacaatatcatatttctttcctaaaaaaatagatagggtggtggggcggttgacatgtgggacttttggcaccacatgttctttactccaaaagggtaaggagttggtggtggggtagtgaaagattcaccactcaccaccaccagtactattttttaaagaagtatagatgtaaattatcctaaagttttgaatatttggaaagaaatggagatgataaataacgtttgaatgaactttttttttggggggtgtaaatataatgcctttttaatcttcagatatatatcccgcttgaaaattcatgcatcagttcatcatgctctccaattcatacaagctcttgtcttctctacagcatgttagttaagtaagggtaaaaggtaggatggtgtttaggagaaagggaaggagaggggaactcctagtaggatatagaggaagctacgctaggacggcgaggcaatggtgccatgagtgcacaacagatcgagagagcatatattgggagtactgggcctgttctgcagctgcagcgcagccgacaccaacagtgtcgcacgcacacggtgcagttgcagttgtcgcagccagcttgctgaacaggcccactgacattattgattggaagggtacatcgctagcctatattatattggaaaaagtacgaattacctccctcccctgaactatcacagtcgaccgaattaccccttgaacccgaaaaccagacattgctcaccctaaacttttaatatcggacgaattacccccctcgatactgttttgtacggttttgacttgagcttgcacacatggcgccaatgtagcaatccaatcagaaaaaacccttcctaggcccacctgtcatacctctctctctccccggtcgctctctctctctctcccccccggatgccgcgcagccacagcgtgagcgccaccatcgtccgggggagcctcgccaccgtgacgaccctcgccacccccatgggcctctcccccgccgccaccatcgccaccgcgtctttgccatttgcgcccatgctaccgaggggaagccgggacgaacgaacagtcggcggcaggcgggcggtgggcagcggcgcgagacgaggagggggaaggaggaaggaggatcccaccgccgtctcgctccatgtcccgccgccgtcgccgttgcctttcgcagctgcctctgccccctccggccgtcgtcctcggctccctgcccatcgtcctaccccccctccggccaccgtcctcggctcttcgcctgccgccgcctcctctgttcacagagagagagagagagaaagagaggggggaggcagagaaggagagaaaaaaagtgttgacaggtgggccccaccgttttttatttgtttttgctgactgtatcgccacgtgtgtgccacgtaggctgaaaaccgcttcgaatctagttagggtggtaatttattcgattttgagagtttggggtgtcaaatgtctggtattgtagtttaggaggtaaatcgtactactgcaatagttcggaggggcgagggtaattcgtattttttcctattataatagtgtcatatttggcctatcattgtaacttattaacatatactaacatacttcctctatagttcatgttaaataaaaaaacagagtataaagatcttaaattaaagggataggggtgcaccattagtcaacaatagataggcatatacgtgttccatggcacttcgtgcatccattgcaaatcgttcaacaataatcagctagctacactcatgtacgtacaagtgtacaacatgattaattaactctgttcactcatatacgtggatgtcattatgccaagtactgacgagacatatcacaggagctactaccggtgcacgcaccacacttgcaacgtgaagaagcaggtgcaacgccttgccaaggacaggggcatcgtggtgaccacgtacgagggcgtccacaaccacccgtgcgagaagctcatggaagcgctcagtcccattctcaggcagctccagctcctctcgcagctgtaataaattaattaattaatcaaccgtgtaatccacttctaatcaagctctaatcgtgcacaaaactgcatatataacttgacaagctaagtcgatctatacagccaaattaattatacgtactcggatgggaaagagaaggaaaaaagggttgtcctacctcccatcatatagtgcttacactgctactactgcttactcatacatacatgtacacacggtcaagtgatagtgttaatatataaatcacttagatatttacacgttcatgtctcctgatgttcacaaagcttacagaaaatgtactttatatgtgcttcagctagcaccttgtaatttgttcgagcaaatatatatgtatacgaatctttcatgtttttatttatatgtatttaataatcattgttttctataaatcccaatgaatttacaatgtcctaaagaaatttacattgatacatgaggtccatcataatttttctattagagtgttacataagcaccacgtcaactaaaaaccgggttgaatacaaccttgagatggcatttccactggtattaggagatgagggatgcgttatattcggctttgcggttgaggaattactgtgattgaaattcgaccataagatgagggacatgaagaaaacttaagccttattcagtttgtttccactttcaaccttactaaattttgacatcaccaaatttaaataagacaacaaactaattaaacacatttaaccattatacctacaaaattttagcagttctatagaagctttctctcttaaaactttaccaaaatttggcaaagacatcgaagcaaacaaaatcaaccctacggaaattagtactaccaaaatagatcaaaatttaacattaccaaaatgtgatttgggaaacaaagtgaacaacctaacctaaaccacccacgaggcaaacttaaaacacctcaatccgtctccacagaaaaaattctcgacaggggaggcccaaacccaaacatctagccgccttatggcccatgcaataataaaaggcactagatttggcccatgaattactcagctgaggggctacggaagaaggacggaccagctaaggcccacttaagctccgcataaccatctcgccgccggccgagccgcctccctccgcgccgccctctcaccaacccgtcccagcgagcgctcgcgcggcggagatcggctgccaccgcgggcgggatatcgccggccaggaagcaggtaagcctcttccgcttccctcgctctactgcgtactggctggaagagctttcggtgcttctcctctctgtgcggaagccgcagaggtagggttttaggcttttaggcacggacgacgacctttgggtggtgggggattaactggcagttggggaatttatggtcgaattggaccagttttcagcgattggagctcgtcagagtcttaggtgtgggtttggatcgaaggagctttctgatgttgctgcagaaaatgtttactggagtaatgcagaaattgtcactggagtagtgccttggttctgtgagattatgccggttgaactggccaaagattttacctcgtcgtttgatggttagcagtgcattggatttattttggggtaaaaccctgttcgtgtgagatctgtgataactgataaccaagtgcgcctgtacatgttttaatcagatctgttcgtgatggcacattgtttgtcatggttcctaaatcatacggagtatatattagaggcgtgaactaccacatgctgatgtgggtgggatgattttttactttgtgctgtaattgggttttgtgtaaaaccaatagagcagaaccaagggaactaatcttctgaataataagcagcgttttagaattttagattaagtaattttgcaaggtgttgtataacaagctatttaggaaaatagtctcctgggcttctggcatggttcatttctatgcatacctagttggggataaatgtcagccagatgtatgtgtagtccgaatgcctatatgattaattcatactaaattctaatgtttgttcatttttcaattttgatgtttcagttccctgaaaagaagattgtgcaacagtccaggaactcgaagatgaacaagggtaaaatttttaagttagcaaaaggattcaggggaagggcaaaaaactgcataaggattgctagggagagggtggagaaagcattgcaatactcatacagggatcggcgcaacaagaagagggacatgcggtctctttggattgagcgcatcaatgctggtacacgaatccatggggtatgtaactgcgtatccagtaatgcttgaagtctcagtgtctcacgtctcaaggacatcattttttttatccatcgctcttttatccttgagtataggccgaataatctatcaaaagtataacttttggatttcaaggtcacgcactgcaggccctatgtctaatatactgttttaactgactaccccaggtgaactatggcaatttcatgcatggattgatgaaggagaatatccaactcaacaggaaggtactttcagagctgtcgatgcatgagccatacagcttcaaagctcttgtcgacgtctctcgcactgcattccctggaaataggcctgttaagaaggaggggctagcgagtattctttaaaacaaacctccccaagtcttgttacaatcacgtctgaatgaaactggtattgttgccttcagcctgcagccgtacaggaaactcaatggcagatattgcatttgtaatactatgtaattctgtttggaaagctgtggaagagaaacacctagttacatgtgttcttcttacctgttattgttggttttttttggataatgtgctctgtttaccttgataaatataacagaatggatgattatcattgtttttgtactttctgcataataagcttgggaggcagccaggtggccacttattttctaatcacatgggaaactgatatgttctctttaggctgtgttcgcatgcaccttttcccatccccttcccctcgttttccgcgtgcacgcttttcaaactgctaaacggtgcatttttttgtaaaaagtttctatacaaaagttacttaaaaaaatcaaattaatccctttttttaaaaaaatagctaatacttaattaatcacgcgttaatggactgctccgttttccgtacgcagaagttgggttcccatctcccccatccgaactcagcctactctttcttcgtactttcctccagctgaagtcatgtaaccttaacatctcaaatttggtgagtggattgcatcatctaatcatatttctttagaaaaacaggtgcttcatcgacaaccactgcatgcatgttgctatatgatgtgcctgcgtaatcgtggcatttcctagtactgctgccaggtaccaacctaccatgttctgtaaaattgttttcttcaatcaactgttctgttaaatctgttatgtcattctcaaactgacaagttacccatcttctaatgcctcttctttttcgaacatttctaatgtctcttgtagtcttgtccctgctttcggaagacccagacaacttaacccaacacacaaaactataggttgatctttgcttttagatggaatggtttctgaatatttttccaaacatgttagcaaattatcccagttctgtgtattaaaacttttaccagtttgtacgaggggtcacaatccaccacgttgtattaccgttactttctgcatcatctgaggaactcatgagattaacctgctgttaggtaagacgatgacaatctaaaaaaggattgaaagagatctcttccgggcaataggcaacccgtcgttttctccccgccgtgtttgatcctttcttggatcattactgtacgcgtaggcctttgggctagaggcgagaaattcagtcacccacagcctgtccagagcttagctcaacaaatcgcattgaattggcagtcgatttcagcatatgggaaaaaaagggacatataggtcggcataatacctgatagctagtagtaacaagtagcagaagccaatgctcagtaacagcctgagataaaactcttagagcagactattagtgagctataagcatatttaataagataaaagatgagagataagagtagtgggctacagatctgtagccagctgcagcgcggactcctagacatatgacaggtgggaccatatattaatagtatattaagcaactattgtatgaattggctatagatgaattgaaactagtagtaggctatactattaaacttgctctgttgcaggttgctggtaatatgttcatatatgttgcatttacatcttgagttcagacgaatccgctatacctgcatccgtatccaaactgaccgacagttacttaagaaatagtacgtgttgaatttgctaatagcaccaataatctcgttgcagcatctaggtaatctaaaataccactttttctccgatcccatgaaacaaaattaaaatacagagaccaaaaaatttcgagcctattttctcctttgttttggtatctatagttagcaatctgtcgtacttttaaatgttactctaggttaaatcctgcaacgaagtaatgaagaaattgttaagcaactctgataggtaataccatatgactatatccaaggcctccctgatggaaagtcagaggtagaacatggatgcgatagcattgtcagctaggaccctttatttattctgttctccattcattcttgtgcatgctggatggcctatttctatatcatcatatcagctggaatctattgattaagagcaaagcatatgcaaagagacgtgagtaagctatcgactatccttccactaagctcccttggttagttataaacctacaatgatggtgcttactagcttgctaagacaaagtcattgacgtaggggatccattgaccaaccttgctaagttcaccactgtttttccagtttttctttaagtatcctgtagaattgttcatctctttgcgtaccaacatgatatttatttttttgagaacatgatatttattcgatgcacgtatatatttgttttgtgtccatgagctggctcatcatagaatgttagttgaatatctgatcagcacataggcaaatcattagatgctaacaactcatatccgtaatcaatatacaaatttcctcgtttcatccttgttttcgtcgcctcagtaaatctagagaagcactacgtatcaccaattttattctcgtttaatccgatcaccaatttttttccgcacaaaagaacaataaccctttggtagttggtagaacttgtcagctagcagattagaaatttcccggtagagctgtagaattacgtgaaaatcgtggacgaaatttattactaccactcattttttaacgaaggaagctgcggttttctgttcagtgctcgctcactcaccgggcaccagcagcggcagcttcaggccaagcgctccactggagctaactgaaatgatgctgttcaccacgaggagctggagaggaaactactcgtaggcaggaatgaatgtttcgacgaggcaatcaatgggtgtcgccctgcctgccccgacgacccggtgatccgatgtgatatcgcactgggtgggcagccaccggacggcgctccccgccacgcacatgctcgcggctcatcatggctgtgtactggtgtgtagtagctcttgccttgccaggtgcggcactggccggccgagccgcgcgcaccgatctcagtcgtctcgctcgcctagccacgttacgcgcagcccacgttaggtcacgcccaccccgacggccgacacgcccgcgcccgttacgcgcagccacgcacgcacgcgcgatgcgcggcacggcacgccacggcgcgccgtgctaccggacgatcgagaggccgacgcgaacgcgcggcatgcggtgcacacggatgctggcgcgcggtggagtgcatgggttggcgcacgcatgcccacgagcccacgcgaggggacggacactccgggcgcgcaaggtcgtgccagataatatacgatcacctgttggatttgctcccgtggccacaacccacaagccacaagccggcgatcgcgcgcggtggttgcgggtcaatttcgctctcgcgccgtggttcgggctcgagcctctcatcgtcacaccaccaccaaacgcgacggctcaccatgtgaaacgtgaatccacctcgtgtactagcttcaagtgagtgagctcacggctttaacgtggaggcgcggagttatgttttctcgggggcggctggcttgctcccgatatattgctgtgcttgtctccgcttttctccgcggcgcggccccggcttggactcgctttccgcgacacgaggctgtgcttttctccgcaggagagagagagaacgggagagtggtggtggtggctgcaagctactactactcctactgcaaccgcgttgcattaggtcgcgttcgcttggactgttctgtgagctaggagtatatctaatcttcctcccgaatcgtcaaactagtttggtggtgggctagctgcagccagccagccagccagccaagggagcggcgcattgcgtgcgtgcgaggaggggaggagggggagtgatgagggcgggaatcggcagcggcagcggcggcggcactacgccggtgcggccgcgatgggggtctggtgtgacgacgccgcggtcgctgagcacggggtcgtcgccgcgcgggtcggaccggagctccgacgacggggaggagctggtcgaggtgacgctcgacctgcaggaggacgacaccattgtgctgaggagcgtcgagccggcggcggggggagcggccgtggcgtcgtcgtcgggtgcgtcgccgtcagcggtggcgccgccgaggcgggcggagccgcctggcggggtggcgtcgcggtcgaggtcgccggcgatgcggcggacgtcgtcgcaccggctgctgcagttctcgcaggagctcaaggccgaggccatggcccgcgcgcgccagttctcgcaggacctcaccaagcgcttcacgcgcacccagagcaccaccaccgccccgccgggcatcgagtccgccctcgcggcccgcgcggagcgccggcagcgcgcgcagctcgaccgcaccaagtccggcgcgcagcgggcgatccgcggcctccgcttcatcagcggccccaacaaggccagcaacgcgtggatcgaagtccaggccaacttcgaccgcctcgcccgcgacggctacctctcccgcgacgatttcccgcaatgcataggtcaatctcttccccaatcgcccccatccccttcccaaacattccagtctccttactttccccagctgcatttgagatgcagggatgacggagtcgaaggagttcgccatggagctgttcgacaccttgagccggcggcggcagatgcaggtggacaagatcaacaaggaagaactgcgcgagatctggcagcagatcaccgacaacagcttcgactcgcgcctccagatcttcttcgatatgtaactaccgtgccgtaccaatttgtggactgattattgatttgttccgttaatgtgactccgttttggtatgcgatttattcagggtggataagaacgcagatggccatattacggaggctgaggtgaaagaggtaataatagtccaatgctgaggttgctttttttttttttacttcctgtattactccatattttcctgtcttttggggatatattttttcgaactgttttcctgggatattttggtttatggagtatttggatgattgtgctgtccatttccccagctctgtaggtgtgtgtacttgttttttgttgtctgcaagtttatgttcctgaatttacgcataagaattatggaacgcgtagcttggaaaaaagaattcctgactaatggaggcccccttggccgaactggccggaaagcacccgcactggctgtctgcacacactagttttttctatacattgaggtaccttgttctagaacatgggaggggtgtgttgtaaatttactcctactatggatggagatggaagtttgaagattaatacagtatagttggtgggggcatttctgtcatgctgcgtaattattataatctgttcaaatgatgcgtggaaagaggcaacttttggattagagcttaatttattcatttcgctgaggtcattgtgtaaagggccgagacaggttgtttttttttatcttttcttgctcgatatgtgaggatggtttgtgatcaataaattaatagtggggtttggcttttttcttttccagattattatgttaagtgcttctgctaataaactgtcaagactcaaggagcaagcagaggaatatgcggccttgatcatggaggaacttgatcccgaacagcttggctacattgaggtaaactagcatgtttcttctgccatctgtgtctgagcactgatagaaagaattacacaatggttggttccatgatttcctctgacaatctacaactatccactgatgtttccttttctcttttcttttttaaacatactgctacagtgctactgatgttaataggttggtttaggagaaacattcaaacagataaatccgttacttactgttttgtaaaaatgcgagagattgcatgtatggtgcttttcactctatatattccagcatgtgcactcatacactttaccctgcagcgctacattaacttgtttctctaaagccctgaaatgttgtcttctcaacctagaaaaactactggcatgaaaagaaataaggccatccaatttaggaactgtttatacgctaagaattaatggttagaatcttaaggaaggttaactagccaaatccttccaccgatttatttttctttctcccttttgtccctccaaaatctatttaagatccaaaatgctgtggcaactggtgataaccatatgaaataaatacataatgcaatattatcttttgaacaagtaattgctgctatgattttgtgcaatattctcacatgcaaaagattacatgtccaacagaccaacactgtcttgatatattggggtggcaattcactctttcaataagatgtcaattgctgcttatgtattttagtatagaaatacaatgtctttaacaccaaatactacagcatgcactaattctttgatattcagtagtagtagttgcatttcacaagttccattttattttgttttattatgcacttgcgtgtctttgttagacttctacgtttttttggagatcataagagacaagtgctgcatgtaaaagattcaggaggatattcaaagattcaaatctgtgtccctctttttaaggatgaaataattgcaagcatgttctacaagattttagcatgtatggtgcactcatgtgggaaccatgtgtgccaccagatgcaattaaaatcttgtggggaccttctgcattttagtgagtcatttgactttggggccttggattgatgtgtaccgtttgcctgccttgtattttctgagtgcaagaagtgtaattaatgttcttgtatgttggttgtgtctatgacctgcagtttctgagatgataccatgacatattttaattaattcaacgagaattagcttattgtctgatgatattatggtagttatgaaaaaaaatatattaatgtgttcttctgtatcattgaaaacaagacaatcacaagcattgaagcgatatgcaagtaaaacgcctaacatattcataaactaagaagaattctaaactttaaatttcagtagtaagttaataattttggtaacattctaaatgttcagaaattctttttggttcatggattgtagaagaacccacttgtcagcaacagaaaatatctttgaaaagtctctgtgttattttaggcatattgttttttcagtttgacctgcttactggttactgagacagtaaactacatttatgtgacaccccttttctcgccgagaattatgtgatccttaaaaacactacttgttgacatgacagctctggcaattggagacattgctattgcaaaaagatacctatgtgaactatagccaagcattgagctacacaagccaggcactaagccagaaccttgctggtctaaggaaaaggagtccaatccggaaaataagcaccaaattaagctactatctggaggacaactggaagcgcctgtgggtacttgcactgtggattgggataatggctgggttgttcatttggaaattcatacaataccgccaccgatatgtctttaacgtgatgggctactgtgtaacaactgcaaaaggggctgctgagactcttaagctgaatatggctattatcctcctgccagtatgccgcaacaccatcacttggttgaggaatacaagggctgcacgggcattgccgttcgatgacaacatcaacttccacaaggttagcgactagactatctttgttcctttgttgtcctttaaaacatggagaaaacacagagtagattcaagatttatcaattgatttggttggaaaaaaatatgacagcacacagcatatactttggttaaggacatgataccatgcatgatgcatgtttgtacctgtggggtttatttgtcatttatgtccatcactatgaaggggacaatacaacttttattgataggctgctcatccatactctttgcattaatgctcctaccatcaggacaaatagtttgggccatggtctactggactctcatttacatcatggtcgatgcatgttaaaagatgggttatgatttatgaatagccacaaaacatggtcagataaggtgtttctattttgatatatataattttactggcttggcttatcctagatgaattaagcctattataaatagtcattttcattagttctccacagccaggagcctaaacaagctcgtgattgttcatctttgaagtttgccatttgcattagagagcattattttcttgattgaatcatagtcatgcaagttcattcctgtcagctaacagcatgcctgtatgtgatatgcttctgaatcaccagtttacattccaaaatatgtatattattgcatggactaactaacttaaaggaggcacaagagaatataaagtcatttggttggtatcatgcagagggcacataagccatgattggaccatatcaatcagcagatggtatagttgatgtcacttaagacagttcatgccaaatatctcttcctatgggatatagcagtctgtgaagtagaagaagcatgaggttcagtttagtcttattttcactagaatgcacgagatgcatttaattttactaagcaaaaaaataaaccatgattataatatgctttttaatggcactgataatgcctttgtgtcatccttaaacaaacagacgcattaaaatacatatggtagcatggccaattcggacatttgtgtgacatgttgacaatgacccagagcaagaatacagctaagggtgaatgttttgcttcttgtaatggcagactattgcagcagcaattgtggttggtgttatccttcatggagggctccatcttgtatgtgattttccacggctcataggttcatcggaggagaagtatgctccactagggaagtattttggtgaaactaagccaacatatttgaccctggtcaaaggagtggagggcataactggggtaatcatgcttgtgtgcatgattatcgcttttactcttgcaaccaggtggttccgccgtagcctggtgaagcttccaaagccatttgacaaattaactggcttcaacgctttctggtattctcaccatctattcatcattgtgtacatatcacttgtaattcatggagagtggctataccttatccgcatatggtacaaaaggacggtgagataattatttttcatttctccttttctctgtacctgtgtaccagaacagtttcataagcttctaatataattctttcctacagacatggatgtatcttgcagtgcccgtttgtttgtatgtaggggagaggacactgaggttcttcaggtctggcagttattctgtccgtctgttgaaggtggcacacatgcatcacaaaattgtattacactatttacatactgattttgtgtacggtcttctgacacactatttatttgcaggtggccatctatcctggtaatgttttaacactgcagatgtctaagcctcccacattccgttataagagtgggcagtatatgtttgttcaatgtccagctgtttcaccctttgaatggtatatgctcttatttcctaatatgcttcgcctggagtttctatttataagattgcaaatgtcatgtttatgaacaccttatttgtagagtaggtagatcagtatagctgcttagatgtttaatgattctttcccctttcaggcatcccttctcaataacttcggcacctggggatgactatctcagcattcatgttcggcaacttggtgactggacaagagagctcaagagggtgttctcagcggcttgtgagccaccagtgggtgggaaaagtggtctccttagagcagatgagactaccaagaaagcgtacgcttatgctctatgtttagcaataattatatgcttgtgcagttggggattttcatgacattgttttggaatgcagcttacccaaattgttgattgatggtccatatggctctcctgcgcaagactacagcaagtatgatgttttactgctggttggattaggaattggcgcaacgccttttatcagcatattgaaagaccttatcaacagcatcatcaaaatggaggaagaggaagtaagtgatctttatcgtattttcagttgcatcttcctgatgcctaactacagtaatagatataattggttgtaattctcatttctctgtgatctatgtatgcatttatataatatcgtctgtgaagaccatgagagacaggacaggacaaactgattaagttcttcacctttctttgcaggaagcttcaggtgatctttacccgccaatcggacgcaataaagcacatgttgatcttgacacccttatgaggattacctcaaaaccaaagagggttttgaagacaacaaatgcttatttttattgggtgacacgtgaacaaggctcttttgattggtttaaaggagtcatgaatgagattgctgaactagatcaaagggtaagtgggtaacttatgtgagctaagccatatattttaagtaatgtaatgttctattttgcatctttttcttacaacctttcttcttgatttataccagaatattattgagatgcacaactacctcacaagtgtttacgaggaaggggatgctcggtcagcactcattactatgctgcaagctctaaaccatgccaagaatggtgttgatatagtatctggaactaaagtaagtcacgtctcaccacttgacctcatgctgtactcctataatttgcatcattgttatttgaacttaactattctattactttttttgcaggtccgtacacattttgcaaggccaaattttaagaaggttctttctaagatagcctccaaacatccttatgctaaaataggtaagttatcatattgcgatataattaaagaagctatcctttttttaatctatttagctgtgatatactcatcaggatgtgaactttctggatcaacaaaactgggactagcatgtgcatatgactgcaacatttgtaattctcttgacatgtaacaatgcatataccagaaaataggaggggaggtggtgtacgaaattgagtagccgtgatctgttgaagtacttgaaacttaagtctgtcattttggtatttaagtaatagcaagacgtaaagcaaaatgaggggctctcaagttcaagtacttgtgttcttctgattaatttttgtatcaattctatcatcttttatcactgtaatgaaggtaattgtgtttgtttgtgtataggagtattctactgtggggctccagttctggctagggatttaagcgatctttgccatgattttaatggcagatgcacgtcaaaatttgagtttcacaaggagcatttctaaaatcaggtaaatgccaaatagggaaataatagaagattgtgctacttgtatgacaccttttcttttacacgatgccttgttcacaatggaattaatagcaagggcgagaagcatagaggtgctatcacaacgcaccctcctggctacggccagtttgcactgtacacttcttgcttgagatactcagaagatacaataagagtgccaagataagagttttggggatcatctggtacaaaatatataggacatcaatcatggggaaacataggttccaacttccaagtgcatcggcgaggtgattgctcgtaacatgttgatctcctggatttggatttggttttcgactataatctggtgtaggacatagaaggctaccatgagcacaaggctaattaattgtatattgcgtgcagctgagtggtcaggctacaagatttgctctaactttgtaattatatacagagatgggaaacaaacaaatatagtgtgatttttgtaagtagtgtaggttggtagtgattgggtccagattggtggctcagattacattcaagcttgtttttttgttgtgccgggagtgtacaacgtgcattgttttagggatggttttacacacatacagatgatgtaatcatgtaatccttgtagcaaaggccttgttcttacgttaaccttctgtctgtacatgtttggcttgtggattgtgtattggaaagaaaagatgcagtaaacagtgatcttttgttgtgtgataaatttgcaagatgaatgctgccaacctgttgaaaggaagtcgagaagactcgctgacgctgagcaacgagagttttcaatgataagttgtatatgtgtacccaaaacattacgctgcattatttgttcctgctaaattgcaaccaataggccgtatacgtgcctcggcctcagtcttagctgaactggagctctgcgtgccgcacgagtcacctaactctagtataattatcaatttatcaggcatactagctggcaattaaaaaaatactttttagattctataaaaaagtattttttaaccctaaaaatcgtagtccaagattcaatgcgctctatacaaatatagcctggcaagtcataaatcccagtaacaagaacttgatatgatgacagaaacggtggttgtgaacgcggggcttggcgtcggccatctggccccaatggtggagcttgccaatctcttcccgcggcacggcctcgccgtcaccgtcgtcctcattgagccgccggcaaagccgcccagcttcgccgccgcggtctcccggtccatggcttccaaccctcgcatcaccttccacgtgatgccctcgccttcctgccacagcaacgtgcccgagctcatccgcgccatgaatgcgccactgcgcgagtacctacgctcgtcggtgccctctgctcgcgcggtcgtcttcgacatgttctgcgcctgcgcgctcgacgtcgccgccgagctcgggctaccggcctacttcttccagtgcggcggcgccagccacctcgccgtcggcttgcacctcccgcacgtgcaggccgagataaacgccagcttcggggagatcggcgacgagcccctcctgttccccagcgtcccgccgttcaaacccagtgacctccccaaggcagcactcgaccgcaacgacgagatgtacagatggattctgggcgtgttcgagcggctcccggaatcccgcggcatcctcgtcaacacgttccagtggctggagacgaaggcgctgcgcgcgctcggggacggcgcgtgcgtcgtcggccgccccacgccgccggtgtgctgcgtcgggccactggtctcgcgaagcggggaggacaagaagcacgggtgcctctcatggctggacgcgcagccggagaagagcgtcgtgttcctctgcttcgggagcatgggctcgttccccaaggagcagctcgcggagatcgccattgggctggagaggtccggacagaggttcctgtgggtggtgcggcgtccgcacgccggcgaggcttcgctctcaggtttgctcgccgggtgtcacggcacgcacggcgagctggacatcgacgagctcatgccggaggggttcttggagaggaccaagggcagggggctcgccgccgggtcgtgggcgccgcaggcggacgtgctgcggcacagggcgaccggcgcgttcgtgacgcactgcgggtggaactcggtgctggaggggatcgccgccggcgtgccactgctgtgctggccgctctacgcggagcagaggctgaacaaggtgttcatcatggaggaggtcggggtcggcgctgtgatggcggggtacgacggcgaggtggtcagagccgaggaggtggaggcgaaggttaggtggatgctggagtcgaatgaagcgtcgccgatccgtgagcgagtggcgctggcgaaggagcgggccgaagaggcgacgaggaaatctggctcgtcgcatcaatcatttgtcaagtttctgatagactttggcgtgaccaagtgaccggtcatgaatcttgtttattggtgacaatgtaaaacgggataagtcaattaagaattatagttattataaaatttaaaaataagtttatttgatttttttaaaatttaaatctatatggaaagtatttgaaaaaaaacatattgtttagcaattcagagaacgtggtaacggtatatgagggattagctaagatgattaggcagtttcgaagggcgtggctaatgcgcgcgcgcgccagcaacagccttcccacgctgtttttttctccgcttttctctctttttttgtgatttttttcctttccttttgacttttttttctgattttttaatctttagcacacatgttttcaaaatatttgagttgaatatttttaaatcttgactttaaagttttcaaattttaacttaaaagttttcaaatcttaacttaaaaattttcaaatctgtacttgaaagttttcaatcttgagttgaaagtttttaaatctcgagttgaaagttttcatattttttcaaatcttaacttaaaaatttttaaatctgtacttgaaagtttttaaatcaaagatgaaagtttttaaatctgagttgaaagttttcaaaatttatcttgcacatttaaattttgagctgaaaattttcaatttttaaaatttgacttcaaaagttttcaaatctaacttgaaagttttcaatcggttagtagaaaaagtctttcggaaaaaaataatatcttaattactgtcattatctactaataacttaattagttaggctaaactatccggaaacgcaaccttaatatatatcttataccacaacaagagctagtataaaaaagaccatgtcaaaaaaattatacaatcaaaattgacaaagccatcttctcttatgcattgtatctgttacaaccatagccactatttgttccacatttccgctgatcatgtcgctgatggaagagaggataaatagagaacaaagcaaaatctgaaaaaaaaaaaaccaattgcacgttggcttttgaaaatcgcaatagtcatatgtcccgaataacagatccatataactgctaaaaaaaacatcggtgaggctacgcctcgaataagatctgttcttacactgccatccatggacacaatcacacctcctcacaaccggatagaccaccaacgagagagagagaggaccgtcattccaaagagcttcatcatcaactccacccagacaacgacgccatggatacgaaaacatattcaaacgtgcctctatggatgaaacaccgaagcaagatgaccacggaaccaaagattagaagatccgtcatcaccatcaccattgatgaagatgatgaaagataactaaatttatttggatgaaaacctaaaccatcacctttgaattgtaggatttagaaaacgttggaataggaaaaagataagatattgatagaatgtaagtgtaaaacagagtattgcaaaacgcaggaaaaacataggaatgaccatttgaataaaccgtaggaaaaacacaagaattagatgagagagatagactcaaataaaatttaccaagaggttaaatctcttgctaaacttcctccataatctctataggattgtacattccataggaaattcaaaggattagatatgattcaatccgttgttttaaagggcttcataggaaattttcctataggattgaaatcctctaaaattcttatgtttttcttccaattcaaaagggccctgatactctttttgtttcaaaatacgagcgttcgttctggtgagattgggtgagaaagcaaatcatattccgcgcgcacgcttcccaaactattaaacggtgtgttttttgcaaaaaaaaattatataggaaagttgctttagaaaataaaattaatccatttttgaaatttaaaatagttaatactcaattaatcatgcactaatggctcacctcgttttgcgtatcttcctaatcttctcaatccccttctcctcaaactcaccgactttatcctaagtcaagctcctctaaatttgatcaaattttaataaaataatattttctacagcaaacaaatatattataaaaaatatttaataatgaatttaataaaataagataagcaattgtccctttttcgctattaatttggtaaatttttttaaaaaattaacctaggttaaaatcaaaacaactcatgttctaaattggaagaacttgtcagacttaattggtactcctacaattttgaagcatcttctgacctaaatttcctagtcaaagattcaatgcgctccagataaatatagccaagacaatcacaggcaatcacagatccatcaacaaaaacttgatagcatgaaagatatggtggtggtgtagctagagtcggtcacatctggtccctacagtggagctggccaatctcttcctgcggcacggctcgccgtcaccgtcgtcctcattgagccgccggccaagccacagcttctccgccacggtaccctggtccatggcttccaactcgttctcacggtatcaccttccacggcatgaacccgtcctcattgagcatgcaggcctagtcctcccgccactacaatttgtctgagctcatctgcggcatgaacgcgccgctgcgcgagtacctaccttcgcttgtcggtgccctctgctcgtgcgctcgtgctcgacatgttctgcgcctgcgcccccaacataatatcgtcgctgccgagctcggagtacgggcctacttcgtccctccactcgtgtgccgccaccgccagccacctcgccgtcgccttttgcacctcccgcacatgcagaattgcagaccaagataacacaccagcttcggggagatcggccacgagtccctccggttcccctggcgagtcaaccgaagcgtggccactccgtgagcgggtggcgctggcggtggccggtgaggagcgggccgaagtggcagtcaagaattctggctcgttgcatcaagcttttgtcgagtttctgtgaggctttgggggcttacacgaagtcaggtgcaggcctgcatgtgggctgtgcggtaaccggctggcgaacacagccttaagtactggccggcaattcgatatgttctcttgatgggcttttagtctaaaggcctcggactatggctcagccgctcaggtgaccaacatctgccctggcacgaaaagtgtgcagtcgtgcaggttaacgaaaagttagtggttaacttccgcagcaagaatatagttggttctttttcagggttaaggtcgtgcgtgaatcgagccaaaataagactaccgtgtgttagcaatatattgtagcatgaagtatacggaaccatttggtgtagctccttagggcatctttggtaggtttttactgcagtgttctaattaagctgtgctgtacagcgtaatcgttcggctgcacaaacacatagctgcgggaagctactgcttgctattggatggctgtggctactgtagctacagctaggccgtccgaacaaagccttaatcggcacaagttttctatattatttttatatttaaaagctctcttaacgtttatactggtacctttcacattacgatgggttcatatggggatggactgcacatgcccttagacttggacaagatccaatgtattattctcttaactaatcgtttggtttttctggttttctttttaatagccaaccatttgattattttttcccccgaagatggggtggttacgcaggcaatgtagggacagggccggctctacaattttgagggccctaggacaaacttgacaacatgatccttaacgctctctcccctatagagagacgtgttatatgtatattcacattttttgggttgttcagattaatgtcattttaaaccatatcaatttttgataaagttgttaaagatgtgcatccatttagtttttttaccaaactttagtaaatacataagaaatcctgctaaaactaggcaatatcactaaattgtaaaaattttggtattgccaaaatttggtaagatttattttggctacaatatgaatggccccttcattttcaaagtgtgttttcaaatctaatcatagagagaaatgaacattgataatatttcatatatatgtttttagaaatagaaaaatatcaacacttaaactgatcttgtttatttttcccatttacttagcaccataaaaatgcttcttgagtaaaattacaacttatcagcacctaaaattataaaggaaatatatattatcaacaagaatctatctatacatacaattttgattgttgaatatagaatctttattaattcactaatcagtattatgtagataatagtagataaccaggagtggtagatagtatgtaattattcactaatcttaaaataatacttcggctcatacagtactcatacaattttaggcatgggcccctagctaggtcgggccctaggccgtcgccctcattgccatgcggcccatgccccagagccgggcctgtgtagggaggatgggagtacgattgcatagagatgacgacgttggctatat

SEQ ID NO: 75012 - DNA, 7125 bp, Oryza sativa
tatggataaaaaggctggttgatgttcaacaaagactagcaattcctcatatgttgcttgctactataagaactagggtagctttggaccgtctgattataactcaatgcttggatgagatcttttgagtaatcaactgtcaataatcagaagaaattttagttgcagactgacaggggcaagtcttttaagccgttgtgtgtacttgtgtacgttttgggtctcattggacacaaaccaaccccaaccacagcttcaatgcgaatagtatagtccacctacgattagtatattctacctgaatcttccttgctcatgcttcaagtaatccatcttgtcacattacttggcaattttgacaggattctacatgactcatatgcagggccacaggaaagtaatttaggccctgcttagttcgtgaaaagaaaatttttggcgtcacattaaatgtttgatcggatgtcgaaaggggttttcaaacacgaatgaaaaaactaactttataactcgcctgaaaaccacgagacgaatcttttgagactagataagccgtcgttagcacatgtaggttactgtagcacttatagctaatcatggactaagtaggctcaaaaggttcatcttgcgatttccatacaaactgtgcaattaatttttatctatatttaatgctccatgtatgtatctaaaaatttgatgtaacattttaggaaaaaaaattgggaactacaccaggccttagtaaactgcatgcagaaaaggatcaggtgctgttttcagtgagaagtttgcatcatccaaaagatgatactactaaaaaactaccgaagttgcagcctttcaacattcatgatcatgtaaaccatgttggtatctgatccctctttgctagtagtgttatgctttgttccagcttctctagccattattcctactaggacaagtagaaggtattcaatggtccagcttccacatataaatgcatccaatccaagagacttcctttctagaagctaaaattattggagacatggagtaaacgaaaacagaagtagaagaatatggcaagagtctcccccaagtcaatagaatgactgaatgagtgatgccaattaagagaaatcctgtaccacaacaagtgcactgagaaagtaattaactttgactttggtctacgtaccactaccaagtaagtctctcgaagatattgccgtgaaatcgcaatattcagctattaagaccttgtagcttgaccagctagtaatgtagtagatgttttagttcaaacggtcgagaaattaggtacgtgattccgttaaaatccaagcaatgaaccattcttcgctgcacaataagtacaggcacaatgccaccaatagttctaaacctactaactctctttaattccgtgagagcagcaataacaacaatttagaggtaatgaaatgaaagtgacatggcggtactgatgcagtcaaatctattcagaagtaatcgtgcacccaaaataaaagtgctaagcttcaaacggttcagtcaatgcagaaatggtgtgctccaatcaggcattcattcagattataggaatttaagggtgagataaacagacatgtccataattcctacaaggtaaaattataaagtaagactatgagaattatagtttagccataaggccatatatgtttgtgcagtgatgttatatactccctttgtctcacatcatgcaacctacctgccttagggatacctcagcggttagactccaaaagatctttcagctcatcagcaattgcacgatagcagaacatgtattgtttctgaaaaacagatgtatcattagaacatccaaatggtcatacacaaaaaaaaacaaactgcacatctgcattgtacagagactctatttagtatcagatgttacataatcaaggattgatataaatttatcaatttcccttcattctgaaaataaagaaagtttttactgctatctcattaggtgtacattccatgatgtgctcagattacgctggacttgttgccttgtctgtgtattttcaaaggaagcaagtgatatgagccaaaagaaacattagcctacctcagtttggaccattccaactcgttgggttctcaaagttttgacagtttcatcaagatgatatgagcttttatcaccaaggagaagtctctcaattgtactatggatagttatgtaagcaccggttcttccaatgcccgcactgcagagatacaaaaacaatgttaaagagaataaaaagacgtgcacagagtagcattttatcaagatgaagtgaacctgcagtgtacaactataggatgctccatcggagtattttgtaaccattttcgaatttgtcttacagcatcagtattagttggaactccatgatcaggccaatcaggatattctatatggcgtacagaatgaaccctgcttgactacattatgaaaatcagtaaccagttataacttcaatccaaaatatcttctaaattaccagaagtactggtagtggctaatgcagaatatgtcatgattattgtgaatgagtgacagcaaagcaggatggaagaaaaataacttgaaagtacttgcgttgtacaaatgcagggttaggttggctgcatacgtagctcagccgaaccttcaaatagattaacagtttacatgggttaaatcagtctgtgctgggttcgaacaagctgggggagttcacagattagctggatgggttccacaggttatgtcggtttagtggtttgagaaaacaacaaatgcataactagattaccttctacggttgagatgactaagataggtgaaacctactaaagttcatgaacacaaacattatttgtctacgtcattttatgtatgacatatttttcctgtaagaagaacaaaaaaacaaagcatatataattacctcgttgcattgcaccatcacatcacgcaaccataactgatggctatctcttttggcatttgtaatcttaacattgtactttccatacgcttcacgttgcttgcgtaatggaagatattcatcacactgccacatacaacatcattaataagcaattatcaggaaatatagatgattcaaagtgcatcacataggacaaagaaaagcaatggattggagagctctgttcaagaaggatgtccttctgcatatgtgcagaatgaaggacctattaaaacagatagttttttattggttacaacctttgtaatattttaagtgctctttttgtatttattcgtttgtaaatacttttcttttaatgaaaatcacactgcgaggcaaagccctggcagtaattaaattcaaaaaaaagaagaaaagtaatggattttcatgtaaaattcagtatgtactgcatgcatatggctcttattacattatcattacctattattttagtaaacattagatatgtatgtcccactgtaaagttgcgactatagagataaatcatacattttcagcttacaaagatgccattgcaaagtgggaaaatgatgtgcaagcagctgttggcaggtactgttgccctcatgctattcccatggcagtcatcacttgccatctctggcaacgccatccagcagggggaccagatcaggccagaaggcacaaaggagaacccactggccagatcaagcataggaacattcagtcgaatccagaggggcagggaaggaggagaacagccaaatcctgaggaagtgggtgcactggaggtagggaggaggccaatgctaactggatttgttgagggggaggtggtacaggggtgcattgcagatttgcagccatgactccggcaacggggtaaatcaattttttttacccgctattttaaaaaagcataatcaagacaaccagcactaatggcgcattaaaatagtgattggcatcagttctaagtgggatccttactagcaataaccattgttcccttctctccttccaaggtgttaaggagtaccctttcactcaaaagcttaatacttgcaagagaggagtttatgacagatttatacaggtatatttggatcctgaactaagatctactttttattttttaaaaatgtttacattatatcctcaggagcaatacctattgttttctcccaaaggaattgcatttaatgatgctgtttaggttatatgattgattcaacctctcaagatatagttttatgatatgaaatcaacatcaggcatttttattactcttttaagacaaattcagctattcatactgttattctgcctgtggttcacatgtgtatgcaagactatgcatgtaagtataccagctaagcaggatctcacttgaatgtcaattcaatagaacatgctgaggagattgtttatgtaagcaagcaccttaagactgtcgaattgtgtgagcataacaataacaggacattgatattcatagaccatttcccagaaatcatcaaatgtcttggctagtggaccttgagtggaaataaattttgcaactctgttgtcctcagtgacctgcaattttcataaaccacatgtacagatgctcaattgtcccaggcactattcagaaagtgaaaaagaattgcagtatatatatatatatatacctttataaagcttgcattgatataatcattgcttgaagtctgactggtggttgatcgttttagccttaccctggtagtatcaactaaagacaagaaagggttcaacttttattaagttcacaaagtttcaaggagaccctgctggttgggcaccggtataatcaccataattacatatgcaggtgaaaaaaatctcacatggtacgacatcaatatagcggtttttctccctatttgcagcattacgagcttcattagaacttctcatcagctcgtgtctcgtgtcctgaagaaatgaccatgatatatggaatgctatcaaaatatagttattaacaggtgataagatatcctctgaggagaaaaaatcattcaataaaagtgaattgcaatcttgtgcaagaaaatttctcttagaaggaatattttttaatcagtgtgagtattaatagagtctgcccaaaaaaaaaaaccgtgagttataattgtaagtaattgctttattcacagctaatctagtagcagttatatttgaacaatatagattttcatatagttgtgattgaaatcatggaataccgaatttaagctttcttatgtgcaagtcacaaagaacacccagtccatcatatcttgcaccagttgatacggccaattggccacaataccatcttaagaaaatcaccgagatgttccttataattttatccaacaaaatttccaatgacagcttatagaattgactaatattgattccaacaacgagacattagtcgaacactggaagttctccaaacaagatgtattcacagatattattgagtctgtatctagtagatcaatgggagaaaacttttaagtttcttaaatccagaaatggcatcaaaggaccagataactttttatacatgtcaagttcaagactgacaggagtagtgatctatagcaacaacaaatgccaatcctacttttgttttactcattgatgtattatagcatagtgaacttggctgaggccactattttagctcagtttttctccttttttttcgtaattctttgctcttttccttttttttttcgagcttaccacttcatgtactgaaacttgtatcacatcacatcacatcccaatgcttcagttgaaagcaacccaatcaaagtgcttcacttcaaagcaaagcataactaaatacaccaacaaataaattatgtgaagatagggcataacccaaagtaatttggactgcacatctgtcactttgattacaattcttcatttcactcagaaaagccacttaatgctagtctgtcacagcctgtgtgtgtcagtaataatgatcagtaattttcaaacctacatgcaaaattatactcacttaacatacataacacaaaaggggatacagaacctatgaacaagcagaccaaattgcattgtaagatgcaaacagaaaatataggatcgctaaaacaggtattcaattacggaattagcctgaacaatctagtagttagccaaactagggaggaaacagcaacacattatcaatcaaacattcacatcacgacgacgaggaaatcggacgaacacagtacatacatacctggagtctcctgaactcgtcggacatggcttccggccggccacacatcccctcgaagtactcgagcgcctccctgcatagaccgacctgctcgggcgtcagcgccggcggaggcggctcgtcgaggggcgcctgggacgacgacgacgacgactgcgccgcgcggcgagggacaccggcgaagcgggcggcggccatcgccctgccgcgggagctcgtgccgttccccgtggccgccgcggtgggagcgtactggccggaggcgggaggagaggggctcgccggaatcgccgccgccgccgctgcggtggtggcggaagcgatggagacgaggggtattaagacacggtgattatgtagagagagaatatatccttttttttttaaggagagagaatatatcctagcaaccagcaaatgtcacggaaaattatagacatttacttctaatagtattaaacatatatgcaaagtctcatatacaaattttttatattttagcctaaaaagtttaaaaaatatgacaattttaagagtaaaaatttgttagaattttgtctttttaggttaaaatgtaataaatttgaagataagatttttaaatgtaggtgtaatactgttggacgtatgtgtctaattttttataacttttactagttggtatacacagagtgtgtatgagaaacttgtgtacataattatgggtgtgttcggacaccccttttcccaaccccccttccttattttccatgcgcacacttttcaaactgctaaacagtgcaatttttgcaaaaagtttctatacgaaagttgcttaaaaaatcaaattaatctatttttgaaaaaaatatatat

SEQ ID NO: 75013 - DNA, 1089 bp, Oryza sativa
ctcacttcgtgattcgcgcgggaaacttttgtcaatcaatgccaatattggcatatattgagcccccacgggtgcgatgtttttgaccggattcaaaaagttcaaaaagcatccaaacatgatttttggacatattggagtgtattgggtgcgttcgtggcgaaaactcacttcgtgattcgcgcggcgatcttttgtcaattaatgccaatgttggcatatattgagctcgcacgggtgcgatgtttttgactggattgaaaaagttcagaaagcatccaaacatgatttttggacatattggagtgtattgggtgcgttcgtggcaaaaacacacttcgtgattcgcgcgacgaacttttgtcaattaatgccaatattggcatatgatgagaccccacgggtgcgatgtttttgaccggaacgaaaaagttcaaaaagccccaaaacatgatttctggacatattggactgtgttgggtgcgttcgtggcaaaaactcacttcgtgattcgcgcggcgaacttttgtcaattaatgccaatattggcatatattgagcccccacgggtgcgatgtttttgatagattcataaagttcagaaagcatcgaaacatgatttttggacatattggagtgtattgggtgcgttcgtggcaaaaacttacttcgtgattcgcgcgacgaacttttgtcaattaatgccaataatggcatatgatgagaccccacgggtgcgatgtttttgaccggaatgaaaaagttcaaaaagcactaaaacatgatttctggacatattggagtgtattgggagcgttcgtggcaaaaaatcacttcgtgattcgcgcggcgaacttttgtcaattaatgccaatattagcataaattggcccacacgggtaaaatgtttttgaccggattgaaaatgttcaaaaagcatccaaacatgatttttgtacttattggagtgtattgggtgcgttcgtggcaaaaactcactccgtgattcgcacgacaaacttttgttaattaatgccaatattggcatatcttgagctcccaccggtgccatgttttttgaccggaata

SEQ ID NO: 75014 - DNA, 9869 bp, Oryza sativa
tgaccggattgaaaaagttcaaaaagcatccaaacattatttttggacaaattggagtctattgggtgcgttcgtggcaaaaactcacttcgtgattcgcgcggcgaacttttctgaattaatgccaatactgcacacgagggtgcgatgtttttgaccggaatgaaaaagttcaaaaagcaccaaaacatgatttttggacttattggagtgtattgggtgcgttcgtggcaaaaactcacttcgtgattcgcacggcgaacttttgtcaattaatgcctattttagaatatcctgagcccccacatgtgcgatgttttttgagcggaatgaaaaagttcaaaaagcaccaaaacatgatttttggacatgtttgagtgtattgggtgcgttcgtggcaaaaactcacttcgtgattcgcgcggcgaacttttgtcaattaatgtcaatattggcatatattgagcccccacgggtgcgatgtttttgaccggattgaaaaacttcaaaaagcatccaaacgtgatttttagacatattggagtgtattgggtgtgttcgtagcaaaaactcacttcgtgattcgtgcggcgaacttttaccaattagtgttggcaaaaaactcacttcgtgattcgcgcgacgaacttttgtcaattaatgccaatattggcacacgagggtgcaatgtttttgaccggaatgaaaaagttcaaaaagcaccaaaataagatttttggacatattggagtgtattgggtgcgttcgtggcaaaaactcacttcgttattcgcgcagcgaacttttgtcaattaatgccaatattggcatatattgagcccccacgggtgcgatgtttttgaccggattaaaaaagttcaaaaagcaccaaaacatgatttttcgacatatttgagtgttttgggtgcgttcgtggcaaaaactcactttgtgatacgcatggcgaacttttgtcaattaatgccattattggcatatattggtacacgtgggtgcgatgtttttgaccggaatgaataagtttaaaaaccacaaaaccatttgttttagacatattggagtgtattaggtacgtccgtgtcgaaaaatcactccgtgactcgtgcggctgatgaaccctgagttccacatgacactcaaagctgttgttggcccgatctttcgatgagttgagataactacgatttggaagaaacgttgacgacccgactacaaccgtacaagacgttgtgttgcgccttagcgatcgatacacctctccgtaggttgttgatcttgccggtgcaaagcaaccctattcctgcaagcaaatcgaagaaacaagcaagaacaagataaaagcaatttgaattgcaaataggaatgaatgcacacaataagttggggtttcggatacaagcagacggacggtctagccgacacgcgcgctgcaaggaagtagcaatggctaaactttcatctaaacaaaagccaaactaaccctgaaggggttactagctatttaagggatgtaggaggtcagaagggcgtcctccctctgtttggagcgcagccccccttgggccccacttgggccggggtcccagacgaaattacaggcccataggcccattacagacaatgcagccccttgtttcttcaattgccaatgactcagatagaatttgacaatgaggttggatccgttggaaggaggattccgagagctttctatcaagtactcgtgggcccaaaatgaaggccatatggagattttgcgaccgtttgaattcaacactatctcaagtggtcgaattggattctagaatgcggcggacttcatctctatctctgcatgcaccatggccgtcgtctttatcttccatatgcagccccaaataagtggattggtcctgaacatataaacgcatacatttatgaggtagtgtcatattcttgattagattaaattggcacttgttatgaaacgagaccacctgtgggtatatgacatgatcaatggttgtatccgtcgtaggcgtggtcacatcatcggcagactttgtcaattaataccaatatttgcacacatgggtgcgatgttttcaactggaacgaaaaagttcaaaaagcagcaaaacatgagttttggacatcatggagcggattgggtgcgtccgtgttgaaaaattactccgttactcgcgtgaccaacttttgtcaattaatgctgatattggcacacgtgggtgcgatgtttttaaccggaatgaaatgttcaaagagctagcaaatattggcctatgttggcacacgtgggtccgttgtttttgccaattaatgtaggtattggcctacgatggcacgcgtgggtgcattggttttaacctgaacaagaaaaaacagttaaaaaaccagaaaaacatgagattttgacttattggaatggattgggtgcgtccttgttaaaaattcactccgtgactcgcgtggcgaactttgtcaattaatgccaatattggcacacgtgcgtgcaatgtttttaatcggaacgaaaaagtttagaaagcaccaaaacatgtgttttggacataatggagtggattgggtgcgtccatattgaaaaatcactccgaaactcgcgcggcgaaagtttgtcaattaatgccaatattggcctacattggcacacgtgggtgcgatgtttttagccggaaaataaaagttcaaaaccacaaaaacatgagttttggacatattgcagtagattgggtgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtggatttggtgcgtccgaatcgaaaaatcactctgtgattcgcgcgatgaactttttcaattaatgctaattttggcacacgtgggtagcggatccaaaattttcaaaatacacgaaagcatgagttttggacatattggaattgattgggtgcgtccgtgtagaaaaatcactccgtgactcgcgcggtgaacttctgtcaattaatgccgatattggtacacgtgggtgagatgtttttaaccggaaaaaaaaagttcaaaaaacagtaaaacatgaattttggacttattggacttgatttggtacgtccgtgtcgaaaaatcactccgtgactcgcgcggcgaacttttatcaattaatgccaatactgcactatattggtacacgtgggtgagatttttttaaccagaagcaaaaagatcaaaaagcaacaaaatatgagttttggacatctcgtagtggattgtgtgcgtccgtgtcaaaaaatctctccataactcgcgcaacgaacttttgtcaattaataccgatattggcacaatggtgatgaaccctgagttcctgacgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcgcattataggtgatgcaacaccttgttcctgtgattctggccacacgagatagaattcagagaagaggctggatccgttagaaagagggctccgagagcttttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaaatggcacacgtgggtgctatatttttaaccggaacaaaaaagttcaaaaagcaccaaaacataagttttggtcaaattggagtggattgggtgcgtccgtgtccaaaaatcactccgtgactcacacggcaaacttttgtcaattaatgttaatactggactacattggcacatatgggtgagatgttttttaccggaacgaaaaagatcaaaaagcagctaatcatgagttttggacatcttgtagtggattgggtgcgtccgtgtcgaaaaatcactacgtgactcgcgcggtgaactttttttcaactaatgccaatattggcctatattggcacacgtgggtagcggaacgaaaaaattgaaaggtacaaaaacataaattttggacatattggatttgattgggtgcgtccgtgtcgaaaaatcactccgtgactcgcacgatgaacttttgtcaattaatgccaatattagcacacgtggtgcgatgttttctcatcggaacaaaaagttcaaaaatcaccaaaaacatgagttttggacatatttaagtgtattgggtgcgtccgtgtcgaaaaatcactctgcggctcgcacggcaaactttcatcgattaatgccaatattggattatgtctacataactatctcgtagcaaagtgcgggctatcaactaattaaaccttccctccggcgtcaacatcgtcacaacgtcattcttattcgtgccaaatttaggtggctttcccagtttatccgcatgtccacaaattaatcccgcatgctcttggcatttacccaccagacgatcacatcacccgctccatttgcaacggagctccttactctacctcgacttgcaaccgaccaatggtcgccgtttgttgggacatccatacccatgcattctggatacgctcttctctcctccgtcttgctcgtcctcctggcgctctccatcatcacactagtgccacgcatgccatcaccgcagtcattcttccgatctccaccgcctcgcctgatcaacagtagggttcctcatccatccgatgccagcgattgtattttctccgacggtaaatgggtgagggacgccgcggcagtgactgcttaccgggaggactgcccgtttcttgaccctggtttccagtgcatcagcaacggccggagcaactcatctttccgctactggcgatggcagcctcatggctgccagctcccgaagtaggtagccatcgccaatgacatctttgataaattagtaatttcttttctgtggtttttcatgatgtggacatttttcagttacttgcattgccactcaatcttcaattccaaatgatttgaggtgtttaggttcaatgcaactgatatgctggagaggagccggaacggcagaatcgtgttcgccggcgactcgatcggccgtaaccagtgggagtccatggtgtgcatgctcgccgcctccgtgccagcggggaagtcaagaatatatgagcagtccgggaaacccattagcaggcacaaagggtacctcgccatggtcttcgcagactacaacctctccgtcgagtactaccacgccccaatgcttgtcatgatcgaccgcttcccggcaagcagcggtgccgtcaggggagcggtccggctggacatgctgcctcggcacgccaaccgttgggccggcgccgacgtgctcgtgttcaatacagggcattggtggaatgagcacaagactatcaaatcgtaatgccaggggctgcttcaagaaacgggtgatgtgggttccaatcattcttggtttggttcctcggcaccaagccaatcccattcctttccgctggtgaccgccttcttgttgcctacctttttaacccctgttgtaaccccaagtccaagtacaaggcatacgtgctcctttaatatgcttgctcctcttttcttgaattcaggattggctaaggctctagccattaaatgtgactggggttgatccaagggctggtctcatggttttgactaggtgtttctcaaatttctgatcatatttcctgtcgttataacccccaaaatacgctaactcgcagctcgaagttcccagttacatgggcaaccctactcactatacatagggtgtgaagagacggacaacaatagtctttctctgctttcactcgagccaaactaagtgttttctaggattggccccaaagccatactatggtcacaacggtaaccccctcgatttgatttatccaatcaatcgagaggcagcatctctatcaattactcggatcggcaacctcggttctggaatgtggacttcactgaccagccgcctcttagtccacacccaacttggaagtgttattgattcgttagtaaccttcgccatcctaatacccgagactgtagtgttctaagttggttaaagccgtcgtctcctgggatgcccggctggtcgggcaagtattagtgaaacggctccgcgcaatcaataactaccctgcttaggtatgagcttccaagtcccgaatccttttgtctcaagtctgccttggtaatgtgaccacacatcctttgatgatggaagtgttgtttcccaacaatccaccccggaatcctagttggagtaatgtatccctacatactatcgcactaatgtaatcgggttctcagatcatactcaatgaggggtggctagtatcccgaaactttgaagaacatgagttaagtagttcattcacttggtttcgccaccagtcagaacgccctaaaacccagtaggttttctcgatcaccattctacgattttatttccacctgttttagaacacataaattgtgctacccttaagagtttatcactaaaatcaagaactttatttatgacctgtaagttgcctcataaaaagtagatgttagtacccgactaaaaggagggaatcaaataaaaggtaaagctctcaattaaaagaaaaagctatcgtttactttgttaagggtatattgcccgtagcgaggttaaggtaaacccttgaccgagtgaaggcgagcccggtaaagcactaagtgtattggctagcttgtactttattagctatcaagtgtttgatgtaccaattactttattgtgtcaactagtttattgaatgcaaaggtaattccctcgataattgatttaattatcaagaaagagaattagttaccctccttcctcgagctgagctatttcttgtgtattcaatcgtatgcacgagggctgtcctctcctctgctctatctcccggacaagtatgaaagtcgtaattctttgggtttttgtagtcaatggaatgagcggagggagacacatccttccatccaaaggtgtgtgtgtcccgtagcgagtggaatggctggttcggtctagtcgtatagaacgggttgagttctttttactgagtcctttcgaggctggaagtgtttcttacagtttccttttccgaagggaaagtcaagtagtataaactagtactaagtccaagaagaaggggtgaaaagtgaggagggcgattagcccgatccacttgaggggaggaaggccttccttcccggtaaaaaccaaaaaaaataaaagacaatacatatttttttaataaaatgaatggttagaacgtatttaaaaagtcaacattgtcatgcattaaaaaaatggagatagtacgttccaacgtagatatataatgcttttaaaatggattaaaatggagtagtggtggtgatgagtggtgaatctaccaccatccccatcactaactccctactttagtaattttatagtacattctacttgaagtatatatttgctgcagtatatggaagggtaggttcggtatttgttaaaaatatgaaaagtgttgtttagtattttgaaattgaagtttattttcatccggattgattttccagttgtagtattttttctgtatctcgtcatccattcgtgatatagcgcttcttcagaatttatcgcgtgtccccggcgtccttgactcccgacgcacttgcctccagccccggcgcctccatcccgattccttcatgacaaaaaaaaagttatgtccagatttcacccgatatgtctggaccaggaaacaactaaataacacgtggttttcagatggagctaatataaattaaataactattattttaggaaaaaaagttacctccggatttcatccatggctctaagtccttttccaagtgtctccttgacccctccattgttcctattcacaatataatcattaggtagcaatctattctcgaattcatacaaagaagaacataggaacgagctcacctctaaatttaattgtcgcgcacgagctcttgttatcggtccttgaatgaacgttggaggattgttgtgtgtatccgagttagtgatgttcgcatcatcctccccctcttgaattgaagtcgtcctcgactcaagctcatcctcttctcccaagtatggcttcaaattttaaatgttaaacgtgggactaaccccaaacttgggaggcaactcaagtttatatgcattatcattaatcttctcaacaattttaaaaggaccatgagcacgaggcatcaacttagactttctcaattccggaaatctatcctttcgcaagtgcaaccaaactaaatcacccggttcaagcttaacctcttgcctacctttactaccaacaattctatacttttcagtcatcttttcaatgttgagcttggttgactcatgcattttcaaaataaattcagcgcgtgccttagcatcatgatgaaccctctcactagtaggtaaagtcggcacatctattggagcaagagcattttatccatcccgcggcggaaaagggcttaccttggtagtagaatgcataggctgagaccccacgggtgcgatgtttttgaccggaatgaaaaagttcaaaaagcactaaaacatgatttctggacatattggagtgtattgggagcgttcgtggcaaaaaatcacttcgtgattcgcgcggcgaacttttgtcaattaatgccaatattagcataaattggcccacacgggtaaaatgtttttgaccggattgaaaatgttcaaaaagcatccaaacatgatttttgtacttattggagtgtattgggtgcgttcgtggcaaaaactcactccgtgattcgcacgacaaacttttgttaattaatgccaatattggcatatcttgagctcccacgggtgcgatgttttttgaccggaataaaaaagttcaaaaagcaccaaaacatgattttggacatattggagtgtattgggtgcgttcgttgctaaaactcccttcgtgattcgcgcgacgaacttttgtcaattaatgccaatattggcacatattgagcccccacgggtacgatgtttttgatcggattaaataagtttaaaaagcacccaaacatgatttttgtacttattggagtgtattgggtgcgttcgtggcaaaaactcactccgtgattcgcacgacgaaattttgtcaattaatgccaaaattggcaaatgttgagccccacggctgcga

SEQ ID NO: 75015 - DNA, 654 bp, Oryza sativa
caaagatggaccaaaggagggatgtaaattgagatctttggcacaacttagacttcaacactcaaagaacgaaattttcgcaattaggattttcagtaaattagcttttaacgtctcgcgaaaagcggggcgttacagcaaggaagtgcacaagaagaggggtttccaagacgacggcagcgggagctggctgaggaactgcagcggcgtcaccatatccccagtgccggctgcagggcggcgtcgtcatgacgactgacgaggaggagcccgcagctgctggcgctcgggcggcgaagctcgagacacccgcaactgccagtgcatggctcgtcgagacggcggagggggcgagtggaggggcctgtagagcgagtcgatgacggcggcagacagagctcggggcgcgacgacgatgggtggaggcgaagctcgggcggcggaggagggtaattcatccagggcgcgacggcttcggcggcaggcagagctcgaggcgcgacggcgatgggtagaggcggagctcgggcagtggagccccgcctctgccccagtcgctcgctacccgggcgagccgcaccttcgcaaccggccgccctgtccacctccgctaccgtcacccgccacccggtctgcctctgccgccgccaccag

SEQ ID NO: 75016 - DNA, 5933 bp, Oryza sativa
tattacgtacgttaattaatttccaaatatgttttaatattttgagtaattctcttttagtcctgtctaatacacatacacgcacgcgtaaatggttcttaatattcaaaataaaggaagaaaacataagagcatctcccttattttgaagtccctagctacaagttggggctgcccctatttcccaaggaaaaaaaaaacctccaactccagtagtagccagtagcccctatttcttagcctctattcatgtttctcttgtattttaaaatacacaatctatgtttacactatgtttaacaccacaataattcaaatataaatatttctaacacgtataatttaaccatacttcaattcaaaatttcaaagtatacaattcaaattcaacatcaaaattttcaaacatgtaaatatggtgcggacacaatgccatatactcatttttcaaacatgtaaaaaattttggagcaagagatgcaataaaattaaaatatactagtagcaaatgccaaatgctcatatactgtacactgctgccgcttcttttatgcatcagttcagtaaaaagaccttgttttccagtttttagaatattgagttattgatccaacctgtcactaactgatgcaattatcgatgagtaatgcacatcagcaatagaaggttgatttctgcaaattaatgattaaattacaagattcataaccatgaaaaggggcagaaggaagtggagcagcgatgtgcaaagtacatgatctggacgagcgacagtgtgggacgttgatcgccggagttgatgcgtgcaaggttgacgacggcttacgcgaaaaagaagaatggtggcgacggcacagccaaggcacgagagagacgagagaggtgcgcgctcgggattttccaccgatccaaaaaaaaaaaaaaggagagataggggttgggtctagagtccccaggattgagggctagggggagaaatttgggagccttcctattttggggcctttaataggggctctgctagaactttatttttctcccttcacctcaaaaactatttgggggcttaatttaggtgctctgctgaagatgctcggtattcaaaataagggctgcctaaccaacattcgatctaaaattcattcaaatgtaaccatggcacaattattacagctcagtggtgatggagacgtgtctacctgcacatcgcgtattcaaccccataccctgcacaagatcgattttcattttccaatccaacccgaattaaattaagcgtgtctaatgggaaaaaatagaaatatttatcccttgattttctatccacaaccctaacaaaaccgtccagaagaatatatattcatgcacacacacacccgatggtatgaatatagatgaggagcatggttaatttcaaagttgtactgtacggcaattctattttattattcatttctgaatgcatgcataaatattttaaaagcgatgtaatttctcagagaatattcagatattatttatttcgactggaggaagatcaatcaagcacactacatgcatatataagggcagagttttccgtagtgcaagttcattatatgggctgatcggaactgctagttgatgcagccgctatggttgtgactgtttttcagctgctagctgtcgctacagccattttttttgctcttgcagcctcagcagcgagcactgccgattacatccatagttgtgtctgattcgagctctagttaagatcttcgactcaaacaattagtacaactagacaggagtattaccttatttatttttttctaacttttcaacaaaatccatgtataacgtatactcccatttgcatactgtgcatatatcttatcgtatttatagtgacaattaatgttcctctacacattattttttctatattacatcaagtctaatttattattttttacatataccagggacaaaaatagtaacaagattacacataaggatggcacggcaaatacacgatattcaaatggcacaaagccaaatatcattgcatgcaggccggggcagatcgatatataccgtccaatgactctacccaatgaccatctgaactaataatagattcataataaaatttaaatggttttcaacgaaataaaatacaacttttacacaaaacactcgatataataagatttattaaagctctaaaactttttggacttgccattgatcgcatgcattgagacttttcaaaaggaaggtgacacgtactacgcgtagctacatggctttacctacctagctacttactcatcgatgatcagtcatcaccagctaccactgcaagacgtcgtggtgtggtcagcacttaaattttagcagccaagtcgtcaggtccatgaagcatgcaacattttagttcggtcttctagaaggtagacaaacatgtggttgttgttctagtgaccttttgtgatccttttcgactttagtagtaactgatttttttccagtctctgtcccaaaaccttttgcaacaaaaatggttattaactgacttggagagatttggattcatctgattaattaatttgtgcaattgctgcttattctttctttgttgttttttcaaaagttatttggccctttggaatggtcatgcatggaaaatttcttgtggaagatgatccacatatatcaatatatcatatccatatctatcagtacatatcaagaaaattacatgtagaggagtgttaattctatgatctcatcctacaacaagttgtataaccatcattcactgaagggtaagtagcatatggtcagccaccattgaatcatctcataatttatgcaaaccacttgggggagacacaactgcttaataaaacagttcctctatcaaatatttgtccattatttgaccacttcgctttgaaaaatatagaaattaatatattcatgtaaaaccgtcaaggatatataacactacttgatacatgtggtgagcaaaccccgccgggttgctaccggtgctactaaacttgaaaaagttatcggacattctataaggaatcctacatctatatatatgataaaatttcatatccaaagcaaattttatttcatatccaaatttgatatgatgcatagaacaagttataaaaataaaaataaaacatctatatatatatgaacttaggatttcaacttgggctatgaatagactggcttttttttttcatcatgtatttcaggtttggaattgagatcttgtgccatggcgtaattcaagcttcttacatattttgtcgatattatgaaaaagcctttacgacttctgtgaaacgcatgaatattacatgaatatatcgtagaaattagttcagttccttcatgtaggatcttcatgtaggatcgtaaagggcctttcccaccccaaaagctagaaatttagttcagttcctttatgtaggatcgtaaatggtctttcccaccccaaaagctagccacttatatcttaggtcatttgccattccacaaccaatgtgggactattcaacacttcaaaattcgcacaaaatttgtttgtccaaaggaggacgccttagaagagtatatcttttttttttttggcttagggcacccgtagcacccaagatatatattcttctgctacttgagaccaccatgcaacaagctagcacaacttgttagtgctgatgatcatcgaaaagtgggcatcttcttcgtgtgttcctcaagcactgatgtcaacgtttgacaatgatatactagtatgtagtatgtatgtatcttggtcagtagaacatgcatctacgtatttgtgtacgtatgcgtgacacagcaatcagccaatggcaagctcttctctcccaatcgaatatgccatgcatgagatctgcatcacctactcattatacagattaaatcaatacacatttcgtgttgtgttaacttaattaattggacaggattaaatacatttcactatgttaatttgattcggtattgagaatattcaattcggaaaacgcgagctcgagtaaggtaataatatattgtaatgagtgtgtaggtagatgacaattaattacagctgagtagataatactgtactcagtatatatagtgccaaatggaggatgggcattggtagatataccacctaattagctgcttaccaaacctaatattatgcttaattatttagttagaggataattagcagccactctaagtgtgcggtcatgtagtgatttatatgtgcatgttgggttttctagaagacctacctaccagactaggattgaacagcatctctccatttggcaaatctatatgccaattatttgagtaccttcttacccaatgatagctcaagagatatttttctatactagatatgaagattagcatgtgtcagatcaacatatgtttttatctgtttaattatggtttatacatatgataattataattaagtttgtcctattggatgagaagcacctttcgtgcaggctaagctagctcaacctaatacctgggcagtaggaatctgaatgtacttaatttggaaacaaaacaatacaacttaggctgtgaattaaagaaaagggtaaacgcagttgacgagagctacgatcaggaattatccagtctagtaattgtcttttcttcatatagacatagatatataattaagcaagcatatgcatattagtttggaagtatcttgattgcccaatttttttacaaaagaaatatatatgtactgccaaattaaacaacacattaagttcaagattttaattagtcctctcttgtacaacacaatctcgataattctcgatcacatttgtggagaagaacaaaatatatttcagttgaaaaaaatgatttggactaattaaagacaggttaatttggagttgaagtccggtcagctggcatggccgcacgctggaaattaaggctaggaaacacaaaaatggaaacgtacgtaggaaaatagaacacaagaatacacgtgtaaaacaaagaaatgaaaaattgaggaaaattgtacatagagtggtcaaaggatttggtctagcagcagctgccactacgtactagaaaaaacattttcgtagacgtggggtttttttttcccaagcaggtatggtcctcggagccaaatggccgtctacgataatgtaaacctcggtggagcttgccgtccacttgcgaagatcaattttttccaagcggaccacttaagaggttcacctgcgaaaataactttattttcgcaggcgggcctctcaaggcgtccgcgtagaaaaatatgattttcgcaagcggaaccttatgtggtctgcctgcaaaaatcatacctgcagaaaaaatatctaagttccatccttatcttctccttcacccatccttaacctctccatcactcatttcccctccccctcctctctctctctgtctcattccttcccggtagacggcgggtcgtgcgacatcctccctctcccggcgatggcaacggctcagtgacgaggaggtcgcgacaatgatgacaacgccttctggatccgctgccggctcgccccgggcacacggatccaccgccgaccggtcgcgggcgcacggatccgccaccggctagactcggggaggggaggggaggtggcggcgacaaggaggtgaggggaggggaggggatgtggcggctcgactcctccctctcctggcgacgggaacgactcagcgacgaggaggtctcgacgacaacgacgacacctcctggatccaccgccggctcgccacgggcgcgtggatccactgccagccagtcttagggaggggagggaaggtggcggcgacgaggaggtaaggggaggggaggggagggg

SEQ ID NO: 75017 - DNA, 858 bp, Oryza sativa
aacaacgtcttggcgacgagggggggaggtggctgtggcgctccaacccatctccctcccttcctcctagatccatccgccggcggcgggtatgagtggtggcgacgatttttttttgtgcgcttaaattattttcgcaggcgggccgctaggctgcctgtaaaaatcatctattttcgtaggtctttgtttacatgtggccctttccccggtctgagaaaactatttttggccgcttaggaaaacgattttcctattagtgtgcttcagcatgagcttgtgcaaaggtctggtttcccgtgaaattggagaagtgcagaaaggaatcaaagtctgaatgctatttaccaaatcctttgttccaaacgtttgaacagttattgcaaaaaaaaaaaagttgaacagtgaaaattttccttactaagttgaatcccttgaaatttctttggaatttcgtcaaatccaaacatggcctaattattaaaaggcagccaaggaatgcgaaacgtttgtatcacattgatgaagtttttttttaataaaattagtgcaaaatgatttgattttcactaaactttttttgttaattttttgggacattttgtcatattcattgttatagctgtgttcacaagtttactttctcatttataaacttaattctgcattattgtagaaaggctagattgattttcatatttaagaaaggttaggggcaatacatattgattttcatatttaaccagacacatatgtatatgtactattaactactagctagctttcatgtgatgcaatatatatgtccccctattatcttataattaactatatacaggtcctttcgtgatcatgggg

SEQ ID NO: 75018 - DNA, 9147 bp, Oryza sativa
atatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatctttaaaatcatcatcgtgcgcatattgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtgtttcaaagattcatgatcagagtgtataacaaattctttgggccataaataatgctgccatgtttccaatgttcgcactagagcaaacaattccttatcataagtagaataattcaaactaggcccactcaatttctcgctgaaatatgctacaggtttgccttcttgtaacaacacaccacccaatccaatcccactagcatcacattcaagctcaaaagttttgttgaaatcaggaagttggagtaaaggagcgtgtgttaacttatctttcaaagtgtcgaatgcattcctttgtgctgcagcccaagtgaatgtgacatttttcttggtaagctcatgtaatggggctgcaatggtgctaaaatccttcacaaagcggcggtagaacccagcaagtcctagaaagcttctcacttgtgtgatcgttgttggaaccggccagctatgtatggcttcaaccttggcttgatctacttcaattccctgcggagtcacaacatagccaagaaaagagactcgatctgtgcaaaatgtgcacttctcaaggttaccaaataaacgtgcatctcgtagagcatcaaaaacagcacgcaaatgaccatgatgatcctctattgatctgctatatatgagaatgtcatcaaaatataccaccacaaatctgccaatgaaagcacgtaaaacttcattcattaatctcatgaaagtactgggtgcattagtgagaccaaagggatgactaaccactcatataggccgaatttagttttaaaagctgttttccattcatctcctaacttcatgcgaatctggtggtaaccactacgcaaatcaattttagagaacacaagtgaaccactcaattcatcaagcatatcatctagcctagggataggatgacgatatctgattgtgatgttgttaattgctctacaatccacacacatgcgccatgagccatctttcttaggaactaaaagcacggggacagaacaaggactaagagactcacgtacataccccttgtcgagtaactcttgcacttgacgctgaatctcctttgtttcctccgggttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggaatatcctcaattggaaataaggtttctttgcaaaccaaatcatagcaaacaacagtgtcagtgtcaacttcatccaaatctgattttgttgcaatgaaacaagatcccttcagcttaatctcatttttattattttgaacagagttggtgggtttcttcttatgcttctcaagttcattagccgcaataagatgctcactcctagtacgctcctgatttttttgtttgctagctctagcaagttcatcctttaaaataacttcaggagacatatgatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccgctgctattaagccattgaatatagtaaggctgtggatgtggctgtgtgctcaatgcaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccccaatgtgttcctcatcttggtgggacgcgtcaccttcccctgcattgttagttgcaagcaaagcataggtttcttcatctaaatcactagcggaggagtacccaccatcagctctcacaatcattacacgagtgcttgggcagtccttgcgcacgtgaccatagcccctgcagcgtaggcactgaatatctcttgtccttcctgatgaagctactgatgatgagctcttggaaggtgtagcagcaacccctcttgttggttcactcgggcatggtgtagagtttgttgtagagggacgcagcttgttgcttgaggatgatggtgctgctgctcgagttgacggtgcagcagcgttagaagatgtccaagagctagcacgacctgcagaaatgttagtcctgaagctagctcttcgtccctgtacttccctttcagctttacaagcaagatgaaacaaacgattaattgaattatattctttgtaggctagaatgtcctgaatttctcggttcagcccacccatgaatctagccataccagcatcatcattttctaccaatccacaacgaagcattcctgtttgcaaagcttgataatactcctctacagatttgtttccctgtctaagttgttgcaatttgtgcagcaaatcacgtgcatgatatgaaggaacaaatctagctcgcatgactcttttcattgcatcccaggtttggggagtgttatttggattggaacgaacaaattcactccaccaaatggatgcaaaatcagtgaactcactagtagcagccctaacacgtttattctcaggaaaatcatggcaagcaaatttctgatcaatggctaactcccatgtaagatatgcatcagggtcatattttccatcaaagcaaggaatggtaaacttgatcttgcctaaagaatcatcattatcacgtacctcccgccgtggtggagcgcccatgccatggcgctgccggcgttgttgtctttgtggacgaccaagtacctcctcatcatgctcagtgtcagcagcgtactccagttcttcccttgctgcgatgctgctattagcatcatggccattgtggttgcgcctagccgatccatcatgaccttcttggcccattctctccaacgtattcaagatacctgcaagagaagtgttcacagccacaagggacctctccaatgaggaaagcttggagttggtgtcaatttgagcggcctccaattgaccaaggcgatcattggcgaccctaacatcctcatcaaggccttcagcatgctccctcacttggcgctcaaaatgttgtatgatgcccctcatacgtggtgaatgttgagggtgctcccccgatcctcctgtcatggttaatggaaagaaacaattcacaagaaatatgtcctatcaactattgaagctaggtgttgtccatctccacttctaccaaacttgtgcaaacgagttcttacatgttcttactttgttatgtaaaaggcgttggcaaacagcaagaacagcaacaacggttagtagtaccggagccgacaacaagcacgatcctgtgatatagtagataaaaatttgtggagctataggtggctgcaagtaatatcaaggtacagctagaaccacatgaatcaaagcaagttgaataatcattcaacgatggtattgtgctggtcctaggcaaaaccctttagagacgcgagcctagtcacaagcgtagccactcaaaatagcacgaaaataacacaaacaaaacagcaacaacaacaacttcctctcttcccttccttttttttttccttctcttcatttctgatttttttttctttcttttttttttgttttctttctttttttttgtacagcaagctcaaagcttcagccaacaagtcaaaacaagaagtaatgatgggttggttggctagttacatgattcagccaacaagtcaaaagtgagagcacttaaatgctttcttgggaagggctgattcacttcaaaaagttgcaaaagggttggctgttggtggaggcagcaataaatgcatttgggggtggctgatgtggtgatgagggtgctgctggttgtggtggacgaaatttggtggggttggaggtggatttcgtggtgaatatggtggtgatggtggcagcgggatgaagataaatgaagtgatggtggaagtgtttgcggtgacgaattcgtgagcagaactcgaaactctaaaggactaaactactagaaccagcaactcaaccaatcgatgcaatcgaaaactcagcaagcaaagactaagtagaacagcaaaggctcaacatgttttggtgatttcgggtctgtcctattttagtggtttttcttttgggctgtaggtaaaaacaaagaagtgataaaatctctcaccgagcaacttgagctctgataccacttgatgcagcaacgggggttcccgatctttcgatgagaggagggtaaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaagttgatggtgaggccacacatagctgaaagtagacgacgagatctttccaacaagtactcatttgccccgtttgccctccggagtgaagagcattgacttcatcaactcagcgctgctagtgctgcttgcgatttggttcctcttccatattcctaacaacaagtagatcacaacaaccatttagtagcacacaattctgagaagaacttgtatgattagctaggaatgactttacctgataattaagttcacgagctcgagctctagtcattggtccttgctgtgcaataggtgtggttgtatcgttggaagggatgtcctcatcatggcatatattggcccacatgggtgcgatgtttttgaccggaatgaaaatattcaaaaagcacaaaagcatgatttttggacatattggagtgtattgggtgcgttcgtggcaaaaactcacttcgtgattcgcgcggcgaacttttgtcaattaatgccaatatcatatattgagcccccacgggtgctatgttttatgaccggaatgaaaaagttcaaaaggcaccaaaacatgatttttggacatgttggagtgtattgggtgcgttcgtggcaaaaactcacttcgtgattccgacggagaacttttgtcaattaatgtaaatattggcatatattgagcccccacgggtgcaatgttttatgaccggaatgaaaaagtttcaaaaggcaccaaaacatgatttttggacatattggagtgtattgggtgcgttcgtggcaaaaactcacttcgtgattcgggcggagaacttttgtcaattaatgccaatattggcatatattgagcccccacgggtgctatgttttatgaccggaatgaaaaagttcaaaaggcaccaaaacatgatttttggacatgttggagtgtattgggtgcgttcgtggcaaaaactcacttcgtcattccgatggagaacttttgtcaattaatgtaaatattggcatatattgagcccccacgggtgcaatgttttatgaccggaatgaaaaagttcaaaaggcaccaaaacatgatttttggacatattggagtgtattgggtgcgttcgtggcaaaaactcacttcgtgattcgcgcggcgaacttttgtcaattaatgccaatattggcacacgagggtgcgttgtttttgaccggaatgaaaaagttcaaaaaacgccaaaacatgatttttgcacatattctagtgtattggcaccattcgtggaaaaaactcacttcgtgattcgcgcggcgaacttttgtcaattaatgtcaatatttgcatatattggcccacacgggtgcgatgtttttgttcggaatgaaaaagttcaaaaagcaccaaaacatgatttttggacatattggagtgtattgggtgcgttcgtggcaaaaactcacttcgtaattcgcgcggcgaacttttgtcaattaatgccaatattggcatatgttgagcccccacgggtgcgatgtttttgaccggaatgaaaaagttcaaaaagcaccaaaacattatttttggacatattggagtgtattgggtgcgttcgtggcaaaaactgacttcgtgattcgggcggagaacttttgtcaattaatgccaatattggcacacgagggtgcgttgtttttgaccgaaatgaaaaagatcgaaaaacgccaaaacatgatttttgcacattttctagtgtattggcaccattcgtggaaaaagctcacttcgggattcgcgcggcgaagttttgtcaattaatgccaatattggcatatattgagcccccacgggtgcaatgttttatgaccggaatgaaaaagtttcaaaaggcaccaaaacatgatttttggacatattggagtgtattcggtgcgttcgtggcaaaaactcacttcgtgattcgggcggagaacttttgtcaattaatgccaatattggcacatattgagcccccacgggtgctatgttttatgaccggaatgaaaaagttcaaaaggcaccaaaacatgatttttggacatgttggagtgtattgggtgcgttcgtggcaaaaactcacttcgtcattccgatggagaacttttgtcaattaatgtaaatattggcatatattgagcccccacgggtgcaatgttttatgaccggaatgaaaaagttcaaaaggcaccaaaacatgatttttggacatattggagtgtattgggtgcgttcgtggcaaaaactcacttcgtgattcgcgcggcgaacttttgtcaattaatgccaatattggcacacgagggtgcgttgtttttgaccgaaatgaaaaagatcgaaaaacgccaaaacatgatttttgcacattttctagtgtattggcaccattcatggaaaaagctcacttcgggattcgcgcggcgaacttttgtcaattaatgccaatattggcatatattgagccccaggggtgcgatgttttatgaccggaatgaaaaagttcaaaaggcaccaaaacatgattttttgacatgttggagtgtattgggtgcgttcgtggcaaaaacttacttcgtgattcgcgcggcgaacttttgtcaattagtgccaatattggcacacgagggttcgttgtttttgaccggaatgaaaaagttcaaaaaacgccaaaacatgatttttgcacatattctagtgttttggcaccgttagtggaaaaaactcacttcgtggttcgcgcggcgaacttttgtgaattaatgtcaatattggcatatgttgagcccccacgggtgcgatgtttttgaccggaatgaaaaagttcaaaaagcacaaaaacatgattttctgacatattgcagtgtattgggtgcgttcgtggcaaaaactcacttcgtgattcgcgcgacgaacttttgtcaattaatgccaatattggcacacgagggtgcgttgtttttgaccggaatgaaaaagttcaaaaaacgccaaaacatgatttttgcacatattctagtgtattggcaccattcgtggaaaaaactcacttcgggattcgcgcggcgaacttttgtcaattaatgtcaatatttgcatatattggcccacacgggtgcgatgtttttgttcggaatgaaaaagttcaaaaagcaccaaaacatgatttttggacatattggagtgtattgggtgcgttcgtggcaaaaactcacttcgtgattcgcgcggcgaagttttgtcagttaatgccaatattggcatatgttgagcccccacgggtgcgatgttttttgaccggaataaaaaagttcaaaagcaccaaaacatgatttttgggcatattggagcgtattgggtgcgttcgaggcaaaaactcacttcgtgaatcgcgcggcgaacttatgtcacttagttccaatattggcatatattgagccctcacgggtgcgatgtttttgaccggaatgaaaaagttcaaaaagaaccaaaacatgattttttgaacatattggagtgtattgggtgcgttcgtagcaaaaacattgacgaacatttgtcaattaatgccaatattggcatatattgagcaccgacgggtgcgatgtttttttgaccggaatgaaaaagttcaaaaagcaccaaaacaagatttttggacatattggagtgtatttggtgcgttcgtggcaaaaactcactttgtgattcgcgcggagaacttttgtcaattaatgccaatattggcatatattgagccccaacgggtccgatgttttttgaccggaatgaaaaagttcaaaaggcacc

SEQ ID NO: 75019 - DNA, 618 bp, Oryza sativa
attcctgcagcccgtccccgtccttttgctgtcgtcgccggcgtcatcctctcgggcccggcgccccatgccgcatgcatccaaaaccatgaggtgcggctcgttctcatccctttcctcccaaaacggaaggagcaaagctccctttcctcctcctcctcctttcgctttttcccctcccaggtagcgagctccctacctccactccttggcttcttgttcaaaaggcagagccgctgacgccgctgcagcgcctcgccgccctccaccttgaccgcacccgctcaccccgcgccaatcctcccgtgctcgcggttcgatttccaccacacgatccaccgcctccaccaccctttgcatcctcgccgtcgctcgttctcgcggcggccatgaacaccagccgagcgccaagaaaaccgcggccacctcgaaccgacctcgccgctcccactccgtctctataaaacccaccccctgtgcttcctccctcccttgcttcattccccccccaagcggcggagccctgccgccatgggaactcctcgccgtcgcgtcgagctccatgtccggcgacatctcgtcgtcgcacggtccgtcctctgccgccttctccctcaa

SEQ ID NO: 75020 - DNA, 11293 bp, Oryza sativa
tgagctccgtcgccgctggctccctcgtcgcttgcccgcgaggagacgagaaggcgagaatgatacgcgaagccgagacggagtgtcggtttcgagaaaaataaggagaatatatatgggagattgggagtgcgacaacgaggccgccggggacgatgcacgcgcgacgccgaggggggtcgctaatcggcgcctgggcgcgcgctagctgctcgcgccgtccccattgctgccggcagtaagtaaaaactctagatcgtgttgctgtagaaaattaagttgtatagtgtgtacaaataaattatattatattttgtaaaccaaaataaaatgacttcctatgttttatatagttaacacatgattgtaaacataatgcaaagtgaacatattttatttaattgatacttatgaattttgaataaaaacaattgagattgtagggttttatgagagaaggagaggagactttttttatcatatatctatcatccaaaagctaaaaataattgcaataatgtggcttcatgagagaagagagaaatagcattaattacacttagtggggatgaactatataagcatatacgataatgcgtacgatagcttaaacaatataatataagtttacataagttaatgtgatttaaatttaaatagtatgtggaataataattcaaatgtaaaagtaaaatgatgtggctctatgagatagcaaagaagataatttagaccatacatctaagggataagaaaattatgatgatatgacttaatgggaagaagaaaagataagaaataatttgaaccatagattaatcatttaagaacttaaaataattgacgtgatatgacttaaggagagaaaagaaaaataatataaactaagtaaaaataaactatacagatatacaggatattataaaaaatgaggaagtgattgtttgaatagtcatatgtagatcctattgtttgaactgcacagcaaacaatgcaaacaagcaacaacttcaaagctctagatccaaaccacaagcaaggaggtgagctcaaacaacaactacacaagcgtagaacaaagcaatgcaacaagaagataaagagggaggaggatatcaccaagatttatgtgacgatatattttccggaattcaaattcttgacggaattttcgttgagaagcacacaaaaacagagacttttttaatcctattctcatgaggttgcacaaatacattcctttcactaatggtatctttttcttgcggaggtgagatccggccttcacaaactttctttggtagatcggaggcacaatagcgacacctagctgtctatactgttggtaggtgaaaactttgacgtttaccgttatcttaaacttccataacttcttgtaagggaaggaacaatctactccctccgtttcaacttataagatgttttgactttggtcaaagttaaactgctttaagtttgattgagtttatagaaaacaataataatattttcaacccaagataaatttattataaaaatatatttaactattaatttaataaaaataatttggtgatgtaaatattactaatttatctataaacttagtcaaaatatcttataatctgaaacggagggagtaatttatatccaagctaataaagtatgccacttggacgttccattattttctcatgggaatattattccctattcaatcatatggataattgggaatttcatcagtgtcctcatccaatcataaaaaacatacaaccctaattaaaatcagccgtacgtgcaatatggcctcttttctcagtcctgtcgtcaaattaaaatcagacagctattcatcaagagtcagttggccaacttcgcccgatgctaagattcaaaccgaattattaaactcaaaacacaagacttaattcctagtatactagtacatggtaaacactatcaattccagtttttagctaccctaatcaattacactggctttcgtctgtacatgacgtccaacataaccatcaacacggacgattgtctcaaacaccatgacaataaccaaggctaaaagcttactaattaattcacccaaattaactgcatagatctcaaagcaaacaattttttttataccagtcacaaattcacaattgaactctatgcagttttctccagaaatcaaagggttaacatttgtcaccagtcatgagttgatgcgtacatagtggtctttgttgtaaggccatataaccgtatacattggctccagaagtatatctgtgctgaaggaagcaagtgcagcacagacaacaacaatgtgcaagatcttgttaatttgaatgcagtctgcactctgcagggaaattcaaatgattactttaagcaagaggagggtgagggttaaggcaaattgcaccaaccgcatacctcctcaagtgtagtctgttaagagcattatgtgtttatgggtatattggcaattcccatctctattttactcaatatatgacctttgggctaactcaatagatatagttcaatccccaaattccctaatttcctcaaattatgacatagtcaacaggtagatcatcaatatggacatctagattctcccttgctgccattttacattgcatacttagctcctcgctgcaacggcgtacatgcagccgtgtcagcgacggtggaaggcccatctccgggagcctcgcgacgccggggcagtcttcgacgtctaaccactcgagggaggccagccgtcgtaggcctgcaggaagcgaacggagattcggcaggtgccagaaatcgaggcgatggagggaggccaggagctggagagccctctcctgttcctccgtcaggtcgatcatcgtctcgccacgcctgctatcccatgaccagaaggatagccgtcgcagagacgcgagccgtctgcagagaggcacggtgaggacggagccatcgccgacctggagggtttccagtcgggacaagatctccgcagaggccagttgctgatgtgacagaagctccaagaatgcaggtactccaggtgagttggataccgccagggacctaaggtttgttaaggagccgaatccctcgatcgaagcaagtgagccgcagtctataatcttcagctcccgcagtgccttggagtatcccagctggagagatgtcagctctggactctgccaaatgtacagtgctgtgatggttgggaacaattgcagcaaacgggactggtccttgtctgtgaggttagagatatcgagttcttcgagtgacggatgaggctgcagtgggataatctgtccatgctcctgcagtttgagatcccacgcagcagagagctcaggactcatatcaatctccaggttctcaagagatggtgggagtaatgcaacatccaccttatcactcatgaccaacaacggcatcagcttggggcaacgctgaattcgaagacgctcaagagaggtgtatcctaggagtactctctcccctgcaacaaactccagttgggcagttggagatgtctagccaccttagagaatggatgatattagatggaatttccaacagctgtttatcatctctggctaagggccttgctgctgtagcttccaaactgctcatgccttccttctccgcagcttgatgactgaacgaaacaaattttagttgtgggatctcgtgtaattccaaactatggagggactgcacatgagaaagcatttctgttaaacaatgccctgatatgccacatgcctgaatggagataaattggagagatgggacgacaaagctgcttggaatgatcaaattagggcagttctttatatgcaatttctctaaaactgtgcactgattgagaccttcagtagatagagagactaaatttgggcaatccactagacagaatgatcttatgcgcgcaaagttatggaatgatatgatcttgtcatcaagcataaccaactcttcagatttgattttcaaatcatatgttaactccattgttggaagagttggaatcccgctgatggagaagcgccgcatctgagcagaaaacgggagaggatgtgaaactaccaaacgaggacaatcatgaattgtgagatcatgaagaccagatagcgactcatttcgatctcctaaggaagtggaaatttgcagggatggagaagttagcccactgcaatattccaggcttgccatcttaatcaaaaccaacttctccagtggaaggactaacaactctttgactgcatgcaggtgtactaactccaactccttcagtgattgcatctctctcagaggaagtatttcccatttgctgccatatcatttacagagaatctaagttattaaagaattgaaataacaactgttcaggaaaaggtaaagcaacgaaacaactgctataccttatatgaggacaacacccaatggtgagtttgtttagagatggaaaccatgacttctgctcggttctgaaagaagagaagctctggaaaggagtgaactcattcaattgagggcagtccttgatcttcaatactctgagacgggaagtcaattctgtcccataagtaccaaagcacttctccaatttcggcaactcaattaaaatcaacttctccaaagagggaattgagagttccactagattccacatcttaaccaatttcaattccctaagcactggaagcatttcaagagatccaagaattcgccactccctgcaattgacaagatgaattgtctgcagtgatgtcactgagagattactagaaagccatgttggagatgtaggaccagtgtaaccagctatacacagagctttcaggttatgatgtggttgaagaccctcaagcacatcttttgtcctctcaggttcaaggctcatgctgccaacactccatgacaagaacaacttttttagatactctttatctataagtctggccccgttggcttcatctttagtcttcacattttcaagatgagaaattacaagagttacaagcttattcatggattggagctgtcttatatcaaaaccgctaatattttgaaccttgaacttaagtttttgaagagagatcatgttgcccacaccacctatcgaaaagtgcactttagcatcagctataagatggcgcaacttaactagattattcatagcagcaggcacagaaatatttccagagaaccccacgtccaacacttgaaggtgataaaaacttgtcaaagctcgaggaaaagcagcatccttgtagtctccatataccaacatatctttagtctccgagacacgaataaattcaagatagcggagatgatgaggatttaggaaagtatgtatagcactgatgtcagcgttcaagacgcaaactcttaacaaccgtaaacatttggcttccttgcatacagtttgtatggacttcaatagatatacactgctgcttccaaaaagcatcaagctcctcaacttttgcaaaggcctaatcttttgtaatatctcatatttctcagtgggaaaattggtatttttatcattatcatcaccagtggttatgatagacaaatgacgaataccttgtcgaattgtgctagattgcaaccctcttaccgtataacattcttttgctgaaacctgttgtgctaaatcatgcataagatcatgcataacatagtgccggtcaaccttttggaaaaatccaaaatccaccaaactacctagctattgcaaccctgtctcctccaaccccttgcctatatcttcacattgcacaaaattttgagatatccaaacctgaaccaaagttgctgcactaaacgggtgatcctctgggaataaagaacagtaggagaaacagcgctgcaggtgagaaggtagataatcatagctaagtttcaggatgggtataaaatcatcatcttttatttgaagagatttccatttgtctcgaattgtcctccaatgttcatagctaacatttctgttcaaaagtgcaccaacacttcgtgctgctagtgggcagccctttagtgctttagcaatttgtcgcccaatggattgcaaactaggatcaccctcgtagttttccttgccaaacgcacatgctttgaagaactgccaaaactccttttcatccagaccactgatttggaatgcattcactgttcctatcatttctgcaactgagttttttcgggttgttgctagcaccatacagccggttacttgactatgtttcaatggagctaacagcttatcccatccactcatgtctttttccttccacatatcatccaatacgagaagaaatcttttatctctaatattcttcaaaagaatctcctgtagtacattgaaattgctaacatctttgaattcctgtttatcttgtttatcttcaaatatatgctctaagatctcacgtgttatgtccacttcattgaagtaagtggatacacagatccaaattcgcaaatcaaaatgatcaataattcttcgatcactgtatataaatctagtgagtgttgtcttcccaataccaccaatgccaactattggcaaaacacgtagatcactagattcctcatttaataatatctctattatcctgtccctgtccgcatccctcccgtacaccttaagttcaataggaacagaagttgtcaagcgtgtgttcctgatcttgctttgcctctgatttgatgttaaagctgggtgtgagacacctggtagaagaatccccctcacagaattgccagctttctgtaaatcgttcactattccattgatcctcttagaaatatcaagtctgatctcaagaggcagcatggtgcaatgagttgtgtctccctctccttgtttcctttttctacaatatgaggcccaaacagtaatttggctcctggcactgtgtagtagttgataaggagaaaatggagttgatgaagacgcatagcttgcctcaggataattagcagcagcagcactgcaaccttcgcctgcaaaggaaacccagtttgttatgggaacctgaaaaggaaagtcgcccaacttcttaagcaaaattagatggactcttgcaactgtgaatctagcagaggttaaatcatggattaaaaatataccggaactaaccaacatataaactgagatatggttcctatgttctcaactacaccaatacaagtaagagaagatcatagaacaagacagctatatatctcaaacctttttcaatctgttgttgtagccggtagtagtcaagctcatccataacgtcttctgcatcataaagcaactcccttagaacatccagcgactggataagtggcttcttgtcaatcctccttccctcggcagtagcaagcaccatctccacgttcctcatctcaaattcaagcttcttgacaccttcggtaagctcaactccacgaatccaggcttccatctgctcagtgaagaaactcccgaggatgctttccacaagccatccaattgcagcttctaccgtagctccagctaaccccatcgtctcatggactaccgaagaccgcagcgacagcagcacagcagcaaccttagcataagggagaaaccaagcagatggattcgatgggagaaaccaagtagttattgtcttggctccctaattgtagtaataaactaaatcaataatatactccaacaatagacgtgtctgattgttacctttctaattatatatatttacacaaaaatatagctatattaaaaaaaaacatgagtctagatcatccgctggtattcttcaaagcagtttcgcggaagtcaatggtatttcattgtcagcaagggtgtttattagaatataatcgttttatcttatcagaaggatgctaataccagagcatcctatgcagcataatgaaatggcgcactggatatggtctactctggagagaagggtacttttaagaaggaaaatggagagaactaatacatgggtgcttaatggattaatacatagcacttcacattaggaatactcgaatataatctatgcgtttggctctcatgatgaacatcttactacctattatcttttgcaaattgcgtgcagcagacaacccaagctagtagcttgcggttgcagaccggaatatattccggattgataccaattatataaagtataggagagcccatgttctaaatgtagtcagagttgtcaggtcgatcagaacaatatatccagctgtctacagtaggcatttgttagttcccaatgggaaagtggatgtgtggctccttttagctatgtctttctcttcactatatgactagtgaacttccagcacatgcacaaactactctacacaaacctaaattaatatatctacttgaaggtagaatcgcagtcctaaatcctaattagtacatatgtagtaccttgcaatagcacatagcacaggggaaattatgtaaatcctgcccctagtcctagcaaaaactagacagaatactaacatgcctgtgtgccacacaagctccagtctgctctgatcatgaatctacaagagttttccccaggctccgacctctgccaccgtgcgcccatcaagcaagacacatgcctgctcttcagcactaggcattggagaggagcaagttctattcctgtcttgccatctccagaatccagatggcatgcttgcggaacacaagccagttgattatccacaaatgtcaaatctaagtgtgttaatttggacgatgaagtgtagatactccctccattccataatataagacacaaccactttttttagatgttccataatataaggcatgcatgcatgtaggcaattaactatgacccattctccattaaattattactttttaaaatcctccactctcatattctctaattctattggatgcatgcattgtatttattaggatgatccaaactacaagatgataataattattttttggtctttgggttaggggtggttataccttatattttggaatggagggagtactatatagctataatcactctgaccgcattgagagggtacagagtttcccttggttggaccagttggtaatcctgaatgaggagcaaatattgctagccatccaactattcaaggatccgtcacgaacgaaaagaaaaaaatttctcaaagtatcaaaactggacttactgataagatgcatacctaccaggaatcaccagaggcttacctatgtgtggccatttgccaggctagccaagaagggtgctgtctgtgccgggcaaaatgatgggagattggagagaggcgttggtcaggcatttcgtcgaacgtatgtagggcgcaccgtcaacgtgcgtcgagcgagcacctaccctcggggctcggggcacggaacagcagaggcgcgtggatgccccccgcgcgcgccctcttcgatcggatggcgcccgagatgcgccgcgcccgcgccctcttcgatcggcggccgcggcgcggggggagccggtgcgaacgacgacgaggtctgcagctgcaaggtcgagagtcgagaagctgcacggtcgctggctgtgcgcgaccccaaaaaaggccggaccagtgaatcatgggccaaaaatggggtctcggcccacgagcaccatcgttagatcataagactttcaggaaaaagtatacttttcctcaactatcgctcgagtatgattcatatcctccaaccataaaaccggatatattgactcctccaattatcaaaaccggtgcaaacaatatccctagggacacaggtcgtctgcagtactgcacatgcagtgcagtactgtaggggatctcaattgatatccctaggtggttttggctgacgtggtacctacgtggcgcttacgtggcattagaaaaaaaacaaaataaaaaaatatgtgggacccatatgtcattaaaaaaaatattgcggaacccacatgtcatcctccctcattcccttcttcctccctctctctctctcccttagctctctctcccttatagctctcgagagcggcggtgggccggtggctgtggcggtggggacgggtcagcggcaaggaggtgagacggtgactcgactcctccctctcccggctcggtgatgaggagaggagatggcggcggtgctccaatcgtccctcccttcctcccagatccgtcctccggcggcgggcatggggtggaggagcagccgacggcggcggccaccgtaaaaagcactggccctacccctcccagatcaggacggagtaggggagccggctagcagcggcggatggaggaggagagtcgtcggccggaaggggaggccgctggcgacggtggcgggtaggggtggtggcagtgtatttatttattttattctctgaaaatattttcataggcgggtggatctaccgcctgcaaagatggagatgccgttgcgtgcatgcgtgttagggttaaggataaggtatactctctacccttggatatacgttgtacactgatatggtatacctgcgcgtgtgcggatgtttcctgtacacgttaaggaagttcattatgtaaccaaaacggagtccacggatggaaggagtcctactcgggcagaactgggtcgttaccgtatcgtgtggggtccgatgtctctgagttctacttggagaccaactgacccgcggtataaaagggaccccccgggaggacctaaggcatcgaatctcaccgccaatacatccaccacagcctacgaagtcggagcctacaggagccaaatcgttgggtgatctaatcgaacctactcgactatggtcttgtcggtatcatcgagttttgctattccctttgtaatatgtggttatcatcatataatcccataccaactggattagggctattacctatcaaggggcctgaaccagtataattactgtttcatgtttgcttgatgtcgtactacgtagatcctcgtaccagcgtaccccaataccctctatatccggtctacgggtatacactgtcgacagtggcgcgccaggtaggggaacttggtgcttaaggttctactactatgtcatcaagcttcgtcgacaacagcgtcaaccccggcattaaccaaggagtttcttcttcaacaatgctggtgtggactcaagtcggcgaaatcgtcttcccggtttacaccacggtgccgatctcgactggtccatcaatgaccggaagcgagaacacc

SEQ ID NO: 75021 - DNA, 21991 bp, Oryza sativa
attagtcctagctgatagttggtcagaggtctgggaagcttggcatttgaatgatcaatgatgtagagcaaattcattttatgtttgaacttgatcgcatatgagtggaatgtgggatgcttgttgcctattacttttttttttcaccctatttattctacaaatgaatcctcaggtcttggctttatcacttctgttaccttcatatttgtggttggagtcttcatgtcatcttgggttggagcatctgtccttagccttggtgagtggattattaagcgcatgccacttgtccgtcatatctacaatgcatccaagcaaataagtgctgcaatatcaccaggtaaacctactgtcgcactaatagcatgtctgcaaattagcttgggttcaaattaactctgctgatttctaattaactctggtttctacagatcagaacaaacaggcattcaaggaagtggtcatcataaggcatcctcgtattggagaatatgcatttggtttcattacatcatcagtctctctccaggtaagacgactattaactattatttcgcttgagattacattacattaagatgtttatgtcatttgtacaaaaataataaaattgttgatatccgttcagcttttatattagcatgtagtaaatgtctggtttcagtacctaatttcatctcatcatcacgtggtaacagagttatactggtcaagaggaactgtactgcgtgtatgtcccacccaaccatctttatattggtgatatcttcatggtaaattcgaaggatgttataaggccaaatctttctgtccgtgaaggcatcggttagtcataagcatgtcctttccgtgtcccatttccacttgatattcatgaaggtagttcaactttgttctgttataaaattccttgatttattcttaacacgtcatgcagaaattgttgtatctggtggcatgtcgatgccccaaattctatcaactctggacccacagacaattcttggagacagaacaggagcaagcagaagctgagatctctccttggttgcaacttgactaaaattatcagaccaagtacagtgaactagatcctgagcaacacgatgtattagtggtctgtcgagctctaggatcacaaggatctgtaaattagtagaagtaggtgactcatatattccttgttcatccgttggcagtttgtaccatggtttgcactttctaccacgttctatacaagaatgcttcgtagttgtaacgccttctttacttcttactgttttgagcgttgacagcacttgcctttaaccatgttgaaggtcatcctggtgaactcttgaaatataaagccttctcgcactgtcttgcgtgcaattttaacatcgttaaaatctctaataattcgtcgtgaactcgtagcgtctaggatgacattaagattaaacaagtggatgtttgcaacaatagctatgcttgcataggcaacgatatactaaattaacaaaatacgacgttgtagacaatacacaggccatgctgtctggctgctaaaaactgttgcaacatatctattccagaaagattattcagtattcacgaatgaaaatggctagtaccgatcatcctctcaaggaaaggccaagaatgtctataagcaggttcgaaaaaccacaccgcagaatgcagtccaccattttcaaaatgggactgaattttgcagcaaaccttatctgaagtctcttgctctgaattctgcaacgttttcgtatcattcacctccttggagggggaacaaagttaccccatggattgtacttattttcttctgatcttaaccgttagagtccattgtagcttgccttctgggcgtggtatatcccttggcaaacggaggggcagctcaaactccccaagggatgccaatggtgacggcaggtgaagattgtctgggtggatattgatattgagttgccttgcaacctgttgattaaattgagatattactacaaatctgaaactttggaacaaggagtgtgactgagctggaggcgcacctcggaaacaatttcgtcctttgtcacaggagaccgcagttcattcccaactgagatgaatctcctcaacacctatcaaaataccaatgatcatcaatagttcaatgggcaatatcacaattgccggctaatgtgaacgagtataaagaaatagttggttgattgtaatatgaaaccaaacaggctgcagcaggattcacgattttggagtaataatcatactaaccaagagagcattatcaagacactttgctgccgtttgatactccttcagtttctcttcctgttgctgttcaaaagttttcagaagtaaatgagtaacaattgaaagcagaaggaagtacgtgactgataaaccagaatatgacactttcagatctaaggccctgtttggcacagctccaactccaagttatttcagagttgggttttcttagctccataaattcttggagttggagcagctgctgattcaactcgaaatctgatgatattatcagtgaaaaaaaatgtggtttcaagaatgaaccaaaggtggtttcaagaatgaacaaaagtgtgcacattacagagccaggaaagctactgtactcaaatttagtcactgaagatagtatcataacagtgttgagtaaataaagcgaaacacttaagcagtactaagtataatgactaccaaacaagaagtaaaagaactattaaaggcactatgttcaatttttttcatacactgaatagttcagatgtgcatgtaagaaaattaagacagtattgtaaccattgtgctcagaaatgtatccaaagtataacttctacaaaacagaaattaacagtgtgttcctatgttggcatagagctgaaatgaaaatatgaaatacaacttcagaactttatacaaaaacatagtacacggcctaagataatctgtagctccaaagagtacatatcaaatcaattcagcacttgaaacaatataaaaaagcaacagaccatgaagaaattgataaaatggtatctgttcaatgatgtacatcattaccttagcatcatcatcttcttgtcggacttctttcaccacctcctcctcttgacgttggtaaagctgatcaaacaaataagaatgatattttcaggcacaaacttatagtttacactgcatccaaacaagtgacaagtcgacaacaagtaaacttgagtagtgataaactagtgggaccacagtaatttaaaccttatttgcgcataaacaaaactaccaacaatccaagaaatactatgacaaattgtgcatgaagaagtagaattcaccatccatagcaaaaatcacagaacctataacctatagtgcaattcatatacccatatagattcaggttatagaaacaatgcaaacattcaaataaccaagctgtagtaaagatgcttgtaagtagctaaaatatagctattacatgttcaattgttcgattgtttattgtatattgaagaactaaagggaacaaaccttgcgctgctcatggatgagtagagcgaatttgtcaatgtttgggacagcgagcatcttgggcataaggtggttgcggaagtgtcctggggccaccttcactacctcccccgctttccccagcttatcaatcgtctacagcattccaggaagaaaccattgagtgggaaaacaacacagttttaactcctaacatttccaatcaccatatgacaaaggcaccgccatgagatcattttgcaccatgaagtgtccaccagatggatgatcgtttctcaattgaagaagaactactagctcaatacgagcggtataatctgaaatttctactccaattatccctaagacgcgcggaataatctgaaattgctactcacttgactaacaacatttcgctcaaatccaaacgtcgaatcaaataatcgacccacaaacccgcactcagatcgtcgcaatgctatacgcattccccaccttccagtaacctcgcacgcatcaaagagacagcccaaagcgaagtggccgcggatcgaaagggacgagctggagaacaggctgttaccgtggtgaggatgacctccagcttgcggtagcggaggccatggccggagaagagcacggggttggcgccgccggctgcggcgaggcagtggcggcggaggagcgcggcgcgggcggacgccatggcgacggcgaacctgctgggtggagtctccgtcgtcctaggtcactagggcttattacttgggcccatatgtttgggccttgtgggccgaacatgacggtttgggcccactccaaccgatcacgattggacggtcgcgattcactaatcgaacggctcccgagaactgcacgagtcgagctcccccgccgtcaaggagtcaaaccctaattccccagatgcctctatataagcacgagcaagagaagtcgtctccatcatcttcatcctccacgccgctatctatcttctttcgcatggttgcatctgcttcctcttcttgttcgctcgtctcgggttgatctgcgatttcagatcttgttctttccgtttggtttttcctttgccaggtattttgcaatggttaatttactttttcgttgttcgagtgggggatttgatttgtgtttttggtgtcgaggacggtgaagatcgtatctattggtctcgttcgtcgtaactggcaaattgtttttgccttgccgaccatcctgatatatcaccacccatattccgagtcctctgtaaccaaatcaattttcgattcctcatgagatcagatcttctttggtgattttctttcgtttggctcttcttttggattcattgtgcagttatattggccgatgattagattaaaatatagacaagcatatgtctgaattttcatgtggaaaagcctaatcttctctatgaggtcagatttattgatgcatgtcattgtgttgtatttttcgtcatctttatccttttcgtttacttttgaggcctatgatgatcaatgtggaaacctttctctctgaaatcttgtgaggacataccctactactgccttccttctgaggtctcttatcattgtttggatctgactaaaaatcttattttgatttttgatatggttttaaaaactatgattttttaagaggtttgatgccgatgtggatgtaaattggttgcaaggtcgagtgatgagcaaaaatgcatagttcagatgatcaaaccctagtggttatgattactttgaataaatagtctttcgctcctaactgacggcctttacgcacccatctcaaaaacggttactaaagatttatttattttgccatatttgatataatttatgttctctgattttgtctatcttaacagcccgtctttctatttgtgttaaacttgagcgtgaactgatcttgctgtagtgctgcatctgtggatacaacaacctaccatgaacctaccatgatgtgatggagatgcgatggaaagttgggagattgggggaagttgtgtgtgaactaaacgtggattggggccctgtttagttcacatcaatcttcctccaaattcccaacttttcatcacatcacaatcacataaactctaattttttttcaaactaccaactgtcaaactttttctcaatttcaggatctaaatgcagactggattgtggattgaaaattgcggctgaagaacgtgaacattgaatgcagactgctacattcgcactgttttgtatcagtccgttaattctacaatatttagctgtttagtaattaaacaatggtcctgtcatcttttgtaacctgttaagattgatattgaataaatcatatttgcgtattttaacctagtctttttaatgtttattttagcagtggatgctgctgtgaaaagcccatgtcagtactactctattttgatgatcaggcccatcacaatgtaaacccaatagcttccttatctagctggcccaaagtatttatagaactattctattctttcggcttacgcacggctcgcttcgtcggactccgctgtttcggccgcaacatctgccgctccttctccccttccctatccgtaaccctaaaatctcctgctgatcctccctctgttgaggctgcgggaggctgaaaattttgggttcccccgtcctggaggaaatgctcgtacttttgtcgatgtgcctgcaagattttgtccttttgtcgaggtgtgaatctgagctacgtttgtgattcctcctctttcccgttcgtttgtgggcaatttggagatgttaacgcgatggcgtgtttggcgaatttgcgaggctctttcccgttcgtttgcgccaatccgcttctactttggctccgcctagtaagcctgaaatttaattgcattttactagtttactacggagatagtctttcgctttaattgtacttctcccgtttcgtttcacaataagtcattttagcatttcccatattcatattgatattaatgaatctaaatagatatatatatctaaattcattgacatcaatataaacgtgggaaatattagaatgacttgcattgtgaggggaagtagatgtttttttttttcattgagatgatttcccagcaaatttactcttgtggtagtgggatatctaagataaacctgatagaacaaatatccgtttttgtgccgaaagacacttcggtgggtggatgtttcccctcacgaccactatgctcttaaaaaattacactcgtaatctgattaatttctgattcctgcttttcatccgtactttatttcgaagaaaagggaaatgtgatatagacttatgtctgctgtagacctgtagtactacaggacagtgaaatgtgatagtataatgccactttctttttgccatgtgatactaatttactttgtgcgttattccaagtcttgagatatccttcttgacaaaggtcattagaatattcttttgcaagttgccaggtggcctttttgtggtgactggattttggtgatgatttgcagcctcaggcctttttgatcctaacagttttggatcctatttgtcttcgtatgattgttctcatgcttggcgagaagagtgatgaaaatgttgccatcgttttcaaagtagcaaatatgaagggtatgattcctgtcctagctatgaacctagtgtataaattagcaaatggaccaattatcactgtttggtttcttttatgacttttggaatttttatgttagcgtgcttgctgtacatagttcacagacaactgtacatacaaaagtaaacgtgcacaccagccaccagatattacttgatatcattggggtagctcaagttctgttaggatatgaatatggaagaatggaactccttgtgacaggttatatatctgtcctgcactatgctgttgtttagggaaaaaattagcaacatttactaatccaatgttagtattgattcttaaagcatcttcaggttttgctagaattagctaaaaaaaatataacgaacctagcttgtacaccacatttctttgtaagagactgtcaaattgagaagatgcttgtcttatactccctccgtttcaaaatgtttaacaccgttgactttttagcacatgtttgaccgttcgtcttattaaaaaaagtttgtgaaatatgtaaaactaatatgtacatgaaagtatatttaacaatgaatcaaatgatacgaaaagaataaataattatttaaattttttgaataagacgaatggttaagcacgtactgaaaagtcaacggtgtcaaacattttgaaacggagggagtagttctggaaacaattcatccctgaagaacggtagtttataataatgttacgtaaagagcagtagagtaatgtagagtgcgacttggaacagtagcacggaaaacggagcgatccattagcgcgtgattaattaagtattagctattttttttcaaaaatggattaatttaatttttttaagcaacttttgtatagaaactttttacaaaaaacacaccgtttaacagtttaaaaagcgtgcgcgcggaaaacgagggagataagttgggaaaatggacgtccgaacacagccttagcagaactttgatccaaaaacctcttgattcttgctgtccaaaccatggcctctcattggagtgataaaccttcacaagagcacaaaccatgtcctgtagtactaattgctggcgcgcatgttttgatatgggatccatgccatgtgagaggactgttcactcttaacaaactgacacaaaatacactggagctgtttcatcaataacctaaagacattagcattttgagagtggctatggctgcaaaagtccaagtggacacccaagagatcatggtgcacagactgaattactgaagagggactgggagaaagttatgactgcatagcagacaagctgcatctagtgaacctcactgtttactacatcactagaggacaggttgcttaggatatattctccaaactaaaactgtaaggaaatttagtaacagacaatatagtctggatgtattaataagtggagaattcagtaggtaaacagactcttgctactgtcctggccctgtttctgaaaacaatgttgtctctatagctctgttcaaccttttttttttttcaaatggtcaggctgttgcctacgttttatattaagaaggtgtcccatttaaaaaaaaacgagaccaaaccttacaatgcacagttaattaggggaaactgagcgaaaaccacactactctaactaacctaagctaccaaaagcgtgaaaaaagaacaatggtggagcccaaaacaaccatcgataaagagcttgttgtaagcgacacaaagacttcgactttcacgaggcaagtgctatcattgccgagcttgtcgcctagtgacacggcagctccgactccacggctatcacatcatcgttgccaaaagcatcgcaaaaacgagcaagtcaccgattgtccactttgaacatcagcccaagccgccagagcaccacttcttgaacacagctagcaccaacacccctcgaagactacaacgtgttatcgttgccaaacttcattgcaccacaacaaaacagctccgacttcacctagaagaaaacgaagaaagttggacgctcaccacatccaagaatggaacccaggaggtgaaggcctcgccgggggcccacgaacgaccatcgttgcacgggaaggttttggtagtgagagaaggcgccataacaacgcctccaaggagggaaacgacgcctaatggcgccgctgttgtcaagccaatcaaaggccagccaaggctttcgccagcgtcatccaaaaccacacaacccacccgcacttcgtacattgccggaccaccacatcgtccctctagccaccaagcctagcccgctgccatgccgttgccatcctctgctgcacgggttgaccaagcgtgacccgtcgccacaagcgcccgcaacgccgccgacccgactagatccggccaaggcgaccatggatccggctgtcaaagctcggccagccgctgccatcatcaccacgagcgcccacactccgctgcgccgccgccaagattctctcccgcaaccgccggtgagcgcagcaggcggccgccactgtctccgcgccgacgagggcacgcaccccccctccgttgcacgcgcccagccccctcctctgtcactggcctcccgcagccatccccgcactggcaagggcgcaccggcccccacctcgccttgacagctcggtgtcgtccttccggccggtagggcaacggatctggccaaggggcgccagatccggccgcccccatcacagggccgccaccacctcacgcctcctggcccctccaagatcgacgacgccgccggtggtgagagcactatatccggccggatccgagctcggcggccccggagctggacgtcgtcgccagcgccatgccaccggcctctggcccagatccggcggcgccttccccgcctccacctcttccgtgcacccgcctcaatgccggcattgatgtggccggctccatcttttggtcctccgcgccggaaccgggggtgaccgccgccgcgagccccgccagctttgccggccactcgctcaggcggcggcgaggcagagatgagagttggaggggggcggtggcggctagatttccgccgctcgagtcgcccacgcaggaggcgaagcgggggctgtttccttggcaatcaccgtcaagctagaaaaacaatcgggacacagttctgttcaaccttaaaaaccagttttccctccaacgtatcagttgtttttggcctgcaacacaatttacttctatccacggtccattgctggacagtggtaaaatacaaaaatacttgtgagatccgaggtgcaaaattagtagactggagattataagaaggctgtgctgttttcatcagctgtgaattttttaataatcgtccttcataccatgtcacaaatttaagttactataaaaaatgctcgtgcgttgcaacggggaaatctactttaatcttattattgttatatggtttagttaagatgaaattcactgtgcgagtttgcttggatatatatatttttagaaaatcatgagctgcagttagaagtccgatcgtctcaagttagcatgcaagtttttttaaaacagatttcttatatgatttcttctgtattaccaaaagtgaacgatcttaaaaaccgactcaattacggatatatattttcaaaagcaaacgaacttaaaaaccgactcatacacggatgacataccaaaatatcggcaaaacatcttcaatttttataatagtagagatagagaagagatatagattaaaaccaaaacataaaatcaaaaccgactcaaatacggatgacgaaccgcggaaacatctttaatttttataaccgactcaaacacggatgacagaccgcggaaacatcttcaatttttataatagtagaatagaaatagatagattccaaaagcaaacgaacttaaaaaccgactcatacacggatgacgtaccaaaatactggcaaaaacatcttcaatttttataatatattagagataagttagactggagattgttcttgccgctgtctataaatttaagctatatttcatcagaactttgatcaagccacaaagccatttcttggcatccttgtttcgaggggacctttgaacaactaggtacaacagttgtgtaacgctccgcttttcgtgagtcgttaaaaactaattcggcaaaatcctaattgcgaaaattttcgttctttgtgtgagagtctaagttgtgccaaggatctcaatttaatcccgttgttccctctcatcgaaatcgaaatcctccacctcgaaaaattccttttccgattcaagtctctgaaatcaaattctgaaattcaaatccttcctttgaatcctcgccaaatacttctacgaatccagaattattcaaatctcgcctcgaatccttcccttgacttcaccttatgttcctaaagtcaaagtatcaaggttaaattccaaaaatccttctcaaattctctccaattgaaacccccccaccaaatcagttctcttggaaaaagtctaaattgcgtccttcttggttgtgggccgtttctcccttgctcggcccatttctactcagctccctccacctccatgtgcgctgcacgcgccgagagagagaggcatcgcctctcttcttcctctctctttcctcgctctctctctctgcttcctttctctctctcccacgccagcgctgccgccatcgccgcttcccgccgtcgccgcccaaaacccgccaccgccttcgctctttcccgcgctcgcgcgtggccgaccggccggtcgttgccgccgtcagccctgccgcgccctcgcgtccgcgcgcacgcgctcgcgcgtgggtcgccgccgcaccagcctcgctgccctgccgcgctgcaccgcgcagccgcacggccccgcgcgcgtgctcgagccgctccacgcttttcttgccaaaacccggaggccgagctctccctctccctcctactcccttcccgaatcggcttggagcgagcctctctttttccccttctttttccctttcccaaccaccatcggcgtcaccgcctgccaccgcctggaccacgggcgcgaccgccagcccgcgctcacgacccgaaattcggccgtctgatccaccgccttcgccgcccaaagcatccacgccgtcgccactttcgcatcgcccatgaaaccgccgctgccgccagccgagcgcttgaccgccaaggtcggttctcccctcccaaaccgacatcgcctcaccccgcgcctataaaacccgcactcccctccctcgttcggctcctagcctctccaccatcgcaccgtttctcaggccaagaacgctcgcccaacgccgcggcctcctccgtcgctggtgttcccttcctcgccgccttgcgtcgccgctcggccaacgcggtgctgcccgccgtgaacaccatcctccagacctggcgccgccctccccgaagcccggccgttttccttcgccggcttcccgtttgctcgccatcgacgccgttcatcgccatcggtgagctcttcacctaatcctcctcgttgccaccctcctggatcaccgtagaacactcccgaaccgccgctttgatcgctggacccctctccctccccggcggcgttccgcccttccccgcaccgcgcctcgctgtcgccggcctctctcagagtctctccgccccatccgaccccgagaacaagttcccagagtcctagagatgctcccgccaccacgaattgaccccattctctcccggcgtgttttcccccttttgctcgccgccggtggcagccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtcttcctcctctcgccggcctgcgtggctgccacgtaggcgccacgtcggtgccaactcggctagaccgagtcaaaccggccagcctggctagccccctccgtgcgcacggaccacggtgcgccatgcggctgcacgtgggcccgtcgcgcctcggtccacccggcgcaccaatcgtgagccgcatccacccgaaaccctaaacgccgcccgcgtgctcccatccctccgtgaaccgtgtcgccgacatgcgggccccacccgggacctcgcatggtgggttcggtccacccggactgccccctttcccttccgcgcgcccctaatgggccgcctccttgcgcccgcgccggcccaatggctcggccgagcctccttctacccattgggccgcgcctcacgctcggcctaaaagtccatattcctccctccgtccaagtcagtgtccatctctcatgagctaaaagtccaaatttgctccctctcaattttattctctctcaccttcttgttgaccccacttgtcaatgagtcaaagatattcttgagaatgtcttttccaatattccacaaatatttctcttttctataaattcaataaatcatttttccctctttcagaaatcaattccttattccaaaattccatgaatcattttccttggtcagtgactgtcaataatattcttgagaatattatttccataaattccgacaaaacatttccttgtccagaaaatccatttagacctccaaaattcatatccctcgatccgtagctccgatcgcctccgttccacttccagtaattccgtaaaattgagatctatttaatggcactactaattagtctaaataggatctttcttttggtcctttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcgtgccaaaccgacggacctacccagtagtcgcactaatttctgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgagacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggacttgatttgtgaatgcctaaaatggcctatacttacatgaggatttgatccttctatgtggcatgaggtaaccctgggtcggcttgggaaaggctttgtcgcgaacctctgacaccggccagtgtctggagtaagttcgtgtcttgtgggtaaagtgtacccctctgcagaggtgggtaaagttcgaacagccgtgcccacagtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcgggttgttgtgctgctgggcagctggactctgggagtccgagaaaatgaaaaaggctctgggagccgattaatcaagtggaatggctctgggagccgagaagtaatgatctgaaccaggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcaccattgctctatataaatatatatatatatatagttcctccgccctgaagagaagataaagtgaagtgaagattagggtttcgtcctggttcccagccgtcgcctgtggtgttgggtattagaccgttggttctgctgctgctgttgttggtgttcgcctcgtccgtgtcgtcggttgtattctcgggctgtctgagctgcagcctaagttaaggtaaataagtcctctatttattttaaagattgctatgattcatatttgtcaccgtgggtaccagcactatgtcctgggactggtaccgagatcgcggtttcgtaggaagcggttcgcaccgttttccctacgacacactcctgtcaggtgccgttgtacggcggtatcagattggggtgtgacaagttgctctacaaggtcattcataagatatgggccacaaatctatagatgatgtctgtcagctatgggtgataatggtgggttcgacgtgcagttccaatagccttccaaaagaagcaaaatattttggtttaatatttttttttaatatacatattgtcttgttaggatttgctccattattattcatgcatgaatattttctgcagtcttaactactccaaaatgttgatatgcaattactttgcctatcagctctgaatgagtgaattcttcattactgatgtttcgttgtccctgtttcacttggggtcaaatgctaatttcttcatgcttggttaatgaaaatcctttttctcttagacagtgtgcttctcttagacacttgggtctggaggactctactgttattaatgtattaataaatttacttcagttgtgaacttccctactgttctcgaaatgatagctttattactataggctagtgttgatgcctcatagaacacaaactctccaacataattactttagcaaggtgaaaacacattccagattgtagactactacgagatagtagtatcatgtattgtatcatgagtaatacttaataagcgtgctttacattaggtggaaaaatatattgagataacaaattacgcctgctttagctgttatatgcatgcatgttcctactgacttgcttggtttacccattaaatgacttctgttattaaagcaaggaaaaccaggagttacatgccaaaactccaggagtacccttcttgagatcgactggctacaaaggaaaaggtacatcttcccatggagttttgtatacaatcttgtgtaacttttccctattaacagtacaaatattatgtacaatgtcaacatatgtcccctgaatgtctaaattcttgaagattgtccatcaaatacgcttcagacatatgttccctgaacatctctgcatctgcaagtcagtttcttgcacatgcacacacaatataaatgtatccgacctatcttgttaaggatttatttgtgattaccatgaacagtgcctttgagcaaacacttgaatgcatgaggtaataacacacatcctatttactttggtatttgcatataagatagagacattaattagccaccccaaaaggggaataatcgactacaccactgtacatacagtacatgccctcccaacatggtatcttcaactggacaacgtttgtgccaattcttcttgagagtatttatctcccctgctacccttcgaaatcagatgtagctttgctagttcattattccaccatgtgtgcttgacccaagtacccaacacaatcatgtattcttagttagatcaagagaacaccatcatcaagcatatcaaagctaagccattctcatgaatttctggggaggaaaatgagtgcaagtgaacttgtgatcctatttccttgacagttgacaccttctacaaccaaaagcaccattgatccatcaaaaaccgccacaagaggagagttgcatgcatacctcctgctgctatgtgttgttcccaccagcttgtttgggttcaagggccaatagttgttggcgcagggccatctggactcgctgctgctgcatgcctgaaggagaagggaatcgacagccttgttcttgagcgctcgagctgcttagctcctctatggcagctcaagatgtatgaccgcctcagccttcatctacctcgtcagttctgtgaacttcctctctttcctttccctgccagctaccctgattaccccacaaagcagcagtttgtggcttacctggagagctatgctgcaaagtttggtatcaatcctatgtacaaccatacagtggtgtgcgcagaatttgacgagcgactgatgctatggcgggtgaggactacacaggccactggcatgatggaagatgatgttgagtatgtgtcgcagtggctggttgttgcaaccggagagaattcagaggccgtgctgccagtgatcgatggcttggaagagtttcgaggaagtgtcatccacactagcgcatacaagagcggttctaagttcgctgggaagactgtccttgttgtagggtgtggcaactctggcatggaggtgtgcctagacctgtgcaaccacaatggttaccctcgtattgtagtaagagatgcagtatgtgatttttcctctatgcctgttagttttatacttgttttatagtttatgccattctgtgtaatatatagttgtttatactttatattcattctttgcccaataaaactcacatgtagattatagtatgtgggatgtttacttgttggtttcctttagttagttctttgacctaatgcctgtgtttgttagaaagtgcaccaggagcaacacttgccctatacttccatggtgtttgtgcatctttaatatttgagcaattcatggcattcatccaaattattttggtctattgattacttctctcttaaaatgttttctgcccaaagtcgaacctcctatgttgtttatgtgtcaagcttagtaacgatgccctatgtcgggctccgtcagtggtttcaattgttagtgaggttgttctaagttatggcgagtgttgtgtggttgttcagccagccggtggttctgtattcttttcttgcaacccacctagggtttttatttccacttgttgaaatataattagcagttttactgtctgttttagttttttttaaaaaaacttggttgtaaagtctaattttttatttagagtttttttttcaaaaaaaatgaaagcactaagtggtgcatggcaccttgtcactgcaatgagaacacatcgttacgaaacactagtacaatagattgagaacctagttttcttgacaaaggcagtcctttctgatggctctaaaattttgaaatggcatgggtttggttacaaattgctaaatcagcttatattgttagatatagtatactgtgttgggtacgaggaaataaggatgaaacccatactttcacaggcatattactcactgtaaaattagttctgattaacatttgttccaatcaccaagccaaaaaaaaacaaaagctttaacctcgttagcgtgccttaagaaattttggatcatgggtttgcaggtgcacatcttgcccagggagatgctaggtcagccgaccttccggcttgcaatgtggctgctcaaatggttgccgatccatatcgtagaccggattttactgcttgttgcacgagcgattcttggtgatacatcacaatttgggttgaaaaggcctagtcttgggccacttgagctgaaatcactgtcaggaaagacacccatccttgacattggcactcttgcaaagatcaagtctggagatataaaggtttattttcactatttttccaaaaatattcatgaacattcatagcctcttacaatcatgggttgatttattttctggatgattttttcttgtgaaggtccgacctgccataagaagaattgcagggcagcaagtaaaatttgtggatggtcgttcagagcagtttgacgccattgtacttgccaccggctacaaaagcaacgttccctgctggttaaaggtatatggcaatacagctgatgttccttttgctgtagaagaatttcagtatttcttttcctgaaaaacgtgttcaccaatattgagtcacctagaaaggttgagcggtcttcaggctaggcggctagcaccataaggtggtgggcttgccaacctaggttcgagcctcacttttcttaataaattccgatatgagggctcctcctctcgtatccagtgttttgtttaatattcagtcactcaagacaacctacagccaatttgaaacaagttcatacaaatgaaatttgtgtacctcctgactctttggcctcttttttggcgccatttggctcactttgagcaggaccaagggctgttttcagaaaaagatgggttgccaaggaaagcgtttccaaacgggtggaagggcgagaggggtctatactccgtgggattctcccgtcgtggcctgatgggaacggctgccgatgcgagaaggattgctcatgacattcatatgcaatggaagtcgtccaaagggaggagtcgtccagccaaaccttctccttagctctgttgtagatgctccatggatggcgagtgtgtgtaccgtcctgccgtttttggagctgttttgtttttgattggccaaccgatttggcagaaacagccaaggccgggtgtaaacatcatgcaattcgcggaagcgacgattttcaggttccacatgttagagaactttgctctgtttggcctggccttggtaatgaatctactcttgttttggcttgcgtgatgatggcttgcgacccctctccttggaaaagcaggaaagggaaagggcatcatgaacaggagagggagacatcgctgatggggagctgagaggcaaaaactgtaacagagatccaaatatccaatgcagttgctattgtgcttgtttattttctgatctaattaacagttcaaatcagctgctacaatagtattacagttggtcttgccattttgctttgattcatgaggtggtgccacttgcagttacagtagcaactgcactgcactgcacagtaaccaaatctccaaaactgacagcacggagaaagacctagggtcttaccggctagcctcaccacctcttaacaaacatcgatgtgagatttaaaaattgacagcatgtggctattggatatgcggagttgacattttggttaagactggcaccaactatacgcttatgtttgattgctgagatacatacgtttcacttgctggttgttttactaatcaaattaaaatattcggcaatatgtttatacatagattatgagaaaaacaactatactagccagaaactaaaacatctgaaatcagttagcatcaaacgaaattcaatctaatcaataccaggcggagccacgcatatgtcgcgaatactgacaacaactaaacatatgcgtgtctgcaccctcttaatttctgaaagagatctgcgacttgacacccattaattgggatgttcctctgctaattcgatgtcatgtagtactagtacctgtcatctacaggctcttttgtgggaggaatgggtgttctaggaaccccagaaactgcaagttgtcatttcgttaatgaaatgggagaggtcattatatctttctaaaataagagtgacgtgttctctctccgttttaaaaaaaaaatctaatcatgaggatgtatatctttgacatgtacgttgtccaaatacatctctagaaatttttttttaaaacacaggagtagtacttcaggacatgcacaattgtttatgtactgcctccgttttaggttttaatactttttagcattgcctatatttacatagatattaataaatctagacacacatatatatctagattcattaacatatagataaatatgggtaatgctagaaagttttataatatgaaacggaggacgtacatgagcatgcagccatgcacacgtcgtccaatatttccagccaaagagagcaaaatttagcaaacgtaacggatatttccgtttgtggtgcagtaaaattaagacgctaatctttgacgtttcaactgttactatcccttcaagcaatccatgaattttcttctcctttctgacttattttcttttccaattcctagtttgttttaaaaacggtgtgctgtggtgatgtgtgcgcgcgttcgccagtgcttctctttactccaaaagagtattgggccaggcccaaacaaaaggcccagcctgagcgatagttgaaagcccattagccgtacaaaaatatacgacaaaacacattttgtaaaggaaaaaaatgaaagtatactctttttaatagtattctgtgtttatatacctgcatagaaaaaaattgctcaaatatacctctaccacataacggagacacgggaccgcctcagtgtcgctcttccatgccgcaggaccggtgggtgcgca

SEQ ID NO: 75022 - DNA, 12399 bp, Oryza sativa
atgtgcttcaattgcaggtttatgctgtttcatcaactgtccatgctgtgagtagacatatagaattataatttccttttatacttttcaaaattgactaatataaacttctgatgctaataaatttgtttatctgttaaagtttgctgtccgtcttattttactcctatggagactcgagctaccctgtttcccgatgctggtgattgctgcttgcaactactgtgagtttgtaacttcgtaatgttgttgtagccataaatttgcaatatataatactttgttgtttgtttcatgatttactatctgccttttattgtaattcccaggcacatcaactgcaatgttatttgaaagggtgaaaccatcccagtcaccagatagtttgaaagcaaacaagattatcgcaactggtgctgcttttggaagctatattgccctgagtacagtcgtttttttcataatgactactaggactgacttcatatctgtaagaacttgtcacccttattatttgtgtgattttctagtaccaaacctaattaacagtatttgacagcacataatcaaagctagattgcttgttggccatgatgaggagattaaatctgccttattccttcaaatgagcattgttaaccatgctattggacttttcgcacattcacgcgatggccactgctctgggcctattgttacaatttcttctgttctatctcaactggtgagttattcccctgctcaatttccaccccaatgtgatatgtggcttttattgcaattgatttagacaaccacctgccaattctcgagtacaatgaacttgcaatattcttgttcctgtgtcctcagtcctaaattggctcagtaacactgatactataatcagaggcaaattatgtttctgaaacagatttgtgatgtggacataacatagtctggtcactgatcaaaccacttgacatgaacaaataaccatataaccatttctctttgtgtacaaagtatttgattattgcttgcagctgtagtaaagtatcatgccaagcttaatttttaagctcaatacatgcatgggttactgaacaaacttattttcaggtggcaaccgtcattgctgtttatggtgacgtgaactctcctctaccaaagggcattggctggggctgggcaggatttatctggctctacaactttgtcttgcttttgagcctcatgttgatctgtatgtatcggaggatattttatttgattttttttatttacatcttttgaagttggtgcatcactgcatgaacctaaaaacttgatatattgtctttcactgcttcatctgaatgcacagtagtgaagccttattgtcaagcactcaagcatgctcaccttttacaatcgtagtagtgaaatttgggagttgcatatctgtcaagagttcaatttagtctaatctagttgtcacgttctttggcaggtgacctgtgtaaccttgcaaagttcaacatatttgggataacctgcaggaggctgttcactggttggaccgagtggatggagaggtgcaggaggctgctcaacaggggtaaaacgtggatggagatgttgaccttaactgctatctcaggcttgattcttgtctggtcgatatatgcatatcatgtcatgaaggtcccgcagcagtagggtggcacttgacaggtagccttgacattaacatatagctttaggtcgcaaattagtgactaagcaatgtagcaatgtatattattaacccgtgtaaagtaaatgtcatcgacatggttttgtttctgtctttttcttttttcttttcttgggtccgggcttctactgccgtataattttgataagagggaagtatatgggtggtcaacttgtgcggatgtgtcattcgaatctgaactctcaaaatatattttgggtatcaaacttgttttgggtgtcatgtaggcccaaacgagctctgacctgttttatgcacggatgtgacacaccatactgatgtctattgtctacgtgttagtgggacctatatgtctatcatatatatatatatatatatatatatatatatatatatatatatatataaatataagtataagtaaagtcatattttctcctcttaggtaaagagggaaaaaggtaaacctaaaaaaataattctaaggtattgaggagaaaatatgttttttaaattttatttttttttctatgtgactgacatgtgggtcccattggatacgcaagcgctactatggcatgccgcgggtcaaagcctgtttagacctatatgataagtttgaggattcgaaaatatattttaagagtttaggaatccattagaccactagtgcacttcacccttttgagaaaatctaagaaatttggatgcgattaggcattagacgtctgatctagaccaaaatgtcagacagttggatacttggatgatcaaatgtttcactagattgtcaaaatggttcaatgcaacacatgtgaaaaataatagtgaaatattacttaaaatagtataatcctgccacatttacaactaataagttgcggaacatcacaaaaaaaaaatggtgtggaacatttttgaaaagaaaattgtgctacatctctaaaaataaattggtgcaatataaaaataaaatgcagtgaaacattccaccacaacattcaactagttttactcctcctgttccaaaatataacgaccttttatgtgagtagggccctagatgtgagtgagacggttagagggtgaaccatcaacaagaaaattatgttactcaattgtagtcaatgctttcttttgtgtaggtgggtgtgtggggtagcatatcgatcattcctgttcgacgcaaactatactcatccttaacgtattgccatttgcatcatatgctcacgacttctcttcctggacttccttttcttaatgcaatttttggggcaaccaattttttttttttttgtaaccagttttctgaaaccatcatccatcctgaatattgcaggcatttcaagaatggaatctgtacgcacggctgagctgagtcggtttcaaaagcaagtctaagaacagtacatgtctaacgttgaggggcagtataggtccaaagactcgatgagttgctgagtgtgcgtaatgacgattaggaacatgctgaggacatggccgcgcagaagattggagaagacatgttcaaattcgtagtacgagatagtgtctaataaataatgcatgccgtaaacttgagttcatgattatgcacctttttatcaactttggttagagattcacaaatagaatttagtaaatgtggggttctttatcttgtggtggtatctatagtttgtgtttgctttatgttatatcagtgtgtggtgagattgttcttgcgtgaattttgtaataattggctgtgaattttataataattggctgtagctcgttgagcaaaggctggtattattatctaaaaaaagggagattgtgactaatcgcgtacaagttattatattttgagacaaacactactacgaaaaccatctttcatgacggctattttgggttttcgctggcggtatttggcaccgccataaagcaaaggccagtgaaaatatagcatctccgctgacagcgctaaaccactagagaagataacttttcgctggtggctggttaaagacaaccactagcaaaaatcgttttcgctggcggctttcgtatgtgggccgccagcgagaatagtcttcgctggcggctgacttatgtgctccgccagcaaaaaaaatagtcttcactggcgggccgccagtgaaaatgattttccataaagaaattaatcaccaaaatctcttttcgcgaaaaagagaaaataaatcagattttccacggcatgtacagattcaaatccacatccaaatttttgagcatcgattcaaatcctcatccaaagttcattagattcaatcaacatgcaagtgaacacggcatacaagcattttgaacatgaaaaaaaaaaaagaaaaacagcatcaacaggagagaggaaggaggtcgtcgtcgccgtcgccgaccgagcagcaccggagccccatcgccgagcatcactgccaccgaggtcctcccgccgcaccaagccccacagcaccggatctgggaagcccagccgccagcgggaccgtgggagggggaggtggagggggaggaggagctcgccgcgcccctgtcaccgttgccgtcccgttgccgccgcgtcccccgacgactcatcccgtcgccatcgccgaaccccccgacgaccgcctcccgtcgtagtcgcgcgcccacctcccatcacggtcaccacctgcgcgagccaccaccaccactgccggagccgctgccaccacctgcgcgagccgccatcgcctgtgtatggggagggaggagaggatgctggtggctggatctggaggaaggagatgcgcgcggtagcggcggcaggtgtgagcagagcggaggaggaagggcgggtggtggcggtggcgggcgtgggagcgaaccggaggaggagcgaaaccggcggtgactgatgtgggagcggagaggaggaagcgcgtgcggcgatagagaggagacgaggagataaggttggggagagaaggagtggataaggagtggctggtaggcggcgattttttgtaatgggtggacgcgcgcggttttttttttaagggcggtgtttttagtaaccgctagcgaaaatgagattttctctgacggttagttaagaggcccgctagtaaaaatatggttatttttgcaagcgtattttgaacaaccgctagtgaaaatccacactaagtaaaaataggtttttttttcaagcggatttcttaagaaatcgccagcgaccctccaccccttgttagaatttcacaagcggatttctcatataaccgccagcgaaaataataggataccgtcatgaaaaatcgatttttctagtagtgaaatggactaggaacaagggaaagtttcacacattcgacatccgcttcagtcgccttccttttccgacgctcatgtatggagaaaatccaagaaatgacattaacaagtgctcaattccaaaaaaaaaaatgccatcgacgagtataaattctataaaatgccattgtacaaacgatttttttctagaaataccatcgccgttagggttccgtccattccgtgccgttaaatacactattcatcctatagcacttaacggagggttgctaacggaaccctagacgtttgtcaatggtaattcttgaattttctccttatgtacagtgacactcaagtttttccccgctggtatcaatcagattgttgcgggatgtgacgtcttgataacaatctgttgctgtataccatggagaaggctgtgaaatgtctttacattatacatgcatcatggataatatgcaatttgaagcacataaatttagaaccgttttgcaactttagagtgaaaaaaagacgcagttgtaccgagaaattcgttggatcttcacaacaaacatgttgagcgtacaaacaattcgaatggacatgctaattctttacaagatctacacatgtgggatcgccgctatttactgttcggtctcgctcagggaaaagcttctccaatacaaattgtctaaatcgtattgaatacaaattcggatcaacagctgataccgaaagtggatcgaacttcagtgatttgagagcatgttcaattctgttagacacattatactctagtagtatgttgagcgtataggacaacatcatactcttcaatggtgtccacgttttctagttctatgttgttatatatacacgcacacttttcgagcttgagtaaccaattgaccatagctgaacacggaacctgaaaaatgaaaataaggaaaaatgtgtcaaaaacagaaggcaatctttgtgagaacaaagaaccacgcagaccaaagtttccaaaataaaaaaggggattttctgcccttatgatatgcaactacacccatcaggattagcacaagtttaagaagcacactactatatagcaggggcatagacgcaaaaaaagtgcaaaaccaccatcacatgtgcaatacaagaagacaagcaatgtatattactgatattgccaaatatatatacacaaacttgtcatttttttatcatgcacaaatatagtcaacttttgacacctcttcaaatgcacaacttataatatgctctacatctatgaatgcttcaagaatttgcacttaattacggaccaagttaaagggtttaaagctaaaggctgatctaaaagttaaaaattcaaataacggaccaagttaccaaaaatattgaactttgcaagtaatacaacttcctcattgtattttgaactttaaacatgctaatatacttagaaatctttcctgaagagtgtgataactatactagatattatctcaatttgtgttctttcatttatgcatgttcaaagaccatacagtaataaatgtacccaatgctgacttgaactttgaaatatttgagatagaagtaaatctaccttccagggactcgcaaaacaagatcaattccttcataaccgccttttgttagccttttgttatgtgtgaacatatcttcctctttaaaaaagtgaccactcaaacttttgctgattcttcctcttgaattttctgtacacgaaaaattactgttatgacacattattctcaaacgaaataactagcaaatcacataataccttcaattttgaaaccaaagtagccattgagggacgatcatctggattgttaacaatacatgtatctgccaaaagtatcctgggacatttcgtggggctccactctttcctttctagtaaaaccagttctctgatgagatttccaaaacagaagacaccaattttttcctgggcactctctgttcaagtacacagatcattagttttaataagaacatattttggaacataacaaaatagtatagatgcaatacaaatctaagtatacaaatacaaatggtttggagaattgaaagatgacatttcatgtcttaatgaaatataggaccagcacccagcaacttacagttgcacgcttctgttagctctatgagataacaatgaatctgctctacatgaaagaggaagacacaaattcttattttattattattattttgcttggttactcatataactaatgcatgaacattgacgaatatatctacacttaaaaacaaaaataacaatcttaaactttcagatagaaactaaggactattttggatgtctgaggcaaatgcatgacatattatcttgaaaaagaatatcccccataaaaagtgagttgaaaaagctagctgataaatctagtaaagatgctagatccttctacttctctaactctattatgctactgaataaccttttacatccatctcccttctatcttgtgaaattcttcaattatgaactttactatcttctgaacttgatgtatgatgccaatgccatactaggtttagatataggacatagtattatagtttagggggaagtatgggtgcattttcttttatggctatccaaagttaagatcatagttaatataaggcccttcagggctgttaaccttcactcgcacacacacagaagtgcaccatataatgacttagaccatctaaaaaatatatatgttgcttggtcttattagagttcagacaaaaaaagcatacctttatcatttgcattaaagatgccaaatcttctatccttgaagaaactcatcttctctcccttccttgtggccaatccaaaatcagcaattttaactgtattatcctgaaattgttatcatttattagtcaaagtagacaattacatggttctctaacagcaacacatttttcccgtaataataaagtattgactgaatttcacaaaagtaaatatactttaaccaaactgttgcaaactacatatttaaggtgttgtatcacaaactgcagcttcagcacaaaaaaattatcatagaactacatatttaagaccaggtataacaaaactacatatttaatattgaagttatcaagaaactataggttttagagtataaatccctagcacgactgatatgtttgagctataaacattgtagtctttgtgattaaattggtgctaaatctgtagttttatgatacttttgttactaaatctgtattatcgtagtacattgacttaaggctgtaattttctgatagtttggtcaaagtatatatatatatttttttgaaatttactctaaattattcgtaaatacaacaagaatttcaccttcatcaaaagaatattcctcaactgaatgtcccaatggacaaagcctgcagaatgaatagcttccagtccagatgccactccaagcaagatagcatccaactcacctttattggatgctgttagtagcaaaatcaataccaatcaaaataagattagattggaaaccctaaaataaaaaaagagcagtaaaatttatttacctctgaatccttcgaggtcctgtttagccctttcataaactagagcatagtactcctctgtgtcagcaaaacccacaagatttatgacatttgcatgtgaaattgaacttagggcattgatctctgctgcaacaaaacagggtgcaacaatttattgacaggtcagaaacttaatcatttttaaatcaaataatggtaatttcttttactgtgtacagacaaccacaagctacctagacacatcttatataataatggaattcaggcaatatatatatatatatatctttcaaatatgcacaatctacccaaacacgcttgaataataatgcagcaaatgcattactgcaccaattaatttcatggcaattattaccttccacataatccggacatactcatccttccttttagaaattttgatagcaacttttcgagggcaatttgcatagttattccctttattcctgcccttgtaaacctgcccaaaggctcctggttttccaagcaacctcttctctgagaaacctttagtaaacttgtgtaagtcttcatcactgaagttgataagctccatcattgttaattcctgataaaaaaaatgacagaaacataataaacataaagcaaatagcatggataatttgggagacctagagacagcacaacattagaacacagtaaagtaaggggtggaagcctagagatgattggattccacttttcacgataactcatacctatggtgtagatgaagtgtatggaggtgagctcagttgctccaaaatcccacagtatgtagcaacggcgtaacagcagagcaaaaatccagaactccagatacaaaatgctattgttttaacatggacaacaaatgggcgaaggctaccccgaggattacccctcgtagaagccctcgcccttttgccctaggggccatgtgagatgagccaaaaacttgtgagatgtgttaatgttggtgtctaagacaagaagataaactttgtagaaagatagtagagtgaagtagatatggagaccatgagtaagcttaagtatagggaatcccctttccaccccttctagttgtattagccatgtactagaagtgcagcaaggggattctccaaactaaccctgcttggcactgggaggtattgcattttcaaatattgcatattggaaacaaacagatattgcatttttgtgatattgagccctcctttggatgatacctagggttcaggtcagcagagccaatgtggccagtggatgaagtatcaggtggggtaggggctttggggaacagggttggtgatccaaaaagatattattgggcttaaccggaggagttgggtcctgtcaacaacacatgaataaagacaatgaatatatgttagcaatgtcatgatgtgattaaacaaaagccaaatgcatacttagcatacaaaggataattaataatcatacgaagttaaagtccatgcgtactggaaatgtattctaatttggcttgttcatatagaagaatcataggattctttgaacaaaaaggtcaaaattgcctccaaaagaaaaggaaaaaaaggcatcttggggataaaacactcgatagaatttctcgattatccacctagagtggatgcatcggaattcatgaaagaatctcaataagccctgtagttatcaatgcttgatgggtcttggatagagaaagttaagtaattagtccattttccaacatcttatcgtgaattttgctatcctgatgtatgccttactcatgaacaaaataaccaaatgcaaataatcaaactgagaattttaaaagtatttcccaagcacatatgtaatatagaatacaagaataaccaataatcagtcaaaagtaacataattatacagtgaatattacatatgttcccaaaataaacatctaacaagaaaaacacgcaaacaagtattagttccattgtcccacaatgcagtgcaagctcatcacacagttcatccaggtgttatctcatcattgtgcaattcaaccattatggtcccaataagaaaatttaagtgattgtccagtacttcccgaaatttcttagaatgaccaatcagcaccaaacaactatcaatttgcaacgtacacatcactactaccttaatgttcttcccgaccaataactattttcttacataaggtacagcaggaaatcattgacgagtttagatggtaatttaatatagaatattaagtcagtcattgtttagatgactcttatttgattatgatggcctgcatatacataaaatcaacatgtgcatagggatgttctaaacattaaggtcagtagtaacatttgaggccagtgttacataatcccaagagatggtaggctttgggccaggctacatgtttaacaacttatgaaaccaaattaatagtacacattgtaccgcacaagtgcaaatggatcaattaaaggaccagcagagatgaaccatccaactttggaattgatcaatcgattagttaattcactgagtcacagaatcacagttgattaatcgattagttaattcagatttagcagaaaagtataatacgccaccagcaaggagtgatagctactactcaatcacttagtcatgtagcagctgttgtcgtgcaccaaaggaaacaaatcaatgtaaattataacagaaacgtataatatgacaccagcaacgggcgatagctactacagtatactcaatcactcagtcatgtagcatctggtgacttgcaccaaagggaacacattaatgtaaattatcatagatgctcctttcacccaacctgctttcagttacacagaacaactttgaaagacccatgcctcaagtggaatttccaaagggaaaactattaagccatctaataggaggtggtacaatcagcattgaatattatatgacctgtacaaacaataccaaaaaaccttggttgtaacttcaatggttccatcagaaccagcacataagaagacaacgattgtcatgcaaaaatcaaatcactggtgacaaaaaacaacaacaaagaaagtcagcactgggcggaaaacattcatcgaaacctgcagaactgaagcatggaggaaattgttggtcacattttgttatgctacttgtcatcactaaatcgcaagctggaaaaactgaagctatctctgctcgaaatgagattagagccaatggaccaaaacctatatatatgtgactcaaatactctccctctcccttgaccctaaagcactgagttgctagataccataattaaaggtcattctattgatgagaactcaaatgcagatgctacgcatgtgaaagtaatatagcattcaaacatgaagattaaggaaggggtaagctcaaaaacaaaaaaagaaggaaaacattcaaggtcattttcaaccattcaatccaaccataccaaactgttccaaattattcaatattttagctatggttctgaattgttggatcagaaaatctgcaacactatattaattgtgtgacagaatcacacatttttcgtatgccactaaatcggggggaggggggggggggggggggggcagcgttaaactacacctgcttcacacgaaaagtaagcaatccaacgaaatgcatctttaagggctaccaaattcggcgtccagctgattgcttcggggcctaccctgattgctaggatggagttaaacaagtgatcaaccccccccgctggtgaatgcccttaccggggg

SEQ ID NO: 75023 - DNA, 1136 bp, Oryza sativa
ggcgcccaacacgggcggcataatagccaagccgtgcaggcgagtacaccagtcggcggcgacgaaggcgagccggtcggtgaagacgtaggcgcccaacaacggcggcataataggccagccgtgcaggcgaggacaccagtcggcggcgacgaaggcgagccggtcggtgaagacgtaggcgcccaacaacggcggcataataggccagccgtgcaggcgaggacaccagtcggcggcggcgaaggcgagccggtcggtgaagacgtaggcgcccaacaatggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcgccgaaggcgagccggtcggtgaagacgtaggcgcccaacaacggcggcataataggccagccgtgcaggcgtggacaccagtcggcggcgacgaaggcgagccggtcggtgaagacgtaggcgcccaacaacggcggcataataggccagctgtgcaggcggaagcaccaatcggcagcggcgaaggcaagccggtcggtgaagacgtagacgcccaacaatggcggcataaaggccagccgtgcaggcggaaacaccaatcggcagcggcgaaggcaagccggtcggtgaagacgtagacgcccaacaacggcggcataaaggccagccgtgcaggcggaaacaccagtcggcggcggcaaaggcgagccggtcggtgaagacgtaggcgcccaacagcggcggcataataggccagccgtgcaggcgaggacaccagtcggcggcgacatatgagtgacatgagttcgtcaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctag

SEQ ID NO: 75024 - DNA, 1198 bp, Oryza sativa
tgtgtctcttatcctgttgtagattaggggtttactggtgagatgtaaggtggaaaaaatatcactattgcagtttatgtgataggatatgcttcattgttgtgtttgggagctaggataacgatactatgcccatgtttgatgtggtgaacccagttatttcatattagtgatgagctcacttgcttgatatatggtatggtattgctcatttagtctgcttagaaagtaaaggtgagaagtcgcagcttcagttgatattaccacttgaacagagcaagatgttatgtaaattatttatttggttatgatatttggaaattcctaaacctcctcgattgctcaagtgaaccgcaatgacagctatttttcaaaaaacattgttcaacaaaaagttccaagtgtaacgtttatgttcttattcctgcttttcgcatctgatacttgccttgcacaaaaagtatgctatacagatttgacatctctcctcatattgttgaagcctgataatcccatgttctgattccctttacgttttctatgatgcaggcttttcataaggtggtccgaagttgggcttcaaagaaattcatgactggatggtaagtctctgaaggatgctgcctaataaatttctgctcgttcttctatgcatctgagtactgtctaccagtgaacagtataattctttctagctaaaagaaagttctatttatgctacagtgtctgtgatggtttatcatacatgacacggttgttgtgggtatgtattatagcatacttaaggaatgtggttacaattcaaaaggtcaaatttatgggttccagaattaataaaatcttccagaattcaaacttctgttctctttgcagaactgagagtaattcaggcaagtgctttggcaagatcactaggttcattgctggttcgtatgatagtgggtgcctatttcttggaatctgggatatagtctttattttttaaaaggaaatcagcttggagaaattggttaaatgccaagatggtcacgtttggttggaagttatgtagagttatagattgatactcgtgtggttgcttgattagtgattgtgtatatattcacatggcaatgacaacgatgaagcacacaattagggtttaacactgttttcttatgctatgataatttcaatgatagtatatgaaattatcttt

SEQ ID NO: 75025 - DNA, 32378 bp, Oryza sativa
  unsure (1)..(32378): unsure at all n locations
taaacacctaaattcccgtgacttgctgagtacgaaagtactcacccttgctctatataaatatatatagttcctctgccttgaagtgaagatgaagtgaagtgaagattagggtttcgtcctggttcccagccgtcgcctgtggtgttgggtgttagttcgttggttccgctgccgctgttgctgttggtgtttcctcgtccgcgtcgtcggttgcattctcgggccgttctaagctgcaacctaagttaaggtaaataagtcctctatttattttaaggattgcaatgattcatatttgtcaccatgggtaccagcactatgtcctgggactggtactgagatcacggtttcgtaggaagcggttcacgtcgtttttcctacgacacgctcctgtcaggtgccgttgtacggcggtgccggattggggtgtgacaagaacactttcggttcaattggatcgataaatttctaagaaagataataatgcccctaaaaccacatgcttcaaactgcatgatgctatagtaaaaatttagaaattatacaactctaaatttaccatcacattatattccatcttagctctagtttcagctcaaaatattttgaccatagaggcatccttgtttttttgaaaaatttctctctccaattgagtcgaaagtgtcatccaacaaattatcaatttttaagtatcttttagccgtgacatgtttttataatgtctactagtaaattgtacattttttaagtgtctgtagcaaattttgccataaaattatgtattgtatcgggacgaaagacatagagagagtagtgtgttagcaagctctgttgctgtctgatttactatgtttttcattttgctttttctgtcacccttagtgattatgtataatttctctggtacttaaaataaaaccagcaacgtttggcttaggtttaaaaatacttgtaaatcaattctaaaaccttaatttagctatgtcttatatgtcaacgagaagctagccaagccaggcaaagcatgtctctctcttttattttttggaatttccatggtagaatttattaagaatccctaatattgaaatatgaatagccgcaagtcccagcgtgtaaaaacagcttagttaggcagcctgaaccagaagaattagtggtgccccgacttaaaacgacgtagaccgccaagaaacgaaccaaccggcaaccgccgccgccgccgccttcgattcgattccgatcgagttggagaaggccgccgctgcccaatggctccgctaccctcgccaccgctgctggccgaatcgctcgcgacgctgcgcacagcctcgccgtcgccgcccatcccctgctctcctcgccgcacccggccgttggtttcagctaggttcgcaagaacggccggccgccggagccggagcacggggggaaggagagaccttaggagctgtgcctatgcggcggaagctgagtacggcagcgcggaggatgaggtcgccgacgacttctactccgttcttggcgtcgtgagtgttctggaacattctgttgaacaattcctttgcaataatttcggtttacagtttattaggttagtagggaagaactgtgcattttagactggaatcattagagatcaatttcttctctgtaaaaaaaaaaatcctacttttggtgagggaggaaagatgcttctttttttcagagtggactcagacaattgttctgaacttctgatgagtgatgagtgatactctgatagtggttttcctttgagacgacggatttgctgctaataatgacccctgatttttgcatctccagatgccagatgcaacccctgaggaaatcaagaaagcatactacagttgcatgaaagcgtgccatcccgacctcagtggggacaaccccgaagtaacaaacttctgcatgttcatcaacgaggtttacacggtaaaacccttcaatgaaaccttgggtccttgtgattgcatatggcaattgtcttggaagatgtgttttgcattgaattcttttttgttcaaaacgctaacatgaggtgttgaagagcaggtgctgagtgatccggtgcagcgtgcagtgtatgatgaaatccatgggtatacagcaaccgcgaccaaccctttcttcgatgacagtgcacccaaggatcaggtgttcgttgatgagtttacctgcataggtactgacattttttggtatgaatagagctataaaagatgctatttggttcttcataaagagatttgatatatttcaccttgttgatgtggatttaggatgcaaatattgtgccaatgtgtgccccaatgtatttagaatcgaggaggattatgggaggtcaagagtatattcccaatcgggtagcacagagctaattcaggaggccattgatagttggtgatgctctgaaacccaacccagcataatactaggactgtttatctgttcataacagattactgaatgtgttattcatgtgtgttatatttccatgtccagcccagtcaactgtattcactggacttctgctgcacagctttctctccttgagaatgaaatgcggagaatagagcgggtgaatgtaagtaatccttctttcagttatttagatgtacggtatatttttgtggtcatataaatctccagttctttggtttgattattaggagtttaggaccttatggttaacttctataacatagatgtaatcacaaaaactcctagttaaaataaacggtgcacaagaaagtttcttatatccctgttcctttctttctgttagcatttttctggaactcaagtgatattttacaggtgatattatcttgttttctcctaatagcctagtagtacactaaagggaatttcaattttgaacaggttgggctgatgagtgctgggatgggagtttcagttgatgtattccgattggtaaatttgtatgtctttattatgtaaatttggcatgtactatctaaatttctctgtttgcatatcctcaagattctttcttccatgtctatgttaaggctaatagagtatagataaagcatacttttgtttaagcatacagattatattatgcataatacttctctatgttgttaattttacttgttcttaagatattttctatttaacaggctagcgtgcgttgggaaaagagacagtcaaaagttttggtatggttccttcccccttcgtcatctttgtgtttctcatagagttagatgtttttaaggatttcgttatcatttacctatttgtatctttgcaaatgggtcattgttttgtaaactaaacattttatgtaaacctttattttgttacaggaaaaaattaggacacggatgacaaacaaaaagtattcagatataagtagttcttggactgatatctggggatccccaactcgataccaaggaaatggtaagctaaaacaaataacacagtttgttagaaataccttgcatggtaaccatgcagaccagcatgtattgtgtaaatataattgttgttaccaaaaatataattattgctcattcttgtatttctgaatccgattgagatttgctgatgatatcagaagaagaaggaacagagagagcgaagagagcagctgctgctgctaggagatggcgagaatactcgagaaaaggcgcagacaggccaccggagtacaaacttccagaggcagcgggcaataaagagtaatagcagaacaaagaaatatttctatcctgcttacgttatctgatagcatttcgtcacctgtacatatagccttattgtttgaagagagctgacatgtagattgctctctcccaattcctcatttttcatttgtaatatatagctgataacaataacctgtagaatacaaacgtcaatagttaaacattcggaatgtaaaagatgaatatgtgcacattctccttcaacaatggtatacatcctgaagatccatcttttcttgtgtgtgtttgtgcagatgaattccggggcaaatttcctttggcagtagtctggtaacccccaggcatcgatgatgaactgcaacatctgccaaaggacaacttgcccagcaatgcagctgcacatctcatggtctcaacctatttctatccgtgtgccacatttagtttcatgtgtagagcgcacagttcactgatcattgtgcagtgatatttatactcgctcctgcatggtgaaaggcagcaannnnnnnnnnnagcacaaggccttttgcagctcctcctgcaaaggcacacggaggctgataggatatactgtaggacaatgcctgctctctagattgtgcccacttacaggaacaaagtctgaaatggagagatcattgtagtgcatatatctccaatctttttaggtcatggggctacttccccgtttattcttagcctagcttcttgctgtccagaccatgtaaagttaagtagcatcaaatatctgctgagaaatctagctcaatctgattttctccactggtttcagactttcagtcacacaggtcatttcatcaccataataatgcagcagtacacaacgcaatttagtagcaagctgatctccagcctccaggaagcctctgcagctaccacccagagctggacatatcaccggtctgtcggacaggctcaaagggcctcgatcgtgtgctacttcagaaaaaaggcaggattttgcagattgattccccttgagaccactggaaaacaaggatcgaatcaaggggaaaaagtgcccgcatgcgagatcaaaagagagaaggaatagggatatccatgagcatgttcgctgccggtttcttggttcctgcgctgaacccgtcccactcccaccgcacgtccgcactgcattgccctatttgcccatgcatgatgcagctcgtcgatcgatcagatccatgcgcctgccaaggttaggcaagcaaaggcgccacgacgcgcgctgtgaaaacccgaactcgataaacgtgtttcgcggggactcgcccgatcggggcactcgatcgagctcacgttttcttttgtgtgtacgtgcagcggcaagataggcggagcagcgcgcggcaagggcgagatcggtgaaaccggtcgtttgctgatgtacacgagttctatctattataatgacactaccattatatatactgttgtgtgaaacgatagaaaagtgaaacccacgtattagtgattgtgattgtaatgataatgttattatggtagaagatcctcgtccttctacaggttactactcgtacgtatcgcgcgcgccccgcgcggggtactcacgtgtttttcaggctcatgcggctgcaatacaaggttgacgcgagcgggagcgttctgcgcgtggcgtacgtaggcgcgcgcgcgagagatcggtggaatcggtcggttgatcgatcgacgggcagcacagcaggctgggcgcggcgtacgtgggggttggcgcaggcggtacgcgtacgtacgtgctgttctcggctttgatcaccctccggcgcgtgtcacggagtgacggacagtaacacacaaacacgggctcgttccaaacgttaaaaatttggttcagtataagacaggacttaggctgcgtttgggagcgcaagttcccaacctgcctcccgacgaaaaaaaacaaagcattcaatcatagtgagattcaattatagtgagattaattaagtattagctaaaaatcttgaaaaataatttaatataactttttaaagcaacttttttgcgaagatatctgatctgaacatgttgaataggccagatttacatgttgagactttatttcccctcctcagaaaattttgtatctatgctactaccttcgtcacagaataattataattctagattgtttagtacatattataaggtttaagaagcgaaatactatgatttttcttactaaatagtgtatagataagagtggaagggtaattaagggtaaaatatggagaaatttaaatgagaagtgattaatgagaccattaatactctgttgcagtaattattttgagacaaattcaaataatagaaatacaattattataggacatccaaagtactataaaagacactagagtggtgatgccaccacaactacttttgtaccttttgtaaactagcataatgccatggcattgcaatggattttttctaaaaaaaaatagttcattctatatatttttgaagtctctaaaataagttattcttatcgtctaatagtacatcatagagcgacgaagaattccataataagagtgtttgattaacatttttttgggggggttgatttgcttgcgtggataggaaaaatgtaaagttttctcctcacttttcacgggcctcatatggtagttagggtggtgatggcatcactagttcaccaccaccaacatctttaaagtagtatagattagtgcgagtctatatactattatagaaaacagtggtggataccaccattatttttgtatttttttataaattagttcatgatattttctaatattatataatagtctcatatttattcatcatatattcaaataagcaaatatgtctatggcatattatatattttattctatacataataaagcatgggtatttagtgtttaaaaaagtatgttcgacaacctctaaatgaaatgccaatttgcacttaggctgtgtttagattcaaaattttttcgtcaaactttcaatttttctgtcacatcaaatgtttggacataagcatggagcattaaatgtggagaaaaaaaaataattgcacagtttgcatgtaaattgcgagacgaatattttgagtctaattacgccataatttgacaatgtggtactacagtaaatatttactaatgatggattaattaggcttaatggattcgtctcgcagtttacaggcggaatctgtaatttgttttgttattagtgtatgtttaatactttaaatgtatgtccatatactttaaaaaattgtggcacaggaacagacgaactaaacacagcgttagccaaatgcatcatgcatgcagcatgcagtgatcgagttcgtccatgttattgaccgggaatcagcacgccggccggcatgaatattgaatgcagaatgcgtgatgcgtcgccgatagtatagtccagacgacgactcgatcgcatgcagaagaagcaaagaaatgcagaccgatctgcagccgaggacgacgacatctctgcgcactatggtaatatgattacaagggaaataaaatgtgatctttgtggcctcaaatctgcattgctgggcaagtctcctttggcagtggcttttgcgtggtttgatcagctcgatcggccactgccaagggagacctgcccagtaatgcatgggccccataaagtcagagacacctcgctggtctttgcctgtatgcatgtatagctagctatatctgcttctccgaggattcgaattctcatcgtatttataggcagcgtgcagagaggccagcatagtcacgcaagcaccgcgaggagatcgaatcggcattattcgtagcacaatatatatgatatatctgaacttctgaagatatttaacggccccgatttttgtgattaaacttttgcgcagctaactgtttcagtttccatttgacgactgctcgttttcgatcttgcgctgggcgatctgcattgtgttggtgtcggctggtgtagttgctcatttcttctctttcttttaatggaaaacagcgcgagagtgccttttcattgaatagagcaggagaaaatacaactcctagggataaaggaaaaaaaaaagagaatcactatagctatatactatacagagtacgcgattaactaacgcaaccgcttaacccctgctaaatctcaaaagctagcctcttctttgattttcgttagaaggaaacacgttgccatctctttgtgatcaaagattagcatatttctctctttccaaatttcccaactaacaggatgagcgatcgaagtccctttttcggggcgttgggcgtatttgcaaggttctccaaccactgttggactgactgggcttcctcccattagttcggctccatctgctgatagcccacccatctagcgacgaggtgccagatcctcttggtgtatctacaagtggcgataaggtgcaacgccgtctcagcctcacagcgtcagtagttgctcatttcaattatcatgttcttgatcacctcttctctcttggatatacctggctaagagcatatgctggctgcaatgctgcagcctgcatgcagaaagcagctggaaggtcggagaaatgtagcagtgctgatttgctgaagcattatgccctcaattggtgttcaagaacaagtaatgcgaactgtttttttccttgtgtaacacgcatattccgtttaacttaaatctgcatccagaagtgcaggtatttctctctttgctaaatgaaaatatcgaagatgttcagagagcatgcgagcttcactttcagacctgatacaatgtccaaaaaatctcaactcctgtttacagaattacagctgaagaatttcaggtcgtgtatccaaacttatgtattgacctcctattaaaaggacttagcaaatttcaccatgaattcaccatcgctgatgaaaaggaacgaatgctagccggtcattgctgaagaggtgccatacctttatgtacggtgtttccttcagagaaaaggccagcaactgcatgctctcgaatagaggaagatccaaatatccaatggaatgtaccctgtagcagtaccatcatctcaattcaaaccatgagaacaatttgagctcgtggctgccgagggccaacgcaaagcttagaatcacaatcactgatctactgaagatcaagaaaggcaggttgcttttagtagtagataggcatgcagatgagcgacagggaggaccattgctggagcacaatattccaaaggaaacctgaaagagagatcaagagatggtgcatcggcaaataaaggttcatggctcggttgttcctctcgaatagtcctcgttctgccaaggagcatatgccatcttagatccatatctcgaggccgatggcgagctatataagcgaggtcaaggcacaaccatgttcttccaagagagcttgcagcaccaaaaaaaaaaaaaaaaggttcttccaagagagcttcaaaattcagaaatgttaaggttcaggatttcagattcagccacagtatgcagtgtgcgaccggcgaattacagggcggtttctcctttggcacgtacggaggcaaggcatgcggtgaaaaatctctagctagccatgcgtgccaaaggagaattgccctgcgattcaccaacacagccatgcagttctcgtcccataatgcaatctcatttcgcaatgcatgttcagaacttcacattagctcgcttttgtcactgaatatgataataatggactgccttgctgcaggtttactcaggatggttctcacagcaggcaatcgctcctgcagttgctctgcatgattagaaataggacaaatagggtttattgatatggttaagagcaagagtcgctggcttcaaatatttcttggagaataattaaaacttgtgacatttcttttctctcttctacatgcatgtcaaaaaaacgatatacagaagaatctactcgcctacagatcgctacagttacatgaaataaattatgcatataagttagctacatgtaaaatctaggggttctcagcgtcaatgtttcatcttggagacttagttgaaatacactttccacaaaaggcaagtcttgatagagcccgtgatcttcgtgtcctcatcttcaatgcagagagctgcagtgaaaatggtcagcatgtgtgagaaaagatcaccgcatacagaggaattatgagaaaacaggattagcatattatcatcaattgatcagcaacaaatgttatatgccatataacatacagcagctgttcttttagtactaaactgagtattgctaaagaatacccttttacaaagtacttttgtttctatttggcatatgtttattagcattacctttcgtctagtagtgcttgaagccttccaacaaagtaaactcgacttaggctccaatctcctgcaaatagatcaataatccaaaatcatacccaagcttcttatataatgtggatgaatcctatttgatagctctattcatgtggaaaatttctaggataaaataagactttgcagctctaaaaatttttcataaactactgaatatgtgcagtgctgtatcaagtgcttgttttagtgcaatattatttttttttaatttgggtatcatctgttcccctccagagtatctgctgaaaaaagtactcctctagtacaagagagtagcatagaactacttacaaattctcttgctctagcttctctgcaatcgacatagctttttgtctagaccaacctccttgttgtgaacaagtttctgccttgttaatgacatgagcaagagataccttgccccttactatgctgttttgtcggccatgctcattattcacaacttctcgtccttgaagaactatgttttcttttctgacaccggcgctgttatttggttcactatgccagtccacttgagaaggtcctacttctataatttcaccttcagtcaatatatgtggatctgattgcacccatcgtgtctgatttgaattagcaccatggaccacgttgtctttttgaagtctcctaattaagttttcacctctggaagaagcggaactatgtctagtgaaagacctccttaatgccacattggaagtgctatcctcaggatacggtgaaatagctggaacatgacctgcccttgcatcatcctttggttcgtaccggatttcaagtgttatagcagaagcaaggacagactcaaatgcatgtagaacttgttcccttgacctctcagctttggatttattcacacgagagctgaacattagttgcacagttggtgctggaggaaaagaactaagtgttagaagcaagatatattggaaaatggaaacagtgtagctattatttcgccaacacaatattcttaaaacaaaacatattacacgttttcaaggaatctggcatgcttagttttttggggggctatgtgtgtcttaataacatcaacaaagttttaaacttgctctcatcaattctagcatgaaaatttagtcaccatgtggagatgcatattattttatttacatgagatattttatggtccttgggaggtatgcggtattgagaaatgagaggtagatatatcttatagtatagaaaacatgtactattacatggcctaggcaccaagattgacgcatattacttgaacaaagcgatttatggtgtttggagggtactagaggtatcaggcacctttacttcaataaatttcaacggttgagatgtttacaggcacacatagcaagccattctatcttattgcttgattacttatgaaacagcatatttatccatcgcattacttaaaacaataataggtcatccttggatgtattctgcaatgaaatttagacatgatataactagtaatatacagagaatgagcaagaaggaatatcttgcctgtgcctaggctgacagaaatcagtcgtgcttctttagccagcatctttctcactgaatctgatcggatatgctctagtacagcctgccaaatcatctcattgtcactttttctgtatctagataaattcactctagtagcacgcgctaataatacatggttgtctggtgtatgttcaccaggtccctttcctctccgggtgcctgccatgttgttgtcagaatcaacccccagattagcatttcttggtaaaccatgaggaccagcatatatgttagtgtgatctatagcagtgctccttcctatgtccccctcagggcaggtaagcaggccctggttaaagcttgcacttgtggatgaactcggcagaacatattgtttatcaggagcaagttgaagcagagcagctgtaagccacgtcatcttatcattagagaccctcaactgtttttcagcttcagagagtgttttcaaggcctggcgtagtttttccatgtcatcttttgatactgtaatccatatattaagatgttagattgtgtggaagaagaatgtttaggtaacatgaatgctactaaaaaaggagagatcagcgatccacgtactactagcccagtcaacaatgtattctttctataaaggaaaggcgtaaataaaatatgtactagtatagccagatctataaaaggataacaatacattggtgagaaaaaaatgctagagcatgacttttacaatacatgactcatggatggatcaacccaactataaatccatctgaagagagtgataaaaagggagtgatattgcttacaggttggacatttgaagaattttcttcgaaccctttcctgcgtgaatgcataggtgccagcaaggatgtcagtaattattgtggcaagctgagacatcagggccaaaggctcaacacctgtttcagtaatatctcttaaagttttcacggtgttcacagtgtcagcagacagtgccaaatcaagcaaatcaaccaatttatcatcagaaaccaagccgacctgtccaaagcaaacaatgtccagttgttattgtcaggtaaatttttaaatgaagtatttttatccaataatataatagcaggttattttattgctactgttagaatttatacaatgtttagtaaacaacatttagaatgcgcacaatgtttagaaagcgaaaattgagtaaaaagactgaacttttccagagtactctttagcccgccttcatggtccaagtgtcaaaattttgcacacgttcaacgctaaacttaagtatgtcaaccaatgctagagtcccaataattaaatcaatagcatgtttcagaattatagaattacaatagcttgaacaaagaatgttttactactatcatttaaattctctctgaaattagaaaccagtagtatactcaataaagaagaaattttgataactattgttggatcacttacaagttcttggacaagcgacattgagattctctgcccaagcaagctcagctgatccaaagtcatctctgcatccctcagtgacccatctgaccgggaagcaataagtttcagggcatctctatcaacatctagtccttcgctagtagaaatccactgtaaagtgttgacaatgtcacactccttcagtttgggaaagaagaacttttggcacctcgacacgattatatgtgggagatcaagattggggctgatgaggataaaaaccacacgccgaggtgcacgttcgatgaccttcgatatgacactccacgtatcaggtggcaatgtgttgcaatcatctactataaacaccctgtgctgagttggtacaggtgaaagcatcacattatcaaggatatccacaatgctgtcaaggtcaatgttaccaacaggcccaatctccactaagctcctactcttgcccagattgtgtgcgatacaagacgcacatgaatcacagggcctcgggtgctcaggagaatggcaattcaacgcctttgcgaacacccgagcgcatgatgtcttgcctgtgccgtgcggcccgtagaacacatacaccaacccaattttcctcttcaggatggcattggagagagcctgcaccaccaagctctgcccaatcatgtccttgaaagtcttgggcgaatacttctgcgtgaggctctggtgccggcctcgatgcgagccccgtgacctctgccccgaccgtgcctctgatgcgaggtcagaatcaagctcactggtctgattcgagaatatcccgagctcccccgagaagctcctggcaatgccaccgatgccattgcgcacgccgtcgacgagcagaggcaacgagtctgagtccgaactggtcgaggtcagcctcgccgtgaccgggaaatgcggatgcgaacgcgagccgtccatgtgaccgcacgagcctgcggaggtggcggcaatggacctccgcgccgccgacgccgacttggggtcggagaggccgcacgagaagctccggccggccatgtcgaggaaggatttgccgcggtggtggatgcgtgaccaattccaggggatgccgcacacattgcgcgagtcctgcgacgcctgcggcctctgcagctccaccccgcactcgtcgtcgtcgtcgtcgtcgcctccgacgacgccgaagaggtacttgttgccgcagacggcctcctgcgagctggagttcaccgagacggcggcggcgccgtccacgccgcgatctagagcgccgccggtggcggacgcgggagcggcgcgccggcccgcgccgcccttgaaccggcgccgcgggccgcgagacggcttgggctgcgggttctccgcgagctggtcgagcagcgtcttgagcgcgccgccggggcgggagctgtcgtcgtggaggtcgtccccgagcccgagcccgaccccctggggctcggcggcgaccctcgacgacgagtccaccgagcggcgggtggacgggtcccgcagcgagcgcgagcgctgcagcgcgagcaggtcccgcatcagcgcggccgacgccgacgcggacgaccccgtcgggctccgcctccgccccgacgacgcgctcccggcgccgagcccgtgcgcgtggtggtgccgcaggtggatgcagttggtcaggtgcgcgtgtccccgcatgtggtgctcgccgctgccgccgccgccgccgccactccccatccccgcggccgctgtcgccgccggcgccggcattgcgggcgatcgatccggactcctcgcctaaatcatcgcgtcgcgtcgcgtcgcgtcgcgtttcgcggcgagcgaggccaaaaggagggtggtgggttggggggcgtggcctcgggtggcgtccccgaagtggccgtgctttcgacgtcgcgtcgcgtccgcgaccgcggcgtggggtggggggagtcgtagggttcgagcctgccgtttggccgttggatgcatctgcagatctgcaccctcacgcccgcgtgtgattactgtgccggttcggtaagtttcggggagctgagaatggccagatgatagtcagtttttaacaatataaaaaaactggattttctagtttctatttttattttattttctaaattttataactatatcttctcataatatgtaccaaaagctaaatttttttggaagaagcttctgatcttgagagaagctgcggtagctagaagattcccaaacaggctcgaatatatttgagagcataagattataagaatatggaaaagctgaagtcctaatttctgatttccaattcattttgtgaattctataactaaagatttttaaaatttgggtgaaaatctagattgtttggcttatgccagctgaatattttaggagaaaatgtagttggcagaaactccccaaaatagacaaaagctcttctagacaatttaaatttctgtttagattctaaaaaattatagatgtaaaatcgtaaaaatgaattgaaagtcagcaactagaaaacacaacttctacagatttttagaaactagctatcagctacttcttgtttcttaaaattttgaactccattgaacaagtctgagaccgtctgtgacacgagattattacccttgtgctaaagttgagtggtctaccgctaacagtggcaaaatggcgctaatagagctgcttgtttatgctttcttttcgaggctatgtattgaggctaaaaaaaggaaaggtgctaaactgctgattgcacgttgtgtcgtgctacattttagtttagataggtaagttgttggtttattaaggtgagctaggatgccattcggtgggagaatctctctacgagactcgacacgctgctgattatcttttggttcagagcttttccttttgttgacttcacgttgcctacttggtctatgctttggcaccgtaccacgaacgtgcatatgaatatgtgatactggccgacagcgtcggtaattacttattactgtacctaacaagttaaccggagtaacgtaccagtaggtaatgttaatgtcaaatcatgagaaattatcgtgccaagtacacgacagagtcatcgacccgtatgagagtagtaccgcggtatagccatggtgggtccgtaatctagcagtagctgcggtactctagctgtgggcctgcatgtgttatctgtttttttttttgttcacagtgatacactagtacatccatccaaaatgtagagtaatatttctaacatattacgttgtctcgaaataaagttatttctccgcctatcttctctcaaccaatcacaactattcttcttcatctactttctcttttcaaccaatcacatattttctccaatcattctcatctacagtattttcttaatacacgtgctaaccatttaagttatcgctatcctatggtttggtgattattgcacgaaaccacgtaattatcgtgatatatatagtaattttaaaaattgaaaatatcatgatagccgcactgttttataaattgtgatggtgacagggattggggaggggtgtacagcccacgcggcagtggcgagcactgggcagcacggcccgggctacgagtagactctacggccccttataatcataggaatgaaaaaaacgaaggaatagcaaaaagattctgacaggaatacaagtgtaaaacagaggattataaaacacagcaaaaacatagaaataaccgtttgattgagccgcagaaaaaacactgaaatttgaggagagataaagactcagaggattcttaacatgaggtaaaacctcatgctaaatttcctccaaaacttacatgggaagaggcattccataggaattttatgggattacataggattcattcttttgattcaaatggctatataggaaaaattcctataggaataaaatcctttaaaattactatgaattttctttgaatcaaacgggcctacgagtgaaattgctaggcccagaaaatactccgttcgatctgatcttcctgcattcttcatcagccagatagcactgtagtttgtgcggatgaattcacgcgaattctgagggtttattttcggtgcacaacaccagcaatccagccaaaaattgaaaacagcatatcacaatacaccgggaaacgtttttgaaagagagggctcctacccccaatgggcgcggaaatcgaggcgaatcattgtgttctctcgtccaactgcagctctcggaacagaacgaaaacgaggagaccgaggagaagatgagtgcatcgtagtacactcgcaccactggaactccttcctgtgctcctggcgcagtagcttcagttcgccgcgagtcaaaatctgaaacctctgatgacaccctcaccagtactgcaaactgacatatgggcccccacagaccctcgggcccatatgtcagcgagcagtacggcagaggatctagattgctgatgaagcgtgtgcctcacccgatcttcaggtaaccagtgtgtatcgttacatggtacaaaagtatgctcaagccctctttgtttagatttataagctaacttataagtcgaatagtctaaacctaaacaaacaagtatctttttcgtttggattttttgaagccataagccactctaacactattaagccaaaagctaggttggataagttttttttggcttatgtgaggtagatgtattacttaaccactaaatttagtacattaaatccactggcttataaatcatataagccaataagctgacttaaaagtctaggccaataagtctaagcctaaacaaagagggcctcaagctgccgggcaatattatcttttttgacgctgacttatttattttctttactctgaatgtactccctccgtttcacaatataagtcattctagcatttcccacattcatattgatattaatgaatctagatatatatatttatctagattcattaacattaatatgaatgtggaaaaagttagaatgacttatattgtgaaacggaggaagtagtatattatcttcagtcttacttcaccttgcaccgtccacacagtaaccctgactgaagcacagatcatacagtacatgatacgtgtagtaccatttttactgtatcagggtccaatatggagtagtcctagactctgatgagaagttgacaaaacatgccctggtgctctggtgagaaattgctacaatactctctctttacatgtgggctgcttcacacacagcacggcagcatgtagccggaatactgcctaaccctatgaggacatagacaaagtagcaatctgtcacaaaattgatcagtgaagctataagccagctaaatactgaggtggagaagagaagagaggagagagagaggagaagtgggctgtaaacttacagctggcttggacataagaaccaagaaactctatgagagagataagtgtgccatgtattaattatgaagagctaactatttgttaggaacctaattgggctgtatatgggccaagctagccaagtcaaagcgaggcccaagcaagcagaagggggcagcatacaaaagcagcagcagcagcattgttggaaggcatcgaacagaatagaacccggcacggcggctcagcaacggcggcgacttggttcgggcttgaaccttatcgatctccttcttcctccctacttctgctagtaacttgtatcccctattcaatcccatttccaccacaaagcttgagttgtagtaatacaattgcagctcaaaaccacctcgaccttcattgcttgtactgtatattggttcattgagatttagatattgggttgctaacaatctggtatcagagccgttcggttcactgggattcttgtcatggaggagtttgggaggcagccatgcaagagggagcaggaattaggttgggaaagttttcatccaagcagcgcccaccatctgttcgatgaaatgtcaagcccattggaggtgtttgaggaagacgttcttcttgtcatgagtgaggagaacatcacatgggatgaagcactccatctgttacaagaggaactgaaggatgcccaatgtagatttgatgagaagctagatcgttttttggaggtgttcggcttgatgggagacaagagcaatcaatctgagggagacaaaaggagcaatgaatttaaggaattcagtgcctccatcaaggagctcacccccaccaccgaggctgctgcatttcaatcaccccaagcatcaccttcttcagcgcccaccaagtgttcgatgatttgctttggcctcgacaccatgtccgacctcaacatggcagcagcggttgtgtgcgccaccacttctctagcctccgtggagttagtggctagagggaacgcaacctgtgaaccctacgtcaacacccctggtcatcccaaggagacgcacaccaagtgttcgatggttggctttgaggtcaagggtggcaccgaccacaccaaggtcacatgccataccatgatgggtgtgcctgatggcgttctagtacctgaagcatcattccatgaagcgtccaagtatccaatcctgtagcccatcacagttggatacgctgtgacagattggcgtgctcacccccgccgatcggaagatttatttataagagcaggtacaataacaagctataagccaactataaatatattttaaagagataaaggaagagagagaagaacagcgagctagagatctgtagccaactgcagcacggactccaaaagcaatgcgtgtatgacaggtgggaccaggtattaatagtatagtaagtaactattgtacaaatttgctattacattggctatagataatttagagttagtagtgtgctatactattaaacttgctctaaacaggccagatccgacaacggcaatctatcagcagcgattccagaggagaaatcatgaacaacgatggtccctgttatggcgtctgcttgcttcatcatttcgtttaggctaataaatcaaaattttaaatttaatttaaaagtttagatcgcacaccgtactgtttgtttgcaccattactgtagcaccgaatctggacaattgatcggaaaagccaaaattatatgcagtcgttaacttgaagttcctaatataactgctgattcgtactcgtagtactttgttcatcctgagtgtctctctctctgtcgttttggctgatatgtctgtctgcactcagccgcttgtcccactcccaagtcccaaccgcataacattgtgcttcaaccttcagatgtgttctctgcatactagaacaatgtaagatgctcattcgtgctgctggactcgttagttcccatcacaagtcacaaccccagcatgttgcagcagtgcaacatcctgtatatgggtttatatatgtaatgaggtcgtacaagtaacaagtgtacaactctagcgcaagcaagttcagagacaatgctgcacagaaaaagcctaattatagagtaactgcagaactacgaaagtaacttaaacttcatttatgttctgagaaatacagtcctgagtcagcgatcaatgaacgatttacatcatttacaggatctgtttttctattcacataacataaatcttcactcaaccatcacggttcacggatcaaatttgttggctcactcaaaacgtacttgggcagttcatacttggcacctgcagcagagttttaaaggttgttattagtcttgcgtgatatagtggagcaaaacagtataggtggtgaagaaacagcgagaattcccaacgaagatctgctcacctctctcgtcataacaaagcgtcatgtcagaatttgaaacaacaatcccagcactgttcactatggtttgtgcaagaggtaattcagcttcagcagcagccctaagtgcatcccaaatctctgtaaagatacaacgagctaccagttatttaactaaggcgatatttgtcagagcacactgttaaaattaagcaattgtgttcaaattttaagccatgctacagttgtaaaataaactccaatgccaatatgaatgatttctacaaactttcttaaattcgaacataacagggcttgttgtattgccaaaccaaataaagattattcagaagagggcatagataaagatggaccttagcaacttagctgcgaaatatgatttaacagtatacaaacattcaattgattttgtttgacatacataatagataaatgtcatagatggaactatggaagagcgttttcccaatcagccttgaaaaatcagctaaatacctttctggcctccatagtgtggagccgtgtcccagaattcttcacgcatctttgagagttgtgttggtgttattgcctgagtgtgcttccaaggttttggctttttgagcttcttactgttctctgcattaaagaagaaggttcaacattacttattcattctaactcatgtcaaagaaatctaataaaaccttgctaggatataaatgcatatcaagcaggattctagttccaggaactgttctgcaataaggccttgttacaacacgacttatttataaacctacattcatctactgtgaatagatgtatcataattttctgaacaaaaaaagcagattcatctttggctcttcactaacttggcctgtatttaaagtagcaataccaggcaatccaactttcgaaagaagtataaccagtgctaaaaaaaattgaagtttcattagcgagcagacaaatatcccaagtgtgaggctgaaatttcacagatgagtgtgtctttctgtaatgttccacctaataaagtatctataactagataaggtgttagaaattgatcttttcgataagcaagacaagatttagcaattggtgaaggcaaagtgcttaatctgaacaaacttttgattattctacttcgagaataatctgtcactttatttctctcatcatagacaaatgctacttttgcaacatacaaacaaaatagcttttctcctttaagaaaatgatataaccaccaatgctcttggcattcagaatactggtagcgttatctctccactaaccaaatgtgacctccatgacgtaggaatttgcactactcactctacttgtatcagataccatccccacatttcgatacattaattccatgagagcactgtcaatcctgcaacataccattactagcagcagatttgatacactacatcacagtaatgagtaatctacaggtgatactaagtttcatccaagtcaacagttctactgcagctggatacttgcaagacgcttaaatcgacagctcaaagtactatcggattatcagttccggtcacaattcgatcaataaacgagaagactaatcaacaatagaacgaacaacctactcctagctaacaacagctctggaaacaattgatctcggatctcagaatctgagcagaaaacaagaacaaagacagacaaacgaatcgaagcatcaaggaagagagagtaagagtaccatcaactttgggagtggatccagcgcagcccatggcgacgacggccgatcgatcagacgctcatgtgggggggacgcccttccagaagcttccggaagcggagccggatctcgcggcgggagaggcggggtgtagtagtgggagacgaggaagaggacggtggatttaataagggttaataaagtggacgagtaggagtaggagacggcaaagcatcagcagcagcagcaaattcagcggcatacgagcggcaaagccagtggaaaaagagaaaaaaaaaaaagaaggcaactgctgctcaggtgacgtcacctacgcaggtgaggtgtcccgccacgtcacctgccgccgcgggcccacgtatcctcccccgcctagacctgttccacgtcgcgacggggcacagatgtcgctgccgagtgggccccacgccggtccacgcacggggatcgcgcctccctccgcttcccgctcttcgtggtcccggttcagtggaccaacggaggctgacatgtgggccctacatcccagccggtccacgtcggttcacagcaccggctcccccttcccgtcccttcccgtcgtggtgccctgcacgcatcctttccgccatttttccgccgcatctggagctctaaaacccaaaccctagccactgcgccccgccgtcgccttcgccgccggcccgccgccgccgcttcagccatgaacgcctttcggttcctcggggacatgacccacctcttctcggtcctcgtcctcctgctcaagatctacgccacgaaatcctgctcaggtgagcccgagccgtacagtgggggtagggtttcggccgcttggttgggggtgggggggattctccgctcacggatctgtgtgttggcgcaggggtgtcgaggaagacgcaggagctgtacatgctggtgttcgtggcgaggtacatggacctgttcacggactacatctcgctctacaactcggtgatgaaggtggttttcatcaccagctcggcggcgatcgtgtggtgcatgcggcgccacccacaggtgcggcgcacgtacgacaaggatcaggacaccttccgccatgtggtgctcgtcgccgctgccttcgtgctcgcattgctcttcaacgagcggttcaccttccgcgaggtgatgtggtctgaccttactttgcttgttcaccgcactgttgaattgatgctgcaatgggacgcccgataaagtggttaattctgctgaacctatgtgcattaagaaatatgatatatctgcttaatatgttttcccatgctacatttcgttgctaggaaccgtaattaaaattcgtgtacaaggctgctagtgctgtgcaatgtaaccttaacaaatttatctcagtatgagccaccctagcaatctgagttcacagtttgcactgacttgaacaagactataggcacaatcatcgttttgttcagtgcagtgaagaattgtggataccctattaataaaatcctacttaagtaaggcaatgcagactgccgacagatgtttgttgatctatatgctatttgctgatgttgtattgttgttagacttcaatagtggtcaaatgccagacaatttctcagacctcattctagttgttttcaaagaacactgctacagtaggagactcatctgaaggtagcatatccatagaatgtaacaaaaggttaggtgaataacacctatacctattgaattaatttagaattttagaaacctatgtattatttgctcagtatacatcatcctgcactaatcaggatttcttccctttgggtaaatagaatctaatcccatttttctgtagtttcaattgtatggtacagattatattcttcgaagtggccactttttttttctagagcacacatacttcttcctcttgtttctactggaaccaattagtcagaatgatgcatagtaaagtagcacattagtaaaacacggtcatgttgcatttacatttgttagtatgatacacaaattaacataatttcaccgttcagatctgctgggcattttcgatttacttggaggcagtggcaattctccctcagttagttttgctgcagagaagtagaaatgtggacaacttgactggacaatatgtattcttcctagggtatgagttttaccacacaagctttttaccataacatatttatacatgattcctgtattacaagagaatgaaacatgtttgcttttcatgcttcaacggcttctgttgcagtctccaagtttatgatggaaacatgaaatatatgcatgcattaactatttagtttttgtttggtccttaggcttgagaatattgaatatgcatgtatttttttttctttatggacatatgacatgtcacatgttccttctgtccatttatattgctggtcataaattttggcacatgaaatgcatcccatctattctttttttgacgtaagaaggtagagctggctctaccttatagccatttccttaatagaaatgaggtagtacaaagttttagtgaaggaaggaaacgaagaagaaacggaggggactttacattagttttggtatttacagatttaaggttctatctgcagtagctgcatcccatctattcttagttctctttcgtcgatcttccatttttcctggttagttctaggcttgattaattaagcctacatttttttaatatacattgtgtccagattcggattagggcatgctttaaatagtgaacgatcgacatgcttctaggttcccagttggtctctttcaagtctcacaatacttgttttgcagggcctaccgtgcattttacatcctaaactggatttaccgttacttcactgagggtcaccacagcagatggatccgtaagcgcctgcccctcgtatgcttgtgtttcatatcccatgttctatatatgaaaagaagttctgacgatctgtttcttccagcttggattgctggtttggtccaaacagctctttatgcggatttcttctactactatttcttaaggtaaactggatactgttgtcaaacctcatttgcagactctctgggtactgacaattccatgtcggttgttgcagttggaagaacaatgtgaagcttgagttgcctgcttgatagttcttcgccacgccagaaaatgtgcacatcacatgagaattatcgagattagttgatgctggcagagacttggtaatgaagtgggcagttgcaatttgtactgttgactatgaaaattgatgatgttcatgtgatggtttcccttggcaaaggctattacgtttcagaagctaacagttgctactgcacagaagtagactagttcctttttggacctcatactgagatggaaaatcacacccaattcatttggcttgttgtttgcagctctattacacttggtgtaaacaaacagtgtgatttccggtgtcttgtaaaaaccaatgcactccaaactactccgaaataccagaaatattgattgtgcttcctggatcctctcaacgctacttcagcatttgcctgtggaacagatcaactgttcaattttagcttttcaatcgtgggagttgtcatgtgatgattaaactactgaattataatctgattgtcggatgatcgtgggtcagtcttctatcaagatttatttcgtctatcttacgacttaacgtcgttcacgtttagcattagtatatacttctacttcgtgctgatcttggagtaaccgcctttgcagcattttagcctgtgtcatcagttttctgaacatgtgtgtcatcagtatcattttactctctttgagatcgccgttattacaaaaataacgccaccttgtaaatgacagaaataggcgaagtgattaatttttatatcatactactaccttgtaaatgacagaaataagggaagagattagtatatggcttttgcgatattagtatatgacttttgcagccctgttgaagtccatgtcatttgcaaattgcaattggtccacgaactcccaagtcccaacatattgccgcaaaacataactaacaaaacgtctctgtcttatcgttcaaacaatttcctcacaagcctataaaacccaaagattgcaatcgtgaatggtcaaatttgtttgttatactttgttttgacacaaccgagttctccccatcctgcaagcaatcgctcgccggctttatctccgtctccaatctccttctacgaccagacgcgaacggcgaaccgcaaccacctctgctgctacgctagccaccaccaccaaccacgatgtgcacgctggagcagcgcggccgcgtgttcgtgctcacgctcaccggcgacggcgagcaccgcctcggccactccctcatcggctccatccgcgccgccgtctcatccgtcgcggcggcggcggcggcggccgggccgggcgcggcgctggtcaccgtggcggaggggcggttcttctccaacggactcgacatcggccctggcgggatccccccctcgcgggtcggggagctcgtcgtggcgctccgccccctcgccgccgatctcctcgcgctccccatgcccaccgtcgccgccgtcacgggccacgcctccgcgggcgggttcctcctcacgctctgccacgactaccgcctcatgcgcgccgaccgcggcgtgctctacatgagcgagatcgacatcggcctcccgctcccgccctacttcgtggccatcctccgcgccaagatcaccgccgcgcacgccctccgcgacgtcaccctccgcggcaggaagctcaaggccgcggaggccaaggagatgggaatcgtcgacgtggtttgccccaccgccgctgaaacggcggccgaggccgtcaagctcgccgagcagttggcggcgcggaagtggaacgggaacgtgtactcgtccattagaatatccatgttccctgaggcttgcaggtccgtcggaattgtcgaggagagcgatgaggagaagaggaatcactttgcttctaagctatgaggatgtgaaaggtatgagtctccaactttccatcccaactccccaattcagctgtattcctgaattgtttgctgaattactgtttatcattgggttaatgtcatggataacactagattgctgaattactgtttatcattgggttaatgtcatggacaacactagatgggaaaaaacggttcagtatgattcctgttggttttgctatgtacaaaacattcacatcaatatataggtttcgctacgtagaaattatggactttagatgtagtaatgcttaagatattgactttcattagatatggtatgcattcaagattaactttttctcaattattaaatatgatttgatttaagcacatttatatgcacacaaaatggatccaacatgtaaaaataaggcactgctagaaggttcattctaggttgagttgggtaatggtttttggtaaatcacagtaaggaggcatctgactgtttcttccctgtctgtctatcgtggtgttaagctcatttttaactgctttgtacatagaatgcgtgtccattagatagtctagaagttttgatatatgctatctcatgagccaattcattggcacagtatcaatttggtactgtggtttgtgacataggaaatcgcaccaaactgttatttctactggaattataatttgattccatattcttatgttattgacttatttcttgcatgggaatacagtgcacaaagatttgtcaagttgtttgtaatttagcacgtctgtttcatattcgtgattatttactgttccatcatttcacatgttgagttgacaatacactttctacctttgtaaactaacttttataatttataacttcctctggtttattgaaaaatggatattatacttagacttcctgatatgaaatctcttccccttagtttttctgatctctgtacaatatgacggtattgcgtggccagaccttaagaaaaggctcctgtattttatagtgggaatttgattaagaatttatcattgtttgtatctcaaaatatatgaacttaaatactactagtattttctctgttcccttttgttctataaagcatgttaccttttccaaacatgttaatttagtgttagtttctcacatatataccttttaccctagtctctctgttaaagtttaaaaggggtgcacttatttcaggattcaaaccttttaagtttagactaacaagtaagctaattatatatatatatatatatatatatatatatatatatatatatatatatatatatatataggtttagcgatacaaaagtgattccaagatttgtttcttaatatacttctatatggtcatgtttatctaattagaaacaatatatagcttcattttgttccatatgaagttacattgtgtcatgtcctgttgtaatgttgagcaagcacctaataaacccacaagtctggcggtttatagttcttgcatcaaccactattcaagcttctgaactcaagatcatttttctcctcctcctttttcagggattctgtggaagtggaccattgagctcttctcaacattatgtgtacattggctagccaagtagccatggatgctttgtatgaaggaccaaataatccagtatatataatttctggaaagcttgtaaactgttgctctatctgcaagtggggaatatattccagttcctttgcaccaccttgagtccttgattaaagaattaatgaaaattctcactgcggaattaccatatgttctccctggaacgttggaacttttggacaatgttccacgtcattgtcaagaatcaagatgacagttgacggcactgtgccaactgccaagccggtgtatcagacttaggccctgtttgggggagtttctagctgcggtagcttttcgcagaatcagaaacttcccccaaatagttcagcttttaatttaaattctgagaagttgtaattgtagaatgcaaaaaatgagctagaagccagaagctgggttagtattagtgcaggtgccgtgcatgacaatggtgtctttagcggcttctgccattgccgttgtggattaccgacaagcttgaggaagtgaagttagagtatcttcaatagcctctccaaacactaatatagctagctctccaatttatttgttaagctaaactcattccttactccaacagcatctccatctatactctctattctgagtctatgacactgggacccacacgtcagcctctactacctccttcctcctcttctcccccatcccctccacaatttcatcgtgagagatacaacctccgcccccacgtccttgggctgctgctcccacaccaccccgtccttcgcctccaccgccgccccgccccttcccatgcgcatcagcagcaccgccagccccaggaacagctcccccgtcctcactgcgagcgacctcctctcggtcccctcgggcggcagcggtggtttcaggtcgtggcccgtggcggcgcgggtgagaatgaagcgacggaagccccgcggctgcgcggtggtgggcacagaggcagaggcggaggagggtggctagggcttgggagggaggccgaaggcggtggaggaggaggagaaggcgaggaaggagggggtcatgggggctcgtcgatggccaccggcaccatcgctgcgccctcggccaacagcgccgttgccacgccatcgccaccaagagaggaaggatgggactgggagtggtggtaggacccacctttggctagtggaggaggctggctacatttggttagccggaggagcaatttggctatctggatggagagtttgctggagctcgttttttctttaacttagagagtcaaatagagagtcggttggagatgctcttactaggctagagaagcagcagctgaatttagcgagctccttggcatgcttgatgaaaaccaggagtctaggacgaaatgccggagctaaggataatccagagtgtaagacactactatattcttatgttaactagtgttaagcatctatatctccgacgtctctttaaaaaccactagtaaaactcaacttataaaatatacacatactactaattcaatatgctaatttaaatatcatatttctctcagtgtgtcttgagcattgtgtataacggtataagtcagtggacactttgctgctagtacaccaatactatgggctaaagttcggcaagcctcttttttttcctttttgttaggccacacactatgcaaaaagttttgtggcaaagtctagatgattttgtcttcaaataaccatatttcccttagagtggttgatggtttttctgcaataacatatgtccgatttgcatataggagtatttgatttgctgtcaggacgcaatatttcgggaaaaaagtattgctcatcacacttaacgaacaactttctctatatgccagtgccttcgtcctataatataacaatctagtatcaaatgtaacacatcttaatagtatgaatatgaatataccttattcagattcatagcattagaatacgtcttgtctcatactccctctgtcccataatacaaaggattttggagtgatgtgacacttcctaatacgactacgaatcttgtctattgtttagattcatagcattagaaagtgtcacgtccctctaaaatcccttatattttgggacggatggagtattatgttgcaatattattagacggcggtagtagtagtatacaacaaccgaatttcttaccgatttgatctttgctcaaaaatctgtacacgcctcatgtaggccctgtttagttccaatggtgaaaatttttggcgtgtcacatcggatatacggatacacatttgaagtattaaacatagtctaataacaaaacaaattacagattctgcatgtaaactgtgacacaaatttattaagcctaattaatctataattagcaaatgtttaatgtagcaccacattgtcaaatcatggcacaattaggcttaaagattcgtctcgcaatttacacgcaatctgtgtaattagttttttgtctatatttaatattctatgcatgtgtccaaacattcgacgtgacaaggtgaaaagtttttgcgttggaactaaacaaggccatagtgatgtgtgaatctaggtgatttgacgattattttagacccaaatcatgcatcatctcgtgataaataccatcacgtaggagtaggggcggattcaacgtgggtgcagggggatttgagtcccccctacacccaccgaacccatgaatacccccctgagcccccttcatttttttcgccatggttgataagattatatagaaggtgctaaagatctcttaaaagcattttagcatagtttaatactaagatgatggtgttttatgccggtatactcggtatgtgagtctccccctttttttcctgatctgcccctgcgtaggagtactgtacacgttgcccccattccattccac

SEQ ID NO: 75026 - DNA, 7843 bp, Oryza sativa
gatccccctagccacctcagcatcaccccgccacgtcggcagggggacggcgccaaagaggctggcgccgtcctgttgaacgacggcgccagccactctggcgcctcaaaaaggaccattttttggataagtttttctaggggtctacttgcgaaataagtttttcaaaaggaccaaaatgtgaaaaatccagggccaagacaggtgccccacctgccaggtctgcttcaagcgcgggcataccgcagcagactgctggtatcgcttcgacgaggactacgtcgcagatgaaaagcttgccgctgctgctactaactcatatggtatagatacaaattggtatattgatacaggtgctacagatcatattaccggtgagctagagaaacttaccaccaaggaaaagtacaacggcggcgagcagattcacacggctagcggagcaggtatggatattagtcacattggtcatactattgtgcatacccctagtcgtaacattcatctaaataatgttctttattttcctcaagctaagaaaaatcttatatctgctagtcagttagccgctgataattctgcttttcttgaacttcactcgaaattcttttccataaaggatctggtaacgaaggacattttgcttgaagggaaatgtaggcatggtctctacctgatccctaactcctttggctgatcaaccagcaaacaagcccttggcaccgtcaagctatccttgtccaggtggcatagccgtctaggacatccgtctcttcctattgttaagaaagttattagcaaaaataatctcccatgcttagttgagtcagtcgatcagtctgtgtgtaatgcttgccaagaagcaaagagtcatcagttaccttatgttagatctactagtgtgtctcaatttccccttgaacttgttttttctgatgtttggggccctgccccagagtctgttgggagaaataaatattatgtgagttttattgatgattttagtgctaaaatataagtctcaagtctttgagaagtttaaagaatttcaggttctagttgaacgaatgtttgatagaaagattattgccatgcagactgattgggggggagaatatcaaaaacttaattcctttttttgcaaaaataggaattgatcatcatgtgtcatgtcctcacactcgtcaactgaatgggtcagctgagagaaaacactggcatattgttgaagtgggtctctctcttttatcttatgcatcaatgcctcttaaattttgggatgaagcctttgttgcagccacttatctcatcaatcgtgtgcctagtagaatcatccaaaattctacacctctagaaaaattgttcaaacaaaaacctgactactcatccttgagagtgtttggttgtgcttgttggcctcatcttcgtccttacaatacacattgtggagattatgggtaccccatacccacacggcatggttatccgactagttataggggataacttatatgtatggaatatgtaacagattatgacttgggtattacgtttccttgtatattacggaacggcctaaagtcctggtttgataagattgtaaagtagagttaggaaaccgataccgtattggataatgtttctatcttgtaatcctgccccccattctatataaggtgggcaggaggccctctagagggcatgagacaacctgatcgtcagatcaatacacactcagcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggctgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgctgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacagctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttcggtgtctacgacttcgccgaccggctggccttcgtcgccgccgactggtgtccccgcctatacggttggtcggtcacaccaccgttcatgggcgtccacgtcttcgccgaccggctggccttcgccgctgccgactggtgtttttgcctatacggttgacggacttcgccgctgttaatgggcttcatcatctacaccactggcttggttccactggcgccgactggcgtttttgtcaccattgatggactgcttcgttcccacatcggctacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgacgaactcatgtcactcatatgtcgccgccgactggtgtcctcgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgtttccgcctgcacggctggcctttatgccgccattgttgggcgtctacgtcttcaccgaccggcttgccttcgccgctaccgattggtgcttccgcctgcacggctgacttattatgctgccgttgttgggcgcctacgtcttcaccgaccggccgccgcatccgccgctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgctgccgactcgtgttcacttcatcacggcgatgcaactttgtcatcatggtggagcgacttcttctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgttttccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaagaacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgtcccgctgactttttaatatagtcatggtgctgtttgggttttaaagcaattgattggttacaatatcgttgctttttgccacgtaagtgtgcatttttattgaccaatattatggcttaggctgattatatattgtggtcatttttcaggcggttggtaaatcctttatgagtttatttactcggattttataccacatatgccgtatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggccttggagtaatctggttcgagagaagattatcttttcgactgtgaaggtctcaggggctactgtggagattatgggtaccccatacccacacggcatggttatccgactagttataggggataacttatatgtatggaatatgtaacagattatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacacacataaactccaattccgttccaaacagtgcgtgttcctaggttttagtactcaccacaaaggatttaaatgtcttgatgtgtcatcaggccatgtctacatcttaagagatgttatctttgatgaaaatatatttcccttttctactcttcactcaaatgcaggagcaagacttaggtctgaaattcttctattgccttcctccatgacaaattataatacgactagtccagggggcacacatgtagttacaccagtggctaatattccattacctagtaataatttaattgtgtctgatgctgatgatgttgtttctggagaaaatggtacaacacatgagcaggaaatggagaataccatgcatggggacgtgcatggcaacatcgtgcatggggaggcggcactggaatcgacgctacaggacagcagcactgtgcctgaccaggacgctgacagcagtggcgcagcctctgctgcagcctctgccgggctgcaggaa

SEQ ID NO: 75027 - DNA, 736 bp, Oryza sativa
tgcacccctcttatttcgtgagttaataaatctttttcccttgatcccataaatcaattctctattccgaaatttcatgaatcattttccttataaatcatttcctttggtcccgcacgtcagagacggtcaataatattcttgagaatattatttctataaatttcatgaatcaatctcccctggttccacaaatatcttccttcgccagaaattccaattaaacttccaaaattcgtatctctcgatccaatcgtccgattgaccccgttccacttccagtatttccataaaatcgagatctatttaatggcactattatttagtctaaatagggtctttttcttggtctcttgtttaggtttttgtttgtttgcgcatagttgcggttaccggattttcgtcgatcgtggatttctcgaagattcgtgaagctcagtgaagaccttgagcaaggcaagccacctttgaacatattgagcctatatttgaacttaattaatttgcttgcaaaatattatgcattgataggattgcacttaatctgtttgccccgtctgcaaggcagaccggtgggcctacccaacttgttgcactgatccttccattgttaattgttatatcatgttcccttgtaaccatctagttgcgcctcgatattcatgcactctgtgcgagtatcgacggtcgccttcaaacttaaaatctgagtaacttcttgggtaaaacttggttt

SEQ ID NO: 75028 - DNA, 7385 bp, Oryza sativa
gtgggctgccctggttgttgtggttgctgccttcggggtgactgccttcaccggtagcagcacttctcctggtcatcaccatctgaaaaccccacacagaaccagcaaacagagagagctgacaattaaaactagccacccacgactaccataattcttgaatttattactgctattaaattggttcattaaagttcaagttgcttaagcaaataaaataaagacaggctccgacacagttataccacacaccggcataaccatgccccacacgactccaacaagaagacaaacgagaaagaacacacgcgcaagcctactaactgctcgtctaccgctgcgacggtccaggacggaaggtgagcaacagcgcatcctccgtgctaccaacgccggaggcttccccctcctgaggaaccacgggcgcgggctcggcacgaggggtctccacgaagcaggtccacgccagggactgacgaacaagctcaggcctggaggtgctcttgcgggcggtgatcttctggctgcggcagacgggcgacgcttggggcgacagacctctccctgggcaatcttgagctgatgcagctgcgcctccactgcgtctaggtccttcttcagctgcagattctcctgacgcagctccaggatcttcatgttgttctcgaccatcccacggcgcaccatatgatggaagtcgatacgagccgcgtcgtacgcctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgttctggcaagcggcggagaaggaatctccacccgcggtgactgccaacgaagtcctctcgggtgagccagtgaggatcactgcagtaacctcccaagcagcgtggggctctgcatcgtcaccctcctgctccgggagctgcctgccctggtagtccactccatgcggataccccaggacaacgcacatgccccgctactccaaaacaaagccagtcaggtccagaccacgacggttgatgctgccggccatctacaaacaaaaacaaaaagaaaagcaacattttaaaggtcagattttgacgataaatgaagcagtaggacagagagagactagaggattttcacaaataagaaaggatttttattttgaaaatattgctaaggcttgggatctacggctcgtcctagggtcaagggggctctgataccaacttgtcacgaccggaaataacccaacgggcgttccttacgtgcgtgcattattccttgtcccaggaggcaaggtacactaaaagttgatacagttcagagtttaacaagcggaagcgtaaatagataatttattacatgggcagcgaaggcccagcacacaaaaagacaaacaggaaacagcggaagactagggcgacgaccacaggcgcttgacggcaggcacgagctagacaccaaggccttcatcttccagaggctcctcttctgggtttgggaaaaattgagcaagactgagtacaaccactgtactcaacaagacacacccacaagtgcaggataaatgcaagggagtacaagggagttataatataaagggttagggtttgcagtaaacagcattaaaagacacttagttgctcaaagctattttgtaaacacgattccagagttataatcaaggccgtgaacccacacgaacctgccttaacccaaggcctacgatgattcaaaccgaactggcaacccgaccctgggtcccagctcgtcccaagccaacccaggccaaccattccacattttagttgtttagcaggttttaagaattaaaacactaacttgggtacattgctcggcttgcccataaccgagggcgcggctattcgaatagattatactctgatcagaggtgtacatctttacccacaagacacattttcctcacgtgtaaccacgtgccacataccaccacggtatacggacggaagacatgacatagtttccaacccatcctagccataaacaagagtaccgacccaaccccacctacggccggaacccccaggacaggtaggcaggactgagcccctagcagcaggacaccggccctgtgccatgacatctcgactaccgggccgcagctcgtgtagccttcatttgccctagagatgtccatcgacccctgacttcgtccatctccatccgtgtacttttgtttataaccagactaagccacaaactaagccttacctactagacatgtggaagtacggtagtgctttgcaacagaggcccgaagaccggtccatatatggccgaggtgctactgtcaaaaccatgcaccccgagcccagcctaaaaccattttgagggttttgaatagagggggaggtgtgaatccaattccacaataatccaaccattccatagtgtccaggtgataagagtattcccaaagtctagagttgtaaaaccacctaatgttgcctaattaaccagcgaagcatctacctaaaatcatactagtggtaccatgagtgtccactagttggggttttgtttcttctagggtgaacaaggaaataataacaataacaataataaggtcataacaaaggtaaataggcatggctagataaaacagtgataacgcgggaatttaataaacagtgataacaaagcgataatgcaataatttaaatcaaaataattttataaactgggattcaatatgttcaaggatgatgtgacttgccttgctcactttcccaaacgtcggcttcaacctccacgaagagtggatcttccgaatctgcaacgtctacacgaccaacggaaaataaaagggcttttactctaataaactccatataacaagcaggaacgaagcacaaaaatgggttcttgacttcttaaggaaaaaaaagagacttgaacggtccaattccgagttcaaatggccaagttatggccatttgaagtttatatgctctttaaatgaatatttgcggatttgttcatttaaattttaatttaaaaagggtttattgcgtcagccgaggggagggggcgcgcggaccgggtccacgggagtggggcccacgcggcagcctcacggtccacggtggaccgggcgcacccgggctcgcaccggccggcgccgtgggccccacgcttcagccgcacccgagggcgcgggcggctgacggccgggccccacgcggcggccactcggcgtgcccgaaggcggccactcggcgcggccggcaggaggcggcgcccgcgcccctatggtcgccggcggcggccataggcacggcggagcggcggccgagagagggaaagggaagggggaaaagaagcggcggtccacggctcaccctaggtcgacggcgatgacggaaaggcagccggagcggaggaaggcggcggcgtggctcgggtcgacggggacgacggtgttccggcggtcggcgagtgaaacggaggggtggacgaggtcgccgaggatgcggcgaagccgaaggaggcggcgccgagggggaaggtggtccggggcgacgacggcggcggaccggagctcggcggcgacggccgagagagagagcgacggcgcgagctcgatttcggcggggagagagagcggcgagtggcggaaacggtggagggaggcacggggagggtttatatagggttgggtgtgagagagggcggccggaggagggggaaacgggcgcgggagacccggccgccattagtggcgccggcgaggttaggggaggagtttcctaacgaatccgagggagagagagagggaaaaatggggggaaagggggaggggatcccggggaataattcccccctattgattgcacgcggggcggacgggggcggcgggattcgcggcggcggcgctagggcgcgggcggggcggcgggagcggcgggaggaaggggatgacgggtgggccccacccgtcatcgagggaggcgggcgggcccgcccgtcggcggcacgcgcgcggggaggatgccgaatgggccgcgggggagaggagagagagggagagagatgggccgagccggcccaagagggggaggggggggggaaaaggacttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgacattgaaaaagttcaaaaagcatccaaacataatttttggatatattggagttttttgggtgcgttcgtagcaaaaacattgacgaacttttgtcaattaatgccaatataggcatatattgagccccgacgggtgcgatgttttttgaccggaatgaaaaagttcaaaaagcacccaaacaaaatttttggacatattggagtgtattgggtgcgttcgtggcaaaaactcacttcgtgattcgcgcggcgaacttttgtcaattaatgtcaatattggcatatattgagcccccacgggtgcgatgttttttgaccggaatgaaaaagttcaaaaagcaccaaacatgatttttggacatattggagtgtattgggtgcgttcgtggcaaaaactcacttcgtgattcgcacgaagaacttttgtcaattagtgccaatattggcatatattgagccctcacgggtgcgatgttttttgaccggaatgaaaaagttcgaaaatcaccaaaagatgaattaaataagtttaaaaagcaccaaaacatgaattttgtacttattggagtgtattgggtgcgttcgtggcaaaaactcactccgtgattcgcacgacgaacttttttcaattaatgccaatattggcatatcttgagcccccacgggtgcgatgttttttgaccggaatgaaaaagttcaaaaagcaccaaaacatgattttttcgacatattggagttttttgggtgcgttcgtaccaataacattgacgaacttatgtcaattagtgccaatattggcatatattgagccctcacaggtgcgatgtttttgaccggaatgaaaaagttcaaaaagcaccaaaacatgatttcttgaacatattggagtgtattgggtgcgttcgtggcaaaaacattgacgaacttttgtcaattaatgccaatattggcatatattgagcccccacgggtgcgatgtttttgactggattcaaaaagttcaaaaagcatccaaacaggatttttggacatattggaatgtattgggtgcgttcgtggtaaaaaatcagttcatgattcacgcggcgaacttttgtcaattaatgccaatattagcataaattggctcacacgggtacgatgtttttgaccggaatgaaaaagttcaaaaagcaccaaaacattatttttggacaaaaactcacttcgcgattcgcgcggcgaacttttctgaattaatgccaatactggcacacgaggccgcgatgtttttgacaggaatgaaaaagttcaaaaagcaccaaaacatgatttctggacatattggagtgtattgggtgcgttcgtggcaaaaactcacttcgtgatttgcgcggggaacttttgtcaattaatatcaatattggcatatattgagcccccacgggtgcgttgttttcgaccggattgaaaaagttcaaaaagcatccaaacatgatttttggacatattggagtgtattgggtgcgttcgtggcaaaaactcacttcgtgattcgtgcggcgaacctttgtcaattagtgccaatattatcatatattggcccacacgggtatgatgtttttgaccggaatgaaaaagtttaaaaagcaccaaaacatgatttttggacttattggagtgtattgggtgcgttcgttgctaaaactcccttcgtgattcgcgcgacgaacttttgtcaattaatgccaatattggcatatgttgagcccccacgggtacgatgtttttgaccggattaaataagtttaaaaagcaccaaaacatgatttttgtacttattggagtgtgctggttgcgttcgtggcaaaaactcactccgtgattcgcacgacgaacttttgtcaattaatgccaatattggcatatcttgggcccccacaggtgcgatgttttttgaccggaatgaaaaagttcaaaaagcaccaaaacatgatttttggacatattggagtgtattgggtgcgttcgtggcaaaaactcacttcgtgattcgcgcggcgaacttttgtcaattaatgtcaatattggcatatattgagcccccacgggtgcgatgtttttgaccggattgaaaaagttcaaaaaacatccaaacatgatttttggacatattggagtgtattgggtgcgttcgtggcaaacactcacttcgtgattcgtgcagcgaacttttctcaattagtgccaatattagcatatattggcccacacgggtacgatgtttttgaccggaatgaaaaagttcaaaaagcaccaaaataagacttttggacatattggagtgtatttggtgcgttcgtggcaaaaactcacttcgtgattcgcacggcgaacttttgtcaattaatgccaattttagcatatcctgagcccccacaggtgcgatattttttgaccggaatgaaaaagttcaaaaatcaccaaaataagatttttggacatattggagtgtattgggtgcgttcgtggcaaaaactcacttcgttattcgcgcagcgaacttttgtcaattaatgccaatattggcatatattgagcccccacgggtgcgatgtttttgaccggattaaaaaagttcaaaaagcaccaaaacatgatttttcgacatatttgagtgttttgggtgcgttcgtggcaaaaactcacttcgtgattcgcgcgatgaacttttgtcaattaatgccaatattggcatatgatgagaccccacgggtgcgatgtttttgaccggaatgaaaaagttcacaaagcatcaaaacacgatttctggacatattggagtgtattgggtgcgttcgtggaaaaaactcacttcgtgattcgcgcggcgaacttttgtcaattaatgccaatattggcatatattgagcccccacgggtgc

SEQ ID NO: 75029 - DNA, 1083 bp, Oryza sativa
ccaacaagttcctcttatttctctgcagctacctgagctcatcaccacaagaaaccggatggcaagctgccggcggcgagcgcccatcgcctcgcccgtccccccgcgccactgcccacggcgcgtccccgcgcaccgccgcccaccgcccgtccgcagccgcgtgcatgggagagagagagagcgcgcgaccgaggagagggagaccgggaaggaagagagatgaaatgtgggcccaagaagtctttttctgactagattgccgcgttggcgccacgtgtacaagctcaagtcaaaaccgctcaaaatagtatcgatgggggtaattcatccggtattaaaagtttagggtgcgttatgtctggtttcgggttcagaaggtaattcagccaaccgtgatagttcagggtaatccatactttttccttgtatttatgtataaacttagtcttgaagtaattttacttttatcataatctggtggtagtagatattgctgcattttgtgagtggtgacatctgcatttgactgcatgttgaacgaattgtgttgttgctgtgcagaatgtgatgtgaagcacgtaggtgcgtgaactgtcaaaggtgtaacttaattcgtcaaatttgattgctgattttgaattgacaatggtagttcgtgtttttctttaaggtgatggaataaatggtttacgtctctgacatataccgacaggcacatatccaataagttttgttgttggaagaaaaaaaaggcaacacagggtgatgccgatttggatcaaataaactacggagttgctagaaatatggcgccatatgctacagtcgattttttttcagccacttacacagtagttacacctcatttacaacccacttacatatgtaattagtatgtaattttcgaatttacatatgtaattttagtacttacatatgtaattttgagacttacattgtaaatacactaaaattacatatgtaatttagggacttacaatgtaaatacataccgactattctttgatgaaaaatatggcgccataaatatagctacacccatcaaacggttctcattgt

SEQ ID NO: 75030 - DNA, 10014 bp, Oryza sativa
tcctgcagcccaccatggcgggaggttaaagttcgcaatgagaactggccaagtgctgtgagaactactcatgtctctgaaaggattcatgccatctgtacacaaacatatcctcatgtttctggggtcggcagcaaagtctttgtgctttcgatcgatattcctccattgaatcgaatccgcagggtgtcttagcaaaccgtcattccttctctctgtggcatgccaacgtactaactttgcttcattggggttggcaaatattctcttgaaacgatcaatgattggtagataccacacaaccttcgccggaccaccccgctttaacttctttccctcgcctgcgctcttctttcgcttgtatcgagaagccttgcagacaggacaagcatctaagtccgcgtattgcttgtggtacaatatgcaatatgtcgtctcgggcaatgtgttctcctaagtaaggaagcatgtccttcagtattcccaaaagttctgtaaaactcgtctgaccatccactactagccttcaacttcattaggtctaatgttgctgataatttggtgtgctttggcttgcatcctgcgtatagaggagtctccgagtcactgaccaacctgctgaacttcatggaatctctctcattcatagctgggtcatcaacgtcacgtaacatgtcttgcagcatatcacggtccacatcaaccatttcaccgcccaatggagatgggacaaacatgtcatgctcttcttcatctccttcttcatgactgtctgcaccacttccgtctgcagctgcaccatcagtacccagatcttgctctccatgcatcacccaacatgtgtatctctccatgaatccccggcgtatcaagtgagcgtgtacttccttttcatcttcccacaaaatctctttcctgcaatcgctacatggacaacacatgtacttgtcgtttcttcttatcctatcctcctctgcggctttcataaaacttaatacgccatctctatactctttgtactgacacctcaagccagtcgtgtacatccaacttcgatccatcactgaacaatgaacaaaatattagttaacatctcataacataagtactactaaattaataggaaatgtttagtactcttttacttacttttatgattttcctgtttttgtttgcaaaaaaattacaaaaattcgcccccttaaacctcccaccaaaatagtgaagagtgggataaactacagacaacggactgctggagtatatatagtgtgcaaagtatatctcaatcgggccaaaaaaaaatgtcatctctaacgggcgcacactaatctctaacgggcataaatagaagcccgacacctataagagtcatcggtgacgggctataggaatatgcatcccgacgagtacatatacaatggcaaaaatttaggcccgattgagatgacttcgttctgacggcccacgttgtccaggcatgtgatgggccgtcacagatgagaggatctgtactagtgatataacaatatgtgtttctaataaatagttttttttcattgttttattcatgatcctacttgcttgagagagaaaggacagtggaaggtcgaactagagggacaatataggctcttgtcaataaattcaataaacccataattaattttgataatccatgcatgtcatatgatatatattccaaaggaaatctcgctttctttgggagagtcccttgaatccatgtgtcgacttacttccaaattagatttgtgacatagacctccaaacgaccacacaacgaaattaatttaataggaccaattcatgattaattctcatgtgcccaagcgtacctgctgccaatcattaagttgaaattcataaatttcttcctagctagtgctgtacatgcatatatgcacatgtagcgacagtaacatgcacgataatatgctatatttagttagcacaggagtgtactttatataaatttgtgctttgctaaaagttgatcaagatgactaattaatcaccagtgtgatgcacatattcgttctagacacatggttagggtagttcattacgtacagtttaaaaaatgtatctcccttattatcatgcaccacatcttaaggcctcgtaagtataaaccatattacaggtgattagtcatttcaaatgggtcggcattcttcatgaaccgttatagatcgatgatttgcatcatctacatgatgggtctatgttccaaaatcattatatagatcgctagtacaaaaatcatttttcaagacagccaaaaccggtttctacatgtagctagacggcccgcctgcacctaggtgtatgtgaaaattaatattgttccatgcgggcagcctaatcacatgaaaaacaggattttcgcatgcggtcacctataccgaccgcgtgaaaaaaaataattttggtggaaaaaaataaaaatcccaaaaaaacaccgaaaccctagcttgtcatcgtcgtcagaactgccactaacgtcgtcaccgccattgccaccgtcgtcatgcctgcttgctcccgcctcctaatcccaccgccgctattcctgaggatggaggctgtcaaatctgcatgccggtgttgctccagagggcaatgacggcggatccgctcgctggcgtcgctcccaccacgagctccctactgctgccgtcgtcaccgtcgcctacctgagtcatggctagtggtcacctggtaactggagccctgctccatgcctcgccgctcccttgctgcgtcctgctcatggggaaccgtcgagtttgctcgccgctccccatggctgtctcgcacccgggacagctggtgctcttgatgctgggctggatttggaggaagtgggagagaggggggggggaaatgagcggggagagaaagaggaggttgtggagaaatgagaggtgagagagagaaggtaggagataaggataaagacttgaaaaattttgaagatgctaagagaaaagagaggagggaggtcagacttttaagaagtccgtttgcgaagttgtacttccgtatgcggtcatttaagaggcctacctgggaaaataagactattttcctaagcaggtctcttaagtggccgcatgccttgaactgatcatgatggagcgatttttgcaggcgggagcagttatggtccacatgcaatctaaaggggatatcatccagaaaaaatcaattctgtagtagtggataaccataatttggttgtatcccagactctagggtacatggctcctcttgatagaagactcggtcgtcttctcagctcctatctttcacccccttatcctctccacctcaatcgagagagtggagaccacacaaaggtgcgatgacacgagggccaggtggttcatccgtccgatgatgcaaggctcgacataaggcccaacaagaagctcgggtcctccacgtagctcgcaatagtgtgagcctctcgacaacatgatgaggggacacaggatgctagagacaccagatccagttgccctaactctgggtaggtgaatctagtgcctcccctccaggcttttggcgacacatctttctcgctctacaaaggacgaccggtgcctccccctccacctcctaagcaccatcaccgccacccccctgtggagctcatgctccctctagatacgatcgcagtagcctcgaggggtgtcagatcttccccaagatcagggtcacctgatctaactacccatgacctcacgacgcctggatctagctaggtggctcaacggcttcccctctttgtgagtaatcctttgtgactgagacgggtatggtgataggcacaaggaggtggagtagcagcatgaagcagtgcgacgacgatgagaaccatctcccatccagatttatccacccaaccaaacacaccctaagttgttgttccctgtacctgagttggatgctcaatggctcagttttttttggaggtggaatgaaatagcgtggtagaaggcacttgaggggtcggtcgtggatgcactgtagccgtttcgcctctccgtggcaatggctacttggacgaggcgggtgacgattgacgacaaccatgacgagcactggtcccgtgcaagttatttaattattatatttgtttttactacattttggctgtgtttagatccaaagtttggatccaaacttcagtcattttccatcacatcaacctgtcatacacacacaacttttcagtcacatcatctttaatttcaaccaaaatccaaactttgcgctgaactaaacacaaccttcgatggttcaatagatatgaacagtcagagatgcgactagtcatcatcagtacgtgatcaattgactgcaacgggtgactgaaccgtcatgttcttgttggactgtaacttacacagatgaccatttctctagtggagtaattggtactagtatcttgcacttgagactgctctaatttcaagtacatattgtgtcgacattcatcttactaattaacatcccttgtggtctgcttccctgtatatcaccccatttttctcgaggtcaattctctgtcattccatgtatgcatatattgccgcagactcaggaggagccagtacacagggtacatgcatgcatgcatgatcattaaattgtaccttatgatatgtccatttcagatggacgtgcagtacttgactgtgttaggttcaacatgaacatttactgtgcatgcatgcagctattagtagcttaatttaattagtggcgggagctgatcaaatgtgtgatgtggaatgccgtcgatacattgccgttgtcggcaacatgccaattcatgcctgcctgcctgcaatgcatccagctaattagctaactggcagtgaagtgcatgaacttgctgactagctagcacaacttaggactatagcctaataaatttagaatggattttaagaacgatatattttagattggtttttagttatcatcttaattagcaacgatcatgaaaagagtttgcgatgaatgcgaccaagaaaatccggccctgtaaattaattataaaatcaaaatttagaatttaattaaaatcagcttcaaattattcttttttgtttgttctttagggtgatatcgatacaatttttaatgcatatatttgattgtttgtattcacatgaagcactaagaaacaacatggaaatatgtttcatgacgtacataataccatattttcactcataaaggttacatgccgacgacgtacgtcgttttgtatgaaaactatgaactaataactcaattgatggagtattccattatcgaaaaaaaaatcaattgatggacattaagaactgattcaatttgatagctttccatgcaccgaaacctaataaacacttaaatacattgtatgccgtcatcgtctcatatatagatggctcatttcgccttcgaattgagaagctagttgccaagaaattaattaacctgtgcgcagtggtgattttgctacgtgttacatggtgcggacactggtggagaaaccatctttcgtcggtcggccgatttccacaatagtcccggatgcaataaaaaccagggttaaagatgatctttagtcccggttcaaaagggtaacgggcatatttgatctttagtcctggttggtaacaccaaccgggactaaagatcatctttagtcccggttcgaatgctgttagggcatgttaggcccccccgggatctttagtcccggtccgggactaaagatcgtaactttagccctagttggtattaccaaccggggctaaagatcctggtgatctttagccccggttggtgctactaaccgggacaaaagtcccacccctatatatatgtcttcttcctcctccagctgcccgagcaagcttcaaaatttcttcaaaaaagaggggaggtcatgccaaaaattctattgaatttattttggtgattacatacaaatcggaggtgcctaaaaggtttgcaacttattcctccaatgttttttttgtcatactacatttgcacctatgtttttcacacttttttttgtctccaaaatttaattgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttaaaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttattgacggcatgcagtattttttgagagtggccgaagcgaacaggcaaaggggttttatttgttgtccatgcaataagtgtaagaatcagaaggagtattctacatccaggattattcatttccacttgtttgagtcggggttcatgccaagctataattgttggacatcccacggagagcaaggtgttgaaatggaagaagatgaagtggaagacgacaatattccggactttgctcagtatgttggatttgaagaaaatcaaacgggcgaggaggaaatagctgctgatggtaacgacgttgcggatgatcttggtcagatgttgcaggacgccagggaggactgcgaaagtgaaaaggaggcccataaattggacaagatgttggaggatcacagaatttcgttgtatccaggctgcgagcaggggcacaaaaagttggataccattctggagttcttgcaatggaaggcaaaaattggggttagtgacaaggcatttggcgatttattgaaactcatcaagaaaattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgacgggcagctaacaaagaagagaattcctgctaaggtgatgtggtatttccctataataccacggctaaggcctttgttcaggaacaaggggaatgctagaatgttgcgatggcacgctgaagagtgtcaacaggacgggatgctgagacaccccgccgatggtttgcagtggcgaaacatcgacagaaaatttaaagaatttggaaaggacgcacgaaacatacggtttggtttgagtacggatggcatgaatccttttggagagatgagcagcggccatagcacttggcctgttacgatgtgtatctacaacctcccccctggctatgcatgaagaggaagtacataatgatgccgattattattcaaggccccaagcaacctggtaacgacatcgatgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcttggaagccagcctatagagagcgaagatggtcacgcggcgatgtggaaaaagaactctatattttgggagttaccatattgggaattcttggacgtacgctcatgactgtcacgtgttgatgacacaactgctaacagctgtaataaggggtatccttccagacaatgtccgggcaacaataacaaagctatgtgcattcatgaacgcaatttcgtagaaggtcatcgatccggatagattagaagcccttcagaatgaagtggtgcaatgtctcgtcagttttgagttgatatttccaccttcatttttcaatataatgacgcatctgctttgtcaccttgtgaaagagatctgtattctcgggcctgtgtacctacacaacatgtttcctttcgagaggtacatgggcgttctgaagaagtatgttcgtaaccatgctcgtccagaggcaagcatcgccaagggttatgaaacagaggaggtcatcgaattttgcgtagaatttatcgaaaaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttgcatcgaggagcacttggctctagttcgcgccaggaacatcggtaagtccgatgcatggattacacggcatcagattgatactttccccacgtggctacgacaacatctcatgggtaacgagtcgatcaaccaacaacttgccttcctggcgaggggaccgtctgggtcaatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggatatatgggaacttgactatggtcctctcaaggttcctctgttccggtgccaatgggttaggttgactggtggaggcgtaatgattgatgacagtggtatgacaactgttgaccttaacaagattggatactcggacgaaccttttgtccttgccaatgatgtaacgcaagtctttttcgtgaaggacatgtctagcaaaggaaagaagggcagagggcctgacgagcctaagcgccaagtggttctcccaggcaaaagaaaaatcatcggagttgaggacaagactgacgaggattacgatcagttggatgggcaaccccctttcacggtgacgattgaccctagcatcctcctatcaaatgaagacaccccttactcatgcagcgatcacaaggagggaacaatagtgaggagaaagtacgtgcggtcaaccgtcaccgccaatgtaatgccgtaattattgtgtacacgatgtaaactattttggatgtattgattatccatataaatcaattgatgtatggcataatttactatcattcatatgctaattagagtttttcacaatttaatttactatctttcatatgctacttatatatgactattcgaatttttaaaaggtttaaatcatgcatgtggcatttacatatgttaattagactttttaacatttaatttaatataattcctacgctaagtatatatgaagattacaatttttattaattttaaatcatgcagtatgtacatacatatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatgcattaacttctattttagaaacacatatgtaagcgaaaataatatgcagtgctataatcttt

SEQ ID NO: 75031 - DNA, 5323 bp, Oryza sativa
tgttttttgaccggaataaaaaagttcaaaagcaccaaaacatgatttttgggcatattggagcgtattgggtgcgttcgaggcaaaaactcacttcgtgaatcgcgcggcgaacttatgtcacttagttccaatattggcatatattgagccctcacgggtgcgatgtttttgaccggaatgaaaaagttcaaaaagaaccaaaacatgattttttgaacatattggagtgtattgggtgcgttcgtagcaaaaacattgacgaacatttgtcaattaatgccaatattggcatatattgagcaccgacgggtgcgatgtttttttgaccggaatgaaaaagttcaaaaagcaccaaaacaagatttttggacatattggagtgtatttggtgcgttcgtggcaaaaactcactttgtgattcgcgcggcgaacttttgtcaattaatgccaatattggcatatattgagccccaacgggtccgatgttttttgaccggaatgaaaaatttcaaaaagcacccaaacatgatttttggacatattggagtgtattgggtgcgttcgtggcaaaaactcacttcgtgattcgcgcggcgaacttttgtcaattaatgccaatattggcatatgttgagcccccacgggtgcgatgtttttgactggaatgaaaaagttcaaaaagaccaaaacatgatttttggacatattggagtgtattgggtgcgttagtagcaaaaactcacttcgtgattcgcacgaagaacttttgtcaattaatgcgaatattggcatatattgaggccccaccggtgcgatgtttttgaccggaatgaaaaagttcaaaaagcaccaaaacatgatttttggacatattggagtgtattgggtgcgttcgtggcaaaaactcacttcgtgattcgcgcggcgaacttttgtcaattaatgccaatattggcatatgttgggcccccacgggtgcgatgttttttgactgaggggaggagtttaggggaggagtttcctaacgaatccaagggagagagagagggaaaaatggggggaaagggagaggggatcatggggaataattccccccactttattgcacgcggggacggcgggaggcggcgggattcgcggcggcggcggcgatagggcgcgggggaggcggcgggagcggcgggaggaaggggatgacgggtgggccccacccgtcagcgagggtggcgggcgggcccgcccatcagcggcgcgcgcgccgggagaggccgagtgggccgcggggagaggagagagagagggggggggagaggagagatgggctgggccggcccaagggagggaagggggacttttagggtttttctttttataaaatcattttaactttgtttatttcttaataattattatttgtgctctgaaaattccactaaaatttatttacgcattttaggcttttaggaaatttacaaaaatcctccaagccttatttgacttttaactttgcacattttaattgttggaggctttcacatggattttaattattctaggcatcatttaagggatatattttagagtcgttttgggacgtgacaattcttctcaaaaacagtcagagatgtcaacgatctgattgagaagaggctcacaaatacaggttggagcaaggaacgactccaaaccagtcaaacgcggtatgcacaccgtcaacgagacggaaatgctcgccgcccaattggatctccttatgaagagaatggacaacaatgagaaggacgccaagaagggtaccgttaaggccttcgacttttcaaatggcatgtgaggtctgtggcaatgacgatcactctgggacggatcgtccgaaaacctgtaaggacgtcatgctcatgaacaacaacaacggatatcgtccacaaggagaccaagtatggagcattgctccatggtctagttcaagaacggaccgaacccacaaggaggttagagtgaaaccccgaaggacggatagtctcaacactttcatgatgaacttcctgtagcgggaagaaacgaggaaccgtcaataccttaagccggcatccaagaagccaggaatataggccggtcaacctgcgttcccagttatgaagaggccgttgcccgcacctaaggcaaagaaggtgtggcagattaaggaaaaaacacctgctcctttacctccggaattgggtgccttatcgaggtaaatgcatcggaggtactgtcgtgcttgtcagacttgaaatgatgtcgcctttgccaacaggtaaatgggtagttatttcatatttattttccattgcatcaaagcatgtttgaatttttcaaacgcagcaaaataaaataaaatttttggcaaaattttgcatggccaccaccacactagtcgttggaacccaatggctaaatgtggggccggttgggtccaccaggggttcggccgaacccctgcatggcactggctggctgcaaatttctttagggtagcggctagtggggcccacatgccattactagccattatccatgcactatataagcagctcggctgggagagggaagtcacaccactctaactcattctcactccctctcaaaaccttcctctcaaaattcattcaaagttttgcaagcttgcctcaaattcacacaatttgctgcatttagtttagacactttacatatacgagtttgctttagttcggtgcaatgttaatcggtgggtatttgtttaacccccgtccgagtagtcttgtattcttgctctttgttgtagctatgaagaaacgacttccgggcatattcaagagacaatcaagctcacggacaagccgacacgaaaagccgagtacaccttcttctgcggatgcatccatggaggaggcgtacgttccaccgaggctgtacgacaactccgatctcgacctcgtgggcgaccgggaaatgcaagcctatcatatgctgaaggaccgaacgtgtgctcagacctaagcatacaactcgaccttttgaaaaggataggtatggatgctgagtttcatactgtttgacgtgctgttggatgggataaatttgcatgtgtagatgagctgggttcctgtttgcttaccatgcagtttctatgtaccttgctagaggtaggcgatggtgtactttctggttattccgcaaggaatatcacctttctcggaaagaccttagcttgcatctaggctttgacaaaacatgcaaagttaatttcaggaacgcatttcttggtttttaacaagcgtatgttttggcaaagtatttcaggtttctcatcctctaaaaagcctagaactagtgacatccatcatcctaccttggggctgttgcataagttgcttggtttcatgttgtttcttagagctgatatccagatagtttgtgaagacgaactagtcctcttgtatgccatggttaaaaaaaaaatcaaagtttcacctgttcaacccatgatcaagcaatggttagaaaatatgaagttgtctggtccttttgagtgtatttctttggtgactcgttcagcatgaagagttgggactatgctttataagcaagtattcctatcacccgctcttatgttgatgaggcctatttagttcaatgccacatactcaaacatggtccaaatgattatcttatatttttgtttcccggctatacaaataagattcctttacctaacccggagtttcatttgtgtaattgccgagaactaaccattccactccaattggagttgcatcgtgatgtcccacgcagggtaacatgacgaatgtacagagaagcacctcaggaggcgtcttcctcttcaccaccagtgtaaatgtatggggactattgggacgctggtggttcgtcctggcagagtgccagcgacggccgatggcatgagccgtaggagctgcactggggatactcgcgctcctccaattcaagtggtccaccttcatcctcttggatgtgtcgctgtctcctctcgaggggatctgggagaactcacccggaggatggatacacttgaactgtaggcagggaacgaacaacacaccttggaggataatgtggtacagtcacgggaatggcaacagtctgttgatgcacaggttgcaaacttcaacactatgatgcaacaatagcaagctgactggcaagcgtttcaccgctaccagggatttgatccccgccatgagccatagcaagaagcaagcttgggggggagatgtctctccccccactaaggtaacttgtatcatattgcatatttccctttcaaattacatgtttaaatttttgcattgcatttataaacctgaaaacaacataaaaatttgcaaaactaaaaataccaaaaagataggttagatttaatatgctaggtaagacatgcttagttcttcatgttgaaatgatgaatagttgctctgttttatatctctcatatatgggttcatggttaagtactctctcaaaatttgaataagggtagcctacaattatccaggaacctgaggtaagtgagctgcactttgctgatctgagtctaggttgttgcgagatatgagatagtaaataagagttgctataaataatcatgttctaagtttgacttgaattccggatgttttatttttcaaaatgataattttgaaagttcctcatttgatatgaattcctaccagagccaaaatattcatattgattaagccatatacattttggttacttgtaattccattaaattttgtcaaatccttgtgacttgtgtagatacttttcatgctctatgtgatcattgatggaggtagctgcaacaacttggtgagttttgatttggtcaagaagcttggcttgactacacgtacacatccacacccttaccatattcagtggttaaacgattccggaggagcaaaggtaacacaggtttgtagggtttcgttttccattggctcatatgcagattctgttgattgcgatgtggttcctatgcaagcttgttcacttttgctggcccgtccttgggaacatgataatgatgctacacaccatggtaggagtaataaatacagttttgtgcataatgggaagaaaattactttgctacctttgacccctgctgaaattgtagaagctgataaagagcgagctgctagtttgaaacttgatgaatctgaaaatcagcaagtggctaaatctgtttttccaactaaaaaggataagctttcacctagttctaaggttgagggaattaagttgaagggtggtg

SEQ ID NO: 75032 - DNA, 865 bp, Oryza sativa
caaatgaagttgcaagcccataggcccattataggtgatgcaacaccttgttcctgtgattctgaccactcgtgatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttgttgttcatccatgatgtgagcaatggttgcatccgtggtagccatggtcgcacccgtgggggctcaatatatgccaatattggcataaattgataaaagttcttcgtgcgaatcacgaagtgagtttttgccacgaacacacccaatacactgcaatatgtccaaaaatcatgttttggtgatttttgaactttttcaatccggtcaaaaacatcgcacccgtgggggcctatatatgctaaatattggcacttattgacaaaagttcgtcgcgcgaatcacgaagtgagtttttgccacgaacgcacccaatacactccaatatgtccaaaaatcatgtttggatgctttttgaacttaatcaatccggtcaaaaacatcgcacccgtgggggccaatttgtgctaaaattgacactaattgacaaaagttcgctgtacgaatcacgaagtgagtttttaacacgaacgcacccaatacactccaatatatcaaaaatcaagtttgatgccttttgaacttttttattctggtcaacaacatcgcatcagtgggggctcaatatatgccaatattggcataaattgacaaaagttcttcgtgcgaatcacgaa

SEQ ID NO: 75033 - DNA, 26302 bp, Oryza sativa
  unsure (1)..(26302): unsure at all n locations
gacgccgcgccacgcctacgccacgccacgcagccgctggcacgccacgccacctacttcgccgccgcgcgcgcaacgccaccgccgccacgccatgccgccatcttcgccgccgcgcaatgccgccgccgcatgcaacaccgcgctgccaccgccgttgccaagccgccaccgccgccgccgccgccgtcaccaccacgccgccatgccaagcgccggcccgatgccgtcacaccgccgttaacgaacacatgaacgagaacgaacacgtcaacgtacgttgccgcgagaacgtgaacgagaacgagaacgatcgaacgaacgagagcgacaacgagaacgatcgaacgaattaacgtgaacgagaatgacaacgaacgtgaacgagaacgaacgtgaatgagaacgagcgaacgaacgtgaatgtgaaatgcaatatatatatgttactttgcatttatcctaatacatattttttgtatcttgcagaaaagacgtgttgtcggagtcgtccctcaagctggagtggaagagctagccctagaaggaattcgtgcaggcaagtgacgtaataatataaatgattgttatatttgtaatgcaattaagaatattagacttgtaattatacttagcatataagattgtgtagtgttctaatattatttgagttttaatataagattattttattgcaaattagacttagtatgtaatttttgactacggaattggtgcgactcctagcaattgactattgtagtcttaattagacttagcatatacgcatgaaacacttagcatacatgactattttagtcttagcatgtaatattatttgagttttaatataagattattttatttgtaattagacttagtatataattattgactacggaattggtgcgactcctagcaatttacaattttagtcttaattagacttagcatatacgacagttacacttagtatacatgactctttcagtcttagcatgtaatattatttgagttttaatataagattactttatttgtaattagaattagtatgtaattattgagtacggaattggtgcgactcctagcaattgactattgtagtcttaattagacttagcatatacgcacggaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttaaattgttaaaacataaatgtctcgtgacttaccagatgtttctagtatcaacagatggctgaccgcgatgaggaacagatattatacaatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctctgttggacagaagagggcacgcgggcaacgaggtgcagcgaagaagcttgagggtcggcacatcataacggaagtggaagaagatggacgtcctagtgccccggccgaagccacgaagaactatgtacgtcacagcggttgggttgtgcgggataacgtgcctgtcagtacggtgtactggcgaagaccannngcatgtggagatcatgagagctttgtcccagattggagaaagagatgctgtggaccacaatgctcgagacattcacccttcccgcgggtacagaggacaaagtgataaggtggactctgaagaaaatggcagaacagtttcagagcttcaagggagagctgtacaagaaatatatcctgaaggggcagacaccgaactttgacacattcccaaagctaaggggatcactgggacgagttcgttgcatataagacaggtgaacaagggtaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaacaggcaaccgccaattggccggaacgatcgaagttctggtactatgctcacggtggaacgctcaacccagctgatggctcactggtcttcggtgatcagatacgagaggctgcacgacgactaacagatgcagtggaagcctcctctcagggcacgttccgaccggacagagatagggacgagctgacactcgccctgcagactccagagcattcaggacgaacacgagggaaaggggtgattccttggaagattggtttcaaggaggacatccacacgtacaggagtcggatgaggagtaagagagataccgaggcgaagattgcagatctagagttccgggtatcgagctacgaactcagcatgcaagaggagggggcaaggaaggttgatgaacgcatggccgcacatcggtcccatgatccccagccgaccattcctcctgcaatggtgagcccgttaggaaaccgtagcagctgcgcctcaacggggcaggtaagatcacagagcatggacgccatgcaaacacaggacgaatcgacctgtctcgttgatgacatcactcagcggacaccatgtgagctgcatattccttacaagaacttatcaataaaggtaagctcgtagtttatatattttagatttagccattccgctagttgctgcttatatatgttgattactaataaataatctctcacaacatgaaggtggcgtcgggcatggccatcctaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctctggctccgccatctcctcctcaggatcctgcaccgtctcctcctcatgatctgccagcaccgactcctcctcaggatcctgcaccgactcctcctcgggcctctacacctactcctccgcaagctcctcttccggcaccttcaaagtcaagggcccccccagctccaccgcctgcccacacaagggaaaccaagaaggcgaaagttgacgccgccaagaacaaggacccggggtacgattgcacgcaagaggagcttgacgcttacgttgcatcagaagtcaagagacaattcaagcctcgaagtccagaaaagaagattcttatagaccccagtgtcaggaacttctttaggggtatgtctgcatctgtcaaggaggccatcaatctatcggactatgagcgaacgctgaagaaagcatcttctggaaagtccaaaccagtccctcagcttggagagcaaccaaaccaggagatcgagccgttggtgactggtaaagaaatgacgatagaacaatttattactgacaccggtctaactacggatcaattgctaggagtcgcaccaatcgaaaaggcggaagagaaatacatgtatgaactcggtaaaccgcttgtcaagcttgagctgctgcagtccctacccacacaaatgtacaagttccatcagctgtacatggagatgagcgccaccggtagagagatgatcggagcgaggatcagggacacggagttcttgcaaggagatgacattctctggatcaatttcaagggaatctatgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggtggagggtttttgatactggattcatcgacactcggagagtaaacgtcgcaatgctcgaccaatatccacaagaaacaaaggacaatctcgtccatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattacagattccactgggtgcttttactcttcgacctgtcggcctgcaccgtcaacgtatatgactcaatgaataaaaaagagtctacgtttgacaaggttttcgaacctatagacaggtaccgtcataagttcctctgttaattaagaaaatcttgttatgttaattgctactacaaatcatagctttaaactccatgtagggcttggtatcggttccgtcatttggtccacggcaaatggagagaaagacttaggcggaagttcaaatttcctgtgagtacacatgctctacatttatatttctccgattcaaatacatacaagtgtatattaattagatctctcgttgtttggcatttatttgtagtgcgcaaagcaaaagcagggaactaacttgtgcggctattacgtgtgtgagtattgccactgccttgcagaccaaatcaacaccacaagagagctcgatgtaagtacaaataaattcaaaattttattacgtaacgatttcttgtttaattactaatcaatttcatacattcatatagtttattcgcacgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggtcatatatatatatatatatatatacacacatatgcatttgcataacatatatattatgtataaatacatatatattatgcatgtacatatgtactgaactatttatacatatatatatatatatataatatatatatatgtatgcatatatatgtattgaaacatatatatgcatggtttatatatatatatatatatataaaccatgcagcaatagggccatgcaaaaaaaaagggtcagctcgatctttagtagatggctcagccggccacgtggttgagccatctttagtcccggttagtgttaccaaccgggactaaagatcgatctttagtcccggttatttcacccgggactaaagatagcgatctatagtcccggattggtactcccggtttggaaaccgggactaaagggggttacaaaccgggactacaaagggtttttccaccagtgggactcaggattttaaggtagtgtatttaaattttgaagtagtaaatttttcaatagcctatttttcaggcttgattgaatatggcctctttttcgtttatatatatatatatatatatatatatatatatatatatatatatatatatatatatatatatatatagacacacacacaatacaattagaaaatgtatgagccgttcagcaacacagttcctgcaagaagcattttaaccaaattatgcatctaggcgcgcgattgagcaaaaagatctttcaatttgtgaaaagattggctttgcttaattaacataaccagataatagagatgccaactaactctgcttgggtgaaacagggatgagatcagatgcattaatttgcagaagctggaatcggaagtggtgaaacagagatatctggagcaggacaagaattgctatagctctccagctgatactcctgatatagttgttgcagacttgaaggaaaaacaaaaaagcatgtggacacgtattattattggaagttttactcactccaaaatttgttacttcctccatcctaaaatataaagatttctaaagttaatacgggtacttaaaaaataggtgaaattaaatgtgtatgaatgttgtgattggtggatatcagaaaatatgtgtggaatttgaatggtggaagattgtttaaaaagaatataggtggagaagttgttatttttgtataaattttgagtactagatattgttatattttgagacggagggagtatattacttggtagaagtagatagatttctttaatttgtttctccattgattatcattaatatgtgtgtaggaatttcaaataaattaaacatgtgcaatactcttttaatttggcagtcatgcaaaaggaacaagagggaataatgctgactatagatatgcattgatcatcgctgaatgttcagctatctctacgtcttgttgatcatgaccgtttttgtctggtcaagcatccatgtgagtatacgatcgagcatatatacatgtgccattctaagcccatgcatgggcatatgcattattcagtactatcgtaccagagatcacctaacaaatgagctatagtaatgtacataatatatacatgaacatatatagcagagacagctcttcttttgatacctctctcgacaatttctgtagtacgtcctccctctctttcaggttattacaagatgactttagtcaaactcaaactatttcaagtttaaccaagtctataaaaaaatagtaatatttttgacctaagataaatttagtataaaaatatatttaattattaatttaataaaactaatttggtaatgtaaatattactatatttgtctctaaacttagtcaaatttaaagcagtttgattttaaccaaagttaaaacatcttataacctgaaacggatgaaaacggatgaagtagttttcattatggctataaatatatatatgcgttaattaagaaaacaatttcggtagtacgtagtcttacatgaccacgactaaaccaccatagatatatgcttccattttgacagaattgaaccaactgtcctgattcctgtatatatatgttaaccgaaccatttactgtgaacttaatttcggtgaaattaattatcggcatgtactactactaaagctaactaggccaaaacaaaattatttccattaatttcaaatcagatgacctgtcttatgtacatatttatgaaattcggcgtccataattatcatctcaggtatgccataggagatttgaccaaatcaatgcaaaattattgatgatcttgggtcaggaacaagtgcaatgcatatacatggccccctactgaggctcttgccgttagacaaccggccatgttcttcaatgtatgtgtcttgtgtggtatgtattggtggaccacacccatagaagctaaaccttatctgctttgctgcgataagcatactacaccaacaaatcctcctcggcagcgataatccagtgaataagctaaaaagaacggggtaaattgcatttttagaaagctgattttctttaaaacacgtgatgcatgcacactcacccatatgaatgcagacacacacggcagcaataatccaatgaataagataaaaagaatggggtaagttgcattttagaaagctaatcttattttttacaaacacagtataaacgcaagcgcccacgacgcatgcacactcacccatatgaatgtagacacgtaaatcctattcctatgagcgcctccgaaagattataccagtatattttgagattgacgaagtcaccatggatgcctcgctgtcgaggtgtacatcgtctatgactgaaagaataattagccataaatacgagtacccgtgtaaaatctagtatttgaacccgggtgaactggttccacaataagaaatctaaccagtttagctacgcttatgtcgcttagaaaactaatatgatgagtgggcttaagaatatgtagcagccacatcactgaaaaccacccacttaaccacaaccagctctatgctacatatagactcccttttcacctataatataataaattatactcttcaaatttatctcataatataagagtttttgtaattccaatacaatacttaacctacgagttttctggtttattgtacccatcacttttttactagtttatccttcctacccattactttcttactggtttatccttccacctacaagttttctactactttatttcaccaccataacctttactatgccccgtccttttgctttttttaacttttaaaataaaatataatcccttatattatagcaaggagggagtagatgattttaatagattagagaacacattaattatatatccaacactagagttgcagaaagaaaaataaaccacgtgagaaccatttgtgaaccaaatatagacattttcttgtatttaccagggaagtatatgtaaatatattgccaatgttttattaaagcatgcgcttaattttgtcacctagttagtagtatattgatatatgctcaattttttttttagagaaacacagcagggagcccctgctgtttgtattgtaataaaaaaagacagaatatttaaaagaagcagaacaatataaatatatggggtgaagataaagggagtgagaggagaaggggttacagggtgttctctcaatttcaaaaaatttcaacatagccttcagttacaattcgaaagccaatatttgatttactgtagtacatgatatgagtttatgaattagctaatcatgaaagtatcggagtacagtacacccaagatagtccatacaaattttatttgctgttcacacacaaagaatatttgaaataaaatgattacaaggtagctagagtactcataagtttctgttgtccttattaatcctaatcaacagagccacatggcttgtcctagccatgtaatatgacagccatcagccatgtgcctcccatcatctggtcttttgtcacctattgcaatgtgatcttgtgctgaattcttcatgatttagtttggatctgtttatggggttgatagatggtctcagctagctagttagttatgtatagtcagttatatgtctgtcactggatgggaagacattctatatataagaccagctggctaattagtgtgtactctaccatgtgtgcgttgccacgtgtcctcggcattcagaagttgcatgtgctggatagatatggtgggatatgcagagtcaactgaagaatgctagccattgtcatggttaaagttcagtaaattaaataaatccacaattcttttggcgccctaaaagttttgtagaaagctttaaaagttttgtagatagattcaattgtacatctggcctcctttgaaacgctacaaatttctcaaacttatgagaaataaaaattggtactgatgaacatcctactcccgcactccaaagcagtctacagatcactacttcaaataaacgagttttctatacaatgacctctttagattgcatatggatcataactggtcgcgtctgcaaaaatcatcctctatttttgtgtgcggtttcttaagaggaccgcacagaataatcgatttccgcgtgcggacctcttaagttcaccacacgcacaaatgagcctatttttgcaggcgaacctcttaagtaggccacacgcaaaaatacccctctctctcttttccctctcactcgcttcaaaattttcacctcctctctcttcctttccttttattttcactcctctctctctttctctcctctcttcgtgtgctctcctctcctctcctccgatcgagcgcggggggggagggtgggaggtggccggctcggtgccactgcctctggagcaggcatggcggcgggctcgagagcatctcagcagacggcatgcgcgcggtggcaggcgcgcgacggtggccgcatgtggaaggtgatggtgaccggtcccaacctggatccggtggagacggaggcccccgcccggatttggcggcgcgggccgtcctccgccaggattagcgtggatccggcggcagggacggccggcgcggcggtggcggctgacgggcaggctcgcgcgcgggctggcgcggtggccggcgtgctgtggggaggtgtggcggtgccggccaatccggcgacagcgacgacgagggcgtcggtgtcggcttctaaggttagggtttcgtattttttggatttaatttttttcggttttttaattttgcgtgcagggtgcgccacccgcacgccaaaatagtgattttcgctgaccttttgctgcatgcgggttgccatgccgcacgcaaaaacctctttcggaccgcacggtaaatggtttttagtactgcacggcacgaactatttcatttaaaaattttaaacatttttcctttttttagaaaattagaaaaaaaaaactttcaaatttcagctcccgggtaaattaatttgtgcgtgccaacatagcatggtaattgtaacattgattggtagactgagtgatctagctcaataatacatataaatatatattttctaacaaatgcacgatgtaaaataactatcattattctcgacaaaggttattacttgactaggcaaaatgattttgatataaatttcttgctctgagaattcgccttcctgtaagggctattagctagcgatatggttttgcagtaccatgtgcaaataactcagtgcgggaaacaacaatacttctgatccctccattttactagattagttgtcgttctagctttatcataaatcaaacatttctatattacgccgtcaaattttaaaattttatgtagtttaacattccgtcaattagatattatgaaattatttctgaaattaaactacataaatttctaaaaattgaagatcggagatacaaagatctgacatagaacaaatctagaacattgagtaatttagaacagacggagtatcttaagaaaatgtgtcaacccttctgtacatgcggagtaagggatcctctgattcaaaggattggtatagggttttttaggattcacaatcctacggattttttttcatatgtatgcctttgattcgtaggaaatgaaagaaaacattccttagggttatatcccttacatgaaaataaggaagaggtctgtcgttcgcgccgttttcatgtgtttggcggtaaactgtgtgcccctttgcgcttcttgtgggaaaaaaaacagagggagatggaatgagaacaccaggggtcacatattagtatccaacaaaccaacagtgatagagatataaagtagtgtgagccgactgccggcggcgcaaggcagcaaaaccgccaattagcggtcagtcatgcgccctcccgcctacacggcacagccatgcggcacgcgcggagaggggggagggggggttgcgttgaaggcaacacgtgtcagttttctctagtttcttcgttgttttttctgattattttttagtttttctcgttttttctttttgtttgtttttctaatatgtatacataaatatacaaagtttatatacatgactttttttaaaaaaaattgtacgtataaattttgtatatacgtgtatatatcttgtatacatcaaatgagtatatgcataaaaaaatatatactttacatatatatactttacctatatatatatatacacacacacactttataagtttatacatacatatatacgtatagagatgagagagaggagaggctagagggggtcgaactgacgcgcatcctcacgcggctagttgcccatcagctgcccccgcaaggtggaggcgaggcttgccggctcaaagcttgggtaccttttatcttttcatgtgtttttattcccgcaggatgaaagaatcaaactacttcaggttctgttctttttctatcctacgaattaaagagacctaaagtattatccctccataccaaaagttcaaaaatcttacccccaaaagaagccaaaagtaataaagttgtattaacataacaaaacccgtcctcgatcgatcgattgaacggatggtggcagacgtacgacaaaattccggcaagacgagcagccgatccactgcgatcgatcgatcgatcgcccattggtcccggccggtcggttcatcaactactactgttgccgctcgctctgtgcatatgccctaccatgttctcttcctccacgtaacggcgccatgtctctgctagcttagcttgcgttgcctccatgtggattcaaatcattcagtacgcccaacgacaatccggaatcctcacgtcgcatctcatctctcatctttctttttctagctagcaagcagtagtaccatgtcccattgttttctttcttttttttttgaatgctatttcgttccctctcttgccggcagtagcttccaaatggaattcgaattaaagccaatccgttaacgatggcagatgcgtaatatcgttcgtgacccaagggcaaacaatctccgtctccctctataaatagccgcttgcaacacatcgccatggctcccccacacctcactagctcgaccaagccgatcccctctctcgatcactctcaactaattctctcaacctcagctgatcatcggagatggttcaccgggcggcggcggacggcgcgcggcggcggctgcggcggcagctgtcaatgccgggatcagggaggccgcagcagcagacgaaggaggcgtcggcagcgctggtgcggctgccgtgcaacaaggggaaggcgtcgcggttcaagcggagctgcttcagcgaggaggacgacgccgcgtccgtcgcgtgcgtcgtctgcgcgccgtccctccctctcattaattagttaattagtcatcactctctctctctctctctatgatctagttgattaattaatcagtcagtgaatcacacttggaggctactgtactcgctagtttgatcctcgcagctggtaatcttgtagtggcattaattaatgtgcgtgtgtgtttgtgtatgtgttgcggtaattaaatggtgatatatataattcgtcctgtccgtcgaatcctcgcccttttctatatttgacgttggtcagtcatgcaaggagtattattttgtcttcactagttaactttctccgtgacaaaaaattctcaaccaagaaagggataagacttctctggtaagatttgttatactatgagaggtcacattcttttttagattgattttttttttgactgagagggtatataaaaatgtacatgatggtgttaacttgaagcaagaggcaaatatggttttccattcaaaggaatatcatcccaagctaagtgcaagctagccagcgcagtacactggcgagtgggccatcctacgccggaattgagccggagtttggttgcctggaccgagataggcaagaaacaggattgccctggtttaggactttggcccaattagaggagaaaatgaataagacaatttttttttgtggaattcgcaatattcgaaatctctatctctactgttataaaaattaaagatatttttaccggtactttggtacgtcatccgtgtatgagtcggtttttaagttcgttcgcttttgaaaatacatgtccatatttgagtcagtttttaaattcgttcgtttttgaaaatacagaaggagtcgtataagaaatctctttaaaaaaactcgtatgcttatttgtaacgatcagactcctaaccacagctcatgatttaaaaaaaatacatcaaagcgaattgccacaatgaatttcaccttagttaaaccatttaacaataataaaattaaaatagccttcacccgttgcaacgcacgtgcattttttctagtagaaataaaatatttgtgaaatgtgtcaggtttaaacttccatgaaaaattatatttgttttgcagaaaatagaaggaactcttcataaataatgttagcatttcacaaacttaaatttatactatgatacagtggagccgacctaggattttgaggttgcccttcgacaactagatcgcaaaaccgattcaaaatccatagccgtattttttttacaactgaaagtctaatacttggcatgtgcaaattgccaaagtagatcatcaaacttgtgcggattggttaattagagaagagaggatggagcccggccggccggcataagaagatggatttatttgcttctttggttgaataggcttttttttcatacacaaacgaatcacatactccctccgtcttaaaaaaacgaatctataactagatgtgacatattctagttcagtgaatctggacagagatatgttcagattcgtagtactagaatgagtcatatccagtagtagattggttttttatgggacggagggagtatcgcatatactaattttttttataaaaaaccttaggtatacaatgatacctttggatctaattgggcaagcccctatgttacacaacattcatcgttcgttctagcttcaatttgtcggacggctggaacctacgaaatcacatttatctatatactcctatgcatctagttagtgtagtttatcatttcgcctatcttttgtcatgcaatattattagattaattatttatttatcatagcttctatcatttttcttaaccgtgttaataaagtggctgacctggcactactggaaaatcatttttttgtgactgccccacagatttcgtgatggcgatgtaaacacagtcaccaagaagacatatcatgacaggcattagaacaccatcacgaaattgggtgtttcgtgactaggaagagcagccagtcaccgagttatagagttggtgacggtgcagtaatataaagccctcaccatactgtgtgatggacttaaatgggccaagctgctctgcctctgtctgaaattgtgaaccactaaaaacagagtgctcttctcgttccccatggctcttgccctagtgagctccacgcctccacctcgacgccgcaactctgctcgtcgattcgtcgccggtagtgatgccggcgaaggagcccgtacattctcacctcaccgttggtcttgcctcccttgctctcctctctgacgggcgtgccgccgctgctctcctcacggtgggtttcgccgccgtccccgtgtcttgtccgtgggtcgcgtcaccattgctcttctcgccgtgaggtgcgcgatcgctactctacactccagcgacctgccttctcctctatgctctcaatccttccaccagaaatagttccctctgttttttccatagggtgacacataggtgttcgatgaaatgccaatgcagcgatttttggttgaatttatgtctgaggcttttaaaccagtaatttgtcacaatgcttttattagatggatgcaaaaattctcagatttcattagatagtggtattaggataatttatgataaacaattatggatagtttactgaccttggtttttgtacactagctttttggttccttacaacagtgagatattttacaagctgcatttttcatgtgtttgcatcctctgaattggattttaattcatagtaaaatattaaggcaagttgtttaatgttcatctcaattataaacatttgtgttccctttcctgtatatgtagataatgcacaaatattgttctactacttgcaggtgtactgaaattatacttcatttttctcgtatacttgtcagtgttgtgtacttttgaaaaaatcagctaacttttagttaaaattccatattgtttgttagagttctaaattcttctaattttacactttataggatcctacagcgagtttactgcagatcaatgacatcacctgaagtatctgttgaacatccacaaggtaaaactgaagaatcatttgttcttttcattttacttgtcaccatgcaagtgttttctgaattattttctgttcttttcttgttacctgctatcatgcaagtgttgttgtcactgtctaactctatgcagatgtttaggaggagttggatagcttatagatgcagttaccattgtgcctacacagctactagatgtaatgcattgtgggaattagattaattctgaacttctgcagtccattcttaagttctatatagtttactgcctgtgcaacgcataatgtggttttaatgatttgttgctagtaaatagtggaacaggacatctttaatatgccttggaagtaatatcttttcgcttttccaaaaatactatggttaattacttgttgtgtcatatctttaatatgttttcctttcatttctaaagatggcttttaaatctaatgtagactgttctaatcagtctgaagaatgggacacagaggaagactgctgtttttgatgcatcagaactagaattttggtgagtcatttttatatttatcatactcatttatatgctaccattaattggtcataattgatttgatactagtcatcttatgccaaaatgaccagctttgtatttaagaaactagaacatactgaaggtacctaatggcttgcaagatttaaggaaattgtctctgtttcttaaagatgtcctgaaacttaacacatacaaatgtgctcccttgttatctgaagctacatggcatgcttgcgttctttgatctagaaattatttttcctagatatctgaagctacatggtatacatgtattcattttatcttagatgctgaaactctgcacagaaatgtgcttatccagttatctgacagctgcctggcgtgtgttctttttatcttggattcattattgaacctaaacatggcaaaaatattggagcatttgctaaaggtccaagaaaactattgtaattttgcatggctctaatgacttcattccagtacagtgttttaatcggtatgcatgataagagcaatttaccgatgattcatctacttgattacctcatgtgattaatctgattcaagctttttataggcttttttacggtgttgactagtgatttcatttgaatttggagctattcagtaataatattagctaataactaaattgtagcttgctgtaatcttcaagtgacattcattgaattttaaggcaacaatttcaagtccagtgatacagttcaactcaatttgatgattcactttgatgtactaatttgttttgaagaaactttcctaatatattatatcatatcttgtagataattgtagaattgttcttttatggaaagctcagaagacttccttttttcacgtggagcttgctttatgagtggccaccgaaggctgcttccctctattctatggcattatattgggcttgtcacttcaagaattgttggactgatacaagacttgtgtagaaatttgtagtgcataattaaatattgtttttctatgaattatgtaaggactcacgatgttcaatgctaatatatgcttttgtgagtttgaatttggacttgggtaaaataagtgattttgttgtattatatctgaactcactttgtagcatatgagattgatttacatgaattttcatattaattacgtgcacatcgcgtgtctcgtgacagccacccagtcacgaaaggtatttcctaatggcaaaagtctgtcaagaaattgatgttctgtgacagctaccaccttcacgaaaaagtattcccaacggttaatcaaaactgttagaaaaatggtcaaaacatgcaaattgggggaattgctttttcgtgactgcttgacagtcacttaacagcttgtgactgcttcccctcaccaaatattagatttcgtgactaatcaagcgtgactgacattttgtgacagtatgtggtaaccaaagatctttgtgacaggcttttgacttttcgtgagagtgaggggcagtcacgaaaaatccattctcttgtagtgtggtcataggattaatccatatgcatgtagtaattgagtgagaaaaaacaagaaaaacctgaaaattggtaaaagataaataaattattagacttctgcatcatgaatccataatactaactttaaaggtgcaagtgggttcaggggtcgatcaacgtgcacccttaaataacttaattagaaaataaaaaaaacctaaaaaagtagaaatttttcttatgcaatcagcagcatcaggaggcaggagcagtggtggtagtacctccaattcgatcaagttgttgtgttcttgtggttggattattcggtttttaaggggagttgtttctttttttctggtctgatgaagctgcgcggtcgctggtaatgataagctcaggtagctgcggaagaagaagaggggtcgctagattggccggaggttggttccgcggcggcgcagtcggccagactgggttggtgctcggtggggctagctctagatggccataaggcccgaagctcaacggccggcccacggtatggtattttggcccggtccaagcacgacacggcatgatcgggctggcacggcacgatgggccagcaggctaggcccgacacacaaagaatagggagcaaacatagacatattatatgccatggttcagagaataaggacgtgaaatagacttattttatatatatatatatatatatatatatatatgtcagcccaaagaggagagagaaaaaatagactattttagctatagatatgtcacaacccaacgaggagggaagaaaaatagacttatttaaaaaagacacgatgggccacccgtgctttcgggccggcacggcacggttcgactgctggtgggctgtgcctaggccaaaggtgcagcccatgggctggcacggcccggcacgaagtgccgactgggccgtgctggcccgatggccggtgggccgtgcctaggccgggctgtgccgggcgggccttacggccatctatagggctagcatgtgttcgttaggtgagacgttgtcaccggagcaacaaggaggcgccatagagggcctcgccactgacctggccgcagcgatgcgcccattctcgatgatcccacatcagtattgatcggtttcggttgtcgacgttggtgccgctgtcggacgcctagtcggctatccactagcatggcagcaccacgaagcgttccatgcattcggcggtgcctgtgcagcgttcaacggtggcagtggaggatggccaggggctctccctctcgatctcgccgtcactgcagtagctggagatggcgaagcaggcggaggggctacgagtccgatacggcgtgctctacatcaactagcaggagcaatagcaattagcaggaaaaaggcagcggcagcggtgtcggtgcagaagctccgaatggcattgcacggccaggagatcgctaggcggctgcgcgcggggaggagtcaccggccgcagcacgcacggggaggagctctttgatcgcgggctcctgctgcctggcatgcacgatagatggaaaagagtagggatggcagtttaacccgtttgtccgtttacccgtggataaaaatcctaatagagttgggtttgttctccatttagtacccatgggttttttattgggtcaaaacctatacctaacgggcatacgagcacgggcataggtagtcgctactcatgcctgcttcgctcgtttacccgcaaaaaccaactgacatgtggtcccttagtcaaattagtataaatgccaccatctagtattgatgaacttgtaatgcttgtattgttgaacttggtacaactgtaccctttctttaaattgtgataatgtctctctgcttgtggagatttgtggttgaaatgttgaactgtagtttgtgacgggtaaacgggcatgcccgtgggcacatggcgcctgtgggcaacgggcatgggtagtgttccttgctcgtcatatagtaacgggtatacccgcgggcatgaattacctcgcgggcatggatatgggtagtcactacccgtgcccgtcgtacccgactgccatccctagaaaagagagaggtgagtaaaaagagaaaaaaaaagattatgactaacaagtggggttgttatttttgttattttttcttactgatatgtgggtcccacgagcaccagttaggataaaactgctattcaaacaaccgagggactcgatttgctctgattttcaaatatagaagatgcgttagatctggtattgtggttgagggaagcaattcaagcagggacaagaggtgagggaggtctaacatacttatcctcacacaataacatggacatgggcctggcttcatcggatggcccacagagacgtggatccagttggtgttggtggtctgcatgcttgtcttgcctatgctggtgttggaggttgcacgcaagctgcttgcaagttgcgaaccatcatccaacaacttatatagtttaacatcatactaaatttctttagattcacatgaaaaatactttcgcaatatgtaattcacatcttatcaaactatacaaattcaagaaaatgatgttaatgtttaaccggcaaacccacatcgcaagtaatttatttgaaatggagggagcattagctcgtcttaatccaatattgtatctccaataattaaataccttaatgtagaagacgcatatgcatccatattaattatgaaccgcaccgctgtctatcttgttttgagtttgctccatctatccgttccaaaatataacaaaatataataatttttagcacattattcatagtattcaatcacatctcatatactttaatttcttcctattttaccccatctattccatatttgctgagagaaagacttttttttcttaatctcaatatttgctaaataatcttgtcatccttgtatttcaaaacagatttgagtattttggtaggagaaccctacaaattgtctatcattgacctaggaataattgttctatgtaccttgggggctagtttggttatgatctttggtgaaaaatctgcattgcatacatttagctcatcggtcatctccgccatatatatataccgatgtttcaacacgaggctacttaactttatcacaaaatattgtatttcatataaaattatattaacatcagggcatgtggtgccgtactatgctattcctattattttttttattgaaatatactattcctacagcatgtacaacggtaattagtgtgctagtccatagcatgtcagttgatgtggaggaaagaggatgggaggagtgagcaagaagtactcctggacaagtgatcttttgccggatcatgtaaaaatcacattagtctggtttcaaataggaaccagcactaaagatcagctttagtcctggttcaaaagcccaatggcactttatgatctttagtcacggttgtcccaatacaataactgtcaggctatgtcaggtccctaacgatctttagtccttgttgatatcaccaaccgggactaaatatctctctcccatgtccttatcctttctctcccacgcctccctcgatctcccacatgtcctacacgtccttatcctctcttgcctctatctctctctctctcacctcgcctctctctaactctctctctctctcgctctctcgagaagtggcagcggcggccgagcggcagaagcggcggtctcgccctcccctatgctagatccggcgggaggggaggcagcgggatgggaggctgtgcggcggtggagcgacaacggctcaacgacgtcagcacggccgtgcggtagacggaggaagaagttcagtctttttttaatttttcgagattttgtgatgtattttttttgagaatttgtgatgtgaatatgtaaacttgtgatgtatttgatctgtggtgtgaatctgtgatgttatctgtgaatctatgatatgaggatgtagggagcaactcgatttggggaaatcaatatgcaagcagtaaaaacaatgaacaaaagaaaaaaccgggactaaagaccacttgctgagcagtgaagggtcgcgtcggctgaagaaaacatatgctagaaaaaattgagatggaggaggaacaaataaagttaaaataatgaaaagttagaataattgctactagttaaatattgttttaaacattatttaacagttgtactagatttggatgggctcgcataaccaccttccaacggctgtccaactaatcccatttttccccctgtgttatgtcctcaaaagcaaaacttatagaggggggcaaaattattaatagcaatacatatttcacctatcctctactccacatgaatataataccccctcccccccccctctcaactactgtaccattgcatatccctcttcatctcttctagcattcctctttctcccaacttctactagaccctcttcatctattataggatgaaattgaacatgatctgcaatatcggtatatgtttgattcctgtatgattagaaatgagcagtatcaggagaacataaactcagcttagcatgacttctcgatggatcatctgagctccgagaaggcccaaatgagcacaaggtcagagcgacgtctgtttaactcgcaccctggtcctcaaattcttttggtagctccatggtacggcagtttatctgggaggacagtgggaagctaaaagctcataggccggttgaacgttgcagacagtacggtcttttcatgaggtagaaatggaaataattaattatttaccactattacaagtggtgataaaagatttgtcacgggacctacaagtcatagacatcaagtgataaatttaattaccacatctttaatgtggtaaaaagttaaatgtccctacaacaacaaatgggtcttagaaaaaaaatcacagcctggtcttgtactcctgtccaacagtgcaggctatagactggaaattaacatcagattgggggtgccttatccactgactttggctgtgtgcctcctagcagagaccagagatataaaccattttcattatctaagaagtgattagtaactatgcgtccttattatatattgaggtgtggttgcccgaacggtcgcgccaaattctatacttcctccgttttataatgtaagtcattctagcaatgttcatattataaatgtttagatttattaacatctatataaacgtgaacaatactaaaatgacttacattatgaaacggagggagtactactcagttcgatctgcatgttgcaatgtggccaaatgccgtatgtaacattcagttgaattaggcatctctccaaagtagttaagaacattcagaacgtaaagataattatgttatgaatgtaatccagattcgaatctgtaacatgaatgatatagttgttattgggttgtgagaaatgctataagagtagctagatttagacacacacatgcatgccagacatcgattatccacagcagttgacatttttggtagtcattataatttcattaagaaaatgtaatatgttctgataaatcaaattaagaggattgatcaaggaaagaaaaaaacaggagatggacagcatggtaacatcaatcacgtggtgacgccgtggtgaagccagatagtggtttctgataacggagcaatcaaacaaaacaattgctaaatcgaagttacccattttcatgtgattttgtcacagcattgaataaccgaactgaacaccacactaattaattacgtgcctatactactccctccatctatttttgatagtcatatttcatcttagtacacagaacaaggataagcaattctacttatcatccatttaaacatactactagtcatttctcgtaaacaagcgattcattaatatttacatttctcaatacctatgtagccaatcttgtgtggaatagtgaagagtcatttattaattccgagaaagtcattaaaatgataggttgttggattgaaatatgactatcaaaaaataaatttttcagatttggaaatataactatcaagactagatggagaaagtatatggctagtgggatcaagagcctgattaattattgtatttaatgaaaagttatatatatttcattgctattcaatgttacgtgtggttaggtggctgtctgatatattccctccgttttttaagcacattgattttttaagcacatgtttgacactattgatttttttaagcacatgtttgaccattcgtattattaaaaaacttttgtgaaatatataaaactatatgtatacataaaaatatatttaacagtaaatcaaatgataaaaaataattaataattatttgaataagacgaacggtcaaacatgttaaaaaaattaatagctacaaatatttacaaatagagggagtatttgatactccttttattactctcatgcttgtcatgatcagatctgaactttgctatatatcaaacccttccattgtcctcagttaccttcagtttggctaaatataccctttggctgcaaaatggcagaggaacaattttgggagatgattttttttttaaatgcagtcttcatgaacatccccattggatgggaaaacataaacaatatcctcgctttggaatgagtggcatcagtaattcagaattacaataggctagtgtaaccttctgggattgaacatggggagaaggtcgcccagcatgtagttcgctaaactctataactgcattctacctattcagagagtgttctattgcccattgaagctagaactataaaacattgacccctatacaggaagaaccctggtaactgcactgtagtgaatagcaaaattcagagagagcaaaaacagagttaattttcaatggaaaggcggagagaacttttggggcaattctctgtattatttctctagaattcataatgggtactccacaaagcaaaacctagctatttaacactgccaagtctttatctcgtgccaactgacgatccccaattctcgacaaaacacacaccacacctcacagactcacacacgcacatgccgccctcgcacaatcactagggcggcacccaccgtgcctatcacatcgcctaacaaaaaccgaaacggatattattctccaaccgtgcaagctacaccagtggcagctttgggatcaacccgggattagctagtgtaggcaacaacccctagatagagcaaaatataccaacgataatccttaggatcggaggggggggggtgcagcgaaaatggggcaccccccgacgcgtgggcgcgcgcccgtagggccccaccacgtctcccctgccatactgtcacgtgtccccaccatgcaggacgttgcaacaaatcacccacttattttgaaaaccctcaattaagggaattcgttttattttttgttccactaaaaatgtttcatctagtgcaatcacaatgtttcactatatatagatctaatattgcagtgaactgaaacattctttcgctatttgctgaaatattgtttttatataaagtgaaacaacacccgatttaaacgatcgaaacattttcgatctacttagtgaaacaattccgatatacttggtggaacaacgtgcaacatttaaaaataattcaataataagctaaaatttttttcgtcgaaatatatccatatgttgtcttgttttgaagatttaattaaaatgaatttaatggtgtaatcggatcatgatttggataaataatttaagagaaaaaataatttaaagtggttttgcacacatgcatcttgctgacatcaccgctcgatttttctactcctccatcagacgcccgatgtctaggctcctccatataccatagcaagcacataaaatcagttgtgcctctacaactgtatctttaattatataattgttttcaaaaagattggtgaaaaatgtactgagtcattccatccatgtaacaaatgaatatataaaatcgtccgggctg

SEQ ID NO: 75034 - DNA, 2165 bp, Oryza sativa
taaggctcgtcctagggtcaagggggctctgataccaacttgtcacgaccggaaataacccaacgggcgttccttacgtgcgtgcattattccttgtcccaggagacaagcggaagcgtaattaattaatttattacatgggcggcgaagacccagcacacaagaagacaaacgaaaaatagcggaagactagggcgatgaccacaggcgcttgacggcaggcacgagctagacaccaaagccttcatcatccaggggctcctcttctgggtttgggaaaaattgagcaagactgagaacaaccaccgtactcaacaagacacacccacaagtgcagaataaatgcaagggagtacaagggagtacaagggagccataatatagggggttagggtttgcagtaaacagcattaaaagacacttagttgctcaaagctattttgtaaacaccgtcctagagctatacaatattattaaccaaggctgtgaacccacacgaacctgccttaacccaaggcctacgatgattcagaccgaactggcaacccgaccctgggtgccagctcgtcccaagccaacctaggccaaccattccacattttagttgttaagcaggttttaagaattaaaacactaaattgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccctgagcccagcctaaaaccatttttggagattttgaatagagggggcggtgtgaatccaattccacaataattcatccattccatagtgtccaggtgatgagaatatcccaaagtctagaattgaaaaaccacctaatgttacctaattaaatagcgaagcatctacctaaaatcatactagtggtaccatgagtagagtgtccactagttggggttttgtttattctagggtgaacaaggaaataataacaataacaataataaggtcataacaaagttaaataggcatggctagataaaacagtgattacgcgggaatttaaataaagcgatagtgcaataatttaaatcaacataattttataaactgggattcaatatgttcaaggatgatgtgacttgccttgctcgctttcccaaacgtcggcttcaacttccacgaagagtggatcttccgaagctgcagcgtctacacgaccaacggaaaagaaaaggcttttactctaataaactccacataacaagcaggaacaaagcacaaaaatgggttcttgacttcttaaggaaaaattagagacttgaacggtccaattccgagttcaaatggccaagttatggccatttgaaggttatatgctctttaaatgaatatttacgaatttctttatttaaattttaatttaaaaatggatttattgcgtcagccgaggggaggggcgcgcggaccgggtccatgggggtggggcccacgcggcagccccacggcccacggtggaccgggcgcacccgggctcacaccggccggcaccgtgggtcccacgcgtcagccgcacccgagggcgcgggcggctgacagccgggccccacgcggcagccgcacggtgcgcccgaaggcggccacgccggcgcagcggcgggaggcggcgcgcccgcgcccctatggtcgccggcagcggccataggcacggcggaacggcggcccaaaaagggggagggaagggggaaaagaaccggcggtcca

SEQ ID NO: 75035 - DNA, 24302 bp, Oryza sativa
tccccctagccacctcagcatcaccccgccacgtcggcagggggacggcgccaaagaggctggcgccgtcctgttgaacgacggcgccagccactctggcgcctcaaaaaggaccattttttggataagtttttctaggggtctacttgcgaaataagtttttcaaaaggaccaaaatgtgaaaaatccagggccaagacaggtgccccacctgccaggtctgcttcaagcgcgggcataccgcagcagactgctggtatcgcttcgacgaggactacgtcgcagatgaaaagcttgccgctgctgctactaactcatatggtatagatacaaattggtatattgatacaggtgctacagatcatattaccggtgagctagagaaacttaccaccaaggaaaagtacaacggcggcgagcagattcacacggctagcggagcaggtatggatattagtcacattggtcatactattgtgcatacccctagtcgtaacattcatctaaataatgttctttattttcctcaagctaagaaaaatcttatatctgctagtcagttagccgctgataattctgcttttcttgaacttcactcgaaattcttttccataaaggatctggtaacgaaggacattttgcttgaagggaaatgtaggcatggtctctacctgatccctaactcctttggctgatcaaccagcaaacaagcccttggcaccgtcaagctatccttgtccaggtggcatagccgtctaggacatccgtctcttcctattgttaagaaagttattagcaaaaataatctcccatgcttagttgagtcagtcgatcagtctgtgtgtaatgcttgccaagaagcaaagagtcatcagttaccttatgttagatctactagtgtgtctcaatttccccttgaacttgttttttctgatgtttggggccctgccccagagtctgttgggagaaataaatattatgtgagttttattgatgattttagtgctaaaatataagtctcaagtctttgagaagtttaaagaatttcaggttctagttgaacgaatgtttgatagaaagattattgccatgcagactgattgggggggagaatatcaaaaacttaattcctttttttgcaaaaataggaattgatcatcatgtgtcatgtcctcacactcgtcaactgaatgggtcagctgagagaaaacactggcatattgttgaagtgggtctctctcttttatcttatgcatcaatgcctcttaaattttgggatgaagcctttgttgcagccacttatctcatcaatcgtgtgcctagtagaatcatccaaaattctacacctctagaaaaattgttcaaacaaaaacctgactactcatccttgagagtgtttggttgtgcttgttggcctcatcttcgtccttacaatacacattgtggagattatgggtaccccatacccacacggcatggttatccgactagttataggggataacttatatgtatggaatatgtaacagattatgacttgggtattacgtttccttgtatattacggaacggcctaaagtcctggtttgataagattgtaaagtagagttaggaaaccgataccgtattggataatgtttctatcttgtaatcctgccccccattctatataaggtgggcaggaggccctctagagggcatgagacaacctgatcgtcagatcaatacacactcagcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggctgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgctgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttcggtgtctacgacttcgccgaccggctggccttcgtcgccgccgactggtgtccccgcctatacggttggtcggtcacaccaccgttcatgggcgtccacgtcttcgccgaccggctggccttcgccgctgccgactggtgtttttgcctatacggttgacggacttcgccgctgttaatgggcttcatcatctacaccactggcttggttccactggcgccgactggcgtttttgtcaccattgatggactgcttcgttcccacatcggctacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgacgaactcatgtcactcatatgtcgccgccgactggtgtcctcgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgtctccgcctgcacggctggcctattatgccgccgttgttgggcgcctacgtcttcaccgaccggctcgccttcgtcgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggcttgccttcgctgccgccgactggtgtcctcgcctgcacggctggcctattatgccgccgttgttgggcgcctacgtcttcaccgaccggcttgcctttgccgccgccgactggtgtttccgcctgcacggctggcctattatgccgccgttgttgggcgtctacgtcttcaccgaccggcttgccttcgccgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgctgccgactcgtgttcacttcatcacggcgatgcaactttgtcatcatggtggagcgacttcttctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgttttccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaagaacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgtcccgctgactttttaatatagtcatggtgctgtttgggttttaaagcaattgattggttacaatatcgttgctttttgccacgtaagtgtgcatttttattgaccaatattatggcttaggctgattatatattgtggtcatttttcaggcggttggtaaatcctttatgagtttatttactcggattttataccacatatgccgtatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggccttggagtaatctggttcgagagaagattatcttttcgactgtgaaggtctcaggggctactgtggagattatgggtaccccatacccacacggcatggttatccgactagttataggggataacttatatgtatggaatatgtaacagattatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacacacataaactccaattccgttccaaacagtgcgtgttcctaggttttagtactcaccacaaaggatttaaatgtcttgatgtgtcatcaggccatgtctacatcttaagagatgttatctttgatgaaaatatatttcccttttctactcttcactcaaatgcaggagcaagacttaggtctgaaattcttctattgccttcctccatgacaaattataatacgactagtccagggggcacacatgtagttacaccagtggctaatattccattacctagtaataatttaattgtgtctgatgctgatgatgttgtttctggagaaaatggtacaacacatgagcaggaaatggagaataccatgcatggggacgtgcatggcaacatcgtgcatggggaggcggcactggaatcgacgctacaggacagcagcactgtgcctgaccaggacgctgacagcagtggcgcagcctctgctgcagcctctggcgctggaggggacagtgtcagtctgggagatgccgaagcaaatggcgcagcagcaagtggcgaagctagcagtgcagattcccagccggtgcagcctgatgtgacagctacagcagcccgtgcaccgagaccacacactcgcctgctgagtggtattagaaaagaaaagatatatattgatcgaactgttaaatatggttgttttaattctacttgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcatatgacaaaagcatacacggcgcctaaagaagcattcttagccgactgctttttagccataattaaaaggaatccgagtggttaacactctaaaaggttcacgaatgaacacacttgacaggcatccgaatagaaaactctaaagattacccaccaaatattataaaaattatggtaatgaataagtctaatagcctaggctatgactatttaccataatgaaaacaggcatataacataccaaggaaatgactatggtaaaaacaagtcattccaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccattcgcacctccgatacccttaacaagaaatcccgagatccaagcgacacttcatcttccccgccggaactctcgccattttccccactccctgctacagtacagagctacgccggcaaactagggttcaccattccactcgaatccaccttcgaaaagttcatcaaaatccttcccgtgatccaccgcctcaatccctcacctctccctagccatccctcgaatcaaatcagcgcattcggaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatatacacgaggctgtggtcttctcccatttcttctatggcggcttcgctcttccgacctcaaaatttttccgcgggatattaagcttctatggaatcagcttgcatcacctaaacccaaattccatagttcacatcgccaatttcgtccatgtttgtgaagccttcttgggaattaagccccacttcgctctgtttcgccgaatcttctttctcaagccccaaccaaacaagagtaagccatgtgtagtcggaggggccggatttcagctgagggggactctgagccagaagtacttctctatgcccttcaagacctcaaacaaagggtggcatgcaaactggttttatattcagaatcctgagcctgctcttcccgagtactcttgtcttcctccggtgtaccaagatgcctggaactctcttccgattggggatgaagcagcccaagccttggagctgatggatcgcatgctaaaactcaaagaacaaggcttacaaggagagcagattactcgacacttcatcaaatgccgattggcaccaattaaagaaagatcccgtacggcattcgagtttgacggcaagcatgatcctaatcgtgaagaaccagattctctggattttaaaatcatgaaggagagaatgtgtaaaatcttctcaaatgctattgtcgtcagctactcacatcagctgccagttgtgccatataacgcattcaatccgcctccgcaggtacgtatccgaaatcttcaacccatgaccaaaacataatcttgtcttcatgttgagttaactaaccgtggaggcatctcattcaggaatatgtattgatgaagtctgaccccccaatcactcagcgccggtctcctcgccagcacaccgttcagggaggtggagggccgacaatcagatcagatccgcaacctcaaacctccaatccgactgggcagacaggttctcgcaagagaaagctggtgcttaatgacgacaaaggcgacgacggcaacaaatctggggacaaaggctcgcccaataaactcccaaagcataccactcccaggaaaaaactggctagtcgtccaaggccaaagattagaacatcttccaggtataaaccttttggtaccatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactggaaaccagtcggcagcaactgaaactacaacaacccaagagcccccgactggaaaccagtcggatgtaggtccagatcaagaaactcccgaagttgaagcgcagacaacaacttctcaaggaccagaggctggtaacgactcgatgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcagctgatgactctcgtcctcctatcttgctcaaatggtgggacgagaactcacaagctgccggcatcgtcataaatcgtcaaaaagaagatgaggaagtgtgccagttgaagaaggcacttggagaagccactcgcattgtgaatgtaaatcttccgggtgactgcctttgatgactttgttttctcttcagcaaaactaaaccatgaaccatcatgcagagaatccatcttcgcaatgaggccaagaccgcaactttagaaaagctggttcctcatttgggaactcttgaagcagttagggaccagctacacgaggccaaggagctcgccaaaaagacagagaaggaattaagggaccgaattgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctctttttaatgcagtagatttttatcataaatgtgttttgtagaccgcaaaatcaaatctcaagctcaatttgacgtcctggttggtaagatcaagaggcttgaaggagcaagagatgaagtcgctaatgtcgctacaccactcgtccaagctatgttcctcaataacagtggtccgagtgcactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttgcagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggactgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagcccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaaggcacgggatcgaacattgcgattataataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcaacttcactcggcaacattgcttctgccccatagacaaggaaaaaaggtgactggcctgtggtccgactgggtgtagtacgcaaagaccaaagtactgatggtagctgttccacccatttgccggcatagggttttagccggtcaaaaactcgcgctttaatcccttgaagtatcatgccattggctcactccacctgtccattgctcatgggatgtgccactgaggcatagcaaatcttaattccaaagtcttcacaaaagtctttaaaaactccgccagtgaattatctgtcattatcagtgatgatccgattgggcactccaaatctatgcacaatgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggctgaaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagttggggaaattagaaccactcctgctccagtgcccgaaagtctttttgatccgtcaaaatgcatggtccagtgctccatcttctccgcgggggtatcctcctggcactcggtctattcggtgacaaaatcagctaacgcttgggacttgattgaaattcggggcttgaatgatatgtccaaagacatcaactccaaagcccacttagcaatccgtccgtttgctccgcggttatgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcacgctcaacgaccaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattggaaatcatctgttttcttcagtagcttaaagaagggcatcccccgctcgccaagtctcgaaacaaatcggctgagcgccgccatgcatccagtcagcttctgaacatctttctgggtacttggcggtttcatgttgaggatagcagtaactttctccgggttggcttggatacccctgtgagacaccataaaaccaagcagcttccctgacggtactccgaaggtgcacttttcagggtttaatttcatcctgaaagcgcggatgctcgcgaaggtttcttctagatccgagattaaatcatccttttgtttggtcttgacgactacatcatccacataggcttcaacgttgcggccgatctgcgttgagaagcatctctggatcatacgttgataagttgctcctgcgttttttagtccgaacggcatggtgacatagcagtatgctccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcaaaatcggtgacttcaaagctgatattctctgtgcggaagttttcccgagtgccaaaagtgaccgggagggtgatctggccgagtggagttgcggataatcctggaattactccgtgaaaaggcgcattgcttggttttagcttggagcgaggaatctgcatatcatccaaggtcttggcgaagaggatattgagtgcactgcctccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaatcctaccggggtgtcgccgtcgtccttcttcctcgacgtgctttgttcttcgtcggagttcttccgtgtagtcttggtgtattgctccgcgaattgcttgtagacgaaacaatctttggccacgtggttggagttaggatggtgcgggcattgggagttcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatgcggtgacggcgtcttcggctttggcgtactcgttgactttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtgccttggaagttggcgatgaagtggtcgcgtaattcggcccaagatccaatcgtaccacggggcaatccatggagccaagatcgggcggaatccgctaaagccactggtaaatagttcgccatggccttgctatctcctcctgctgcgcggatcgcgagaccgtagacggtaagccacgattctgggttggtggtaccgtcgtacttctctattccagtcggcttgaagccggctggccaatccactcgacgcaggtcgtcggtgaaggctgctactccatcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggcgaatgaacggaccgctcgtcgtgacccctgctcctgcgattggatcctgcgccagtgatgctgaggcttggatgacggtagtcatgagatcggaagtgggggagtcggctgccagtcggcgtgcggacgctttcggagttaactgggaccgaagccgcaatcatggtctttgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgttgaaatcacgcgctcggcgccctgcttccaaggctcgctgccgtcggtcctcagcctccttcgcggttcgctcacgctcctgctgctcacgccgtagccgttcttgttcttgtgcttgacgctcctcctccagtcggcgacgctcagtctcgcgacgtgcttcggtttcccgggcttggcgttgctcctccgtctcgttatcggccatgaagacgccgaagtagagaggggtgtagttgtcatctaggcttccgtcgaagtcgtcgagatccgggtcgttgtagcgagagctaaactcgtcgtactctacgatgtcggtgggacgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgccaaatcgtcggggagcttcatcaggatcggtgggtaagcctcatcatcttgatctggtgacattggagaagatgcgatctcgcccgagtggtttgaagccaactcgattgagatggtcttgaagtaactttcagccgcgtttgggagtccaaacgggactgaaatccggttctctcccgactggtctgactccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgcccccctacctggcgcgccaactgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgagatatccataatctccacactactcgtgaaccacaaaatgatagagaggccacaaaataatagagaggctctaggagataaaaactggatagctgcaatgcaagctgagtatgatgctttgataaaaaataatacatggcacctagttccgtatgagaaaggacaaaatattattgggtgtaaatgggtatataagattaaaagaaaggcagatggaacacttgacagatacaaagctagacttgtagcaaagggctttaaacaaagatatggtattgactatgaggatacctttagttctgttgttaaagctgctactattagaatcatcctgtctattgctatttctagaggttggagtcttagacagctagatgttcaaaatgtctttcttcatggattcttacaagaagaagtctatatgcaacaacctcctggttttgagtcatcctctaaacctaattatgtatgtaaattggataaagcattgtatggtttaaaacaagcaacaagggcatggtattccaggctgagtaagaaacttgttgaacttggttttgaagcttcaaaggccgatacttcattattctttcttaacaaaggagggataattatgtttgtattggtttatgttgatgatataattgtagctagttctacagagaaggcaactacagcacttctgaaggatttaaacaaggagtttgcacttaaggatttgggtgacctgcattacttccttggaattgaggtaactaaagtttccaatggtattattttgactcaagagaagtatgctaatgatttattaaaaagagttaatatgtcaaactgcaagccagttagtactcctctctctgtcagtgaaaaattaactttatatgaaggatcacccttgggacctaatgatgcaacacaatatagaagtatagttggtgctttacaatacttgaccttgactagacctgacatagcttattcagtaaataaagtttgtcagtttcttcatgctcctactacccgtcattggacaggagtaaaaagaattctcagatacttgaatcagtgcacaagtctaggacttaatatacataagagtgcgtctactcttgttcatggatattctaatgcagactgggcaggtagtatagatgacagaaaatcaacaggaggatttgctatatttgtggggtctaatcttgtgtcctggagtgctaggaaacaatccactgtgtcaaggtcgagcactgaggcagaatataaggctgtggcgaatactacagctgagttaatgtgggtacaaaccttgttaagagaattgggaattgagtctcctaaagctgtcaagatttggtgataacttaggagccaaatatttatcagctaatcctgtgtttcatgcaaggacaaagcatatagaggttgattatcattttgtaagagaacgagtgtcacataagcttttagagattgattttgttccttcaggagatcaagttgctaatgggtttacaaagtcactgtcagttccttcaggaggggctgtgaaacaacctaactctatcctgtgcgtggtgcatggcgcatgcatgcgataatggcgcactactggagatgggaaggctcccgtgtgcatgcgaatattaccgggtgtttctctgaacacacggtaacttaccgtgagtagaacaataaactcgggaaccatcaagcgcttaccgtgtgttagagatgactcacgggaacaccggaatccacctactttccgtctgtgcgcgtcaaactctgttggcgcgagtagtatttttctctttggcgcgaacggatttcttttggcgcgcgcctagctccgtttggcgcggcccaatttttcgctggcgcgaaacagaaggggtgttcccgtgtttttttttcattcagcgcacgggaagtgagtgatggcccacatgtcgattggataaaaaaaagaaaaaggaaaacaaatcctaaccctaaaaccccaccggctcccacagcccacgccgccacagtcccaaacacctcgccactgctgcccttctccttctctccctcctcgcggcacctgcgcgccgccccttcctcgccgcacctgcgccgcccccttccctcgccgcacctgcgccgcccccttccctcgccgcacctgcacgccgccctcttctctccgcacctgcacgcaatctgcccaacatcaaggtatgtgattgtcgaatgttggctagcttgtatagtctcttgatgtttgatgaagaaataagaaaggagaaattaatccctttgttctctggatttatcaaataagaaatatagtctcttgattattgcttcagtaatctcatgttttgctttagatcgtagactaaaatgcttgtgtcctctagcagtctttttagctttaggattttaatgtgatggcatgctgttatttctgaagtaattctgacctaccaatacttgtgaagttgaagaagtattgcagttgtatactgttcctatttagccttgcaattctagattgttttggtgcctatggatgtcctgcctgatgttctattaaaggatgtgtttttggtgcctttcttcttgtaacaagagatgattgttatatcctgtcgggatggttatgtgcttgggtttcagttagatgtctacttttgggagtttggtggagggaaacatctgtagtcctgctgttagaaagcttgcaatccgagcatctgtttgttctatttgtttgaccttttcgtgtaaagggtctatgtttgggcttttcctaaagccgtgcaatcaaaaattgtttgttctctaaatatgctgaaatgttttgcaggaggatgcgacgattaagctcgggctctagaggggcctccagttctgcagatggttcagctagtgctgccatctcatctaggaataggacaaggtcatcttcctctcagcaacctactgatcctgttcaagaagaggagcaggaagatgatgagttctggttttgtggccctacaagggtgccaccacgacctacacgagaggaggataaacctgtgcttaggccaataggggatatgtaagtgtgttgcttgtgctatatattgctgttatttcaagtatgaagctaatatctagcttttggttgggatttgtgcaggcaatgggaggtacaagattatggtcagagtactagagtccccaatggtatcctgactacattgataaaagaaaatttccctggtgtggtgaaattcaagggtagagatgagcctgcatggtctccggaacattacttgcttaaacctgataatgcaaaagctaatcaagcacgcttgccaagcctcctccatcgcgttgaggaagaattctgggtatttctttaccaacttagtttctttcaagttacatagatcatgtattgtttggttaacttttggtagttgcaggggttctataggtgggcagaggggacagaagtggaggctagaagagttgtgcacaactgcgtcaagaaactctttgttgatatattctatgaggctcgtatcctagctgtgattacttatcacaagaagattctgaaaacagatatagatcggccaactgcttgcaggacttatctcacaaaggcggagtatatgaaagtaagctcgcttgaacaagaaaatgttattagatgcttagcttttgaacatattagtgactaagcgcaagtttgtttgttataggctaagccatggtggttcctaaatgctggtcgtgcgtgggcattattgtcagatttgaggtggtgcaatccagaatggcaggcttactcccgtgcttgtagcgaacgcagggcaaagatgaaaacgccagcccatcgccaaggcagtgctaaccttcatcgttaccacaagaatttggttcgttagtttttcttagacataataccaagacctgcatagctttagactttaattgtacggtgttcattgaattgcagcagcacattattaatagtgttaaactatttattttgaatgtaggagaagaaaatgggcacaccagtgcatgtattgaaggcttatgctcatgccaatagggtagacccagacgagggctactgtgatgaagattcatctcagaatatgttgctcgtaagtgccttacacattgaaatttgtgttgtactactctattgtctacattccatttggttaactgccattttcatttgaatctgtaataggaggcctatgctcgcgcttttactgagaggcacggagaagacagtaattggcggactgaacccattgatggtgtggctgtgcacatggctggtggtggcaagaaacatggacgcttcttcctgcttaatggactccttaagacaccagatgttcttgctgatgttgggagaagcaggtgctcacttgatgatccacggcctagcagacggctgaggccaaaccctgatgatagtgcccggattgaggagcttgagcgtcaacttcagtgtgagcgtgaggagagggagcaggagagggagcgggcacgcgaggagagggagcaggagagggagcgggcacgtgaggagagggagcgggcacttgaggaaatggagcggacacgcaaggagatggagcaggagagagagcaggcacgtgtggagcgggtacgtgagcacgagttgttccaggagaaaacaagc

SEQ ID NO: 75036 - DNA, 10312 bp, Oryza sativa
atactgcctctctccccctaggtacttcaccaagtcattgatcagggatggtccaacataggatgcacttgcacttaagactgcaaatcctgcattcattatagcttttcttctaataaataggaacattgctgtgtaaattgatttagtatttagaccatgcctgttctcaacatcatctatgatttttttgaatgaatcagaaaggaactcagcggagtccttcccatagacatctggcacatcattcttatctagaggtttcttgtatccaatagcaaacacagggttcatccaggagaatgtgacaagttgtagaagatttgcttttccatatgggcatggccttttgatttctgtctgctgtcctgtagatggactcaatagtggctctgttatgctgttatctacaagggtgattcctgtttttcccctggcggaaattacaaatagaagagtgcagataacaagcatgaacaggttaatccatttttcaggtcctaaatattcatgatcgagtaaaatagacctgagatcaaataccacactggtaattgattgcagaaagctaaatatccaccatgctcgaattataaacggaagctttgcggatttcgtcttctgaaaactgaacactactagtgataatattatccaggatagcacctgcacactttcacctagaacaaatgctggatatttgcagtcacttatgcttccttgtaacaacaaaactactatcttcagagtatgacttgctaagttaagcaggcaacaaactttgcttgcttgatatgttatacccagctttttgtctgtgttcttctgttcctgatatgaatgcttgctttcagcagttgatgtcttaaatctctgcctgcaccaccttattctcttatacagaaactgaaccaagatactcatgatgaatatcaggtgtatcagtgcaaaagcgtccatccagaagcaaggtgagtacatttcttgccattcttgcaaatgttgcaatttagtggaatctgtaatgttgcaatgtaaatttatgtgttaagaactaacaggagaatagatttgttcaagagtcatttttcatatacccttttatcaaaagcttttactacaatgaaccaacacaaagtattatcgttggcttccagctaaagatacaacttctcctaggaatccagtgtactgaaaagaatattccatttccctaatgacaccataatatttcttttaatccattcaaatgttttgcaaccataaatccatgatatctagtaatgttatgtaagagactgtaatatctaataatgttctggatcgtttcctgtagttatatggatttttcttttaccaaagtagttatatggatatgagaacagaaagttaatcactgattgccatgctgagttttccttaaggaacatgtgtatggccacaagcaaatgtatacagctgttctcatagtaaacatgtaacttctgcgtgttatcccacctatcaacatgaatacgtttaacagaaccacgactgttatgaactgcaaccacgtattggtccttgctgtttcctgtctgctaatggttacagatgcttggattgttcatttgttcacattcttcttatccatgtgaagaatgtatgaactcacccaacatgagaaccccaaacttatcatgaacctttcgttttttccagttcccctaatttcttttgcaaacattttgcagaggcaggaaaaaagaacaagaagggaaaaaggagaaacaaagataatagcaaagaaaacccatgcagtgcaatcaaactcatggatgtctcggcggggaggaatcagacgtatgcatgaaccaatctctgcatgcagatgcagggtatgattaaaccttacttgaagaatcacggagcaatccccagcggagaaacgcctgctgcgccgtctcgggaatcctcgcgagaacatgcaagtgcaggctcgctccttccatggcgcaatgcgaatgagacaggggaggaggagagagggagggagagatgggcagtggccgtgaactggtgacggtgatatagaaggtggggaggcctgagtccgcgctagatggttacgggttttggcgtatcacggtacacggtgacagagatccaaaaatacggttttcaccccggtaaggcctggttcagttaatccctacgagatagggattggaggggatttattccacacctattgtgatgtggaattattctctctcaatcccctctaatcctctttaatccccacaccaccgtagaataggggctcgttcgatgggaaattgaagtgatatgcatcatatagtgcatatttgggtctacattaactatttttctacgattataatgtaactatgaaagtgcatatgcacacattactgatcgatcagtcacctttctttatgcggttacaagaaaaacgtgcacgctcaaaaaaccaaccatgcacaccatttatccacatctgtgattataagtgcaccaatacattggttgtgtacattggctttggatctaatggtcgggttttaatccattttctgaaaaaatcattggtatgtgctgaacagtcagatagacctgataaattaaataatccgtaaattttttaagtgcttactcgcatgtggtataattatagacatcatgcatcctcaacttcaccattgcatcttaggaaaggaagtatataatgggaatcaatgcgcttagttcagaattgcacctccattactaatggacgtggactagtggagtattatatcggaagaagtatcaaatcaggtgtattgccctctgctgaactcaagggcaaacttataagttataattctcctttaactcaaagagacacagctttgtggtcagagtattggaaatggtttgaaaagtttttttttcgcgaacgcaaaaaaaattgtacgtcaatatattaaaggaatagagttttttttacacaacgcaaaaaaatgttttaaaagtggcacgtgtaatcatctgccacgggtgcagaacgactttaagcatgcagacaagagcaaaaaaaagcatgcagacaataccaaagacagcatgaacgaaaccagcttcaattgaacacccaaacatactatagtttccacaatatattctccatcaatccatcatcatttcaccggtattttttatccgtcatcgatcgatcggtcgattgcatcaacacgcacaaaaggcaacacagcagctcgagaatccgggcacgtaagctaattattaacacaacataaagggctccacacgtgttgccaaagttgccacgaaatgatgctcagtttttttttaaaaaaaataaccatgtccgttggtgcgatgcgtacggctgaaaaggtttgcagcagaataaatataccgatcgaccaaatacaatctaagcacatgatattcacccaacacgaacagattaaaaattgacagcacataatttctcagcaactgcccgtcagctcagataacctttagtttactgccggatcagatagccgtgaggacagtgtcagaatccattacgaggcaccatttgatttagattagaaaaacagacttaccaaatactacgttcgtcctaaaaaaaataagggaaaattgtaacatgccattataattttgtaaaatttgagatatgccatcttgacccacatgtcattgactcatgtgggtcctatatgtgattgagataccgatggcatatctcaaactttgaaaaattataatggcatagttctaaattacccaaaaaataaatctaatattggatgtgtaataatttggaaaacgtaacagctccacgccctccgccccccccccccccaacacacacacacggggggcgaaaccctagcagcgccgccgcctttcctctccccctcccccacctcgccgccgccggagctcaccgccggaaagccggcgggcgagccatgatggcggcggcggggcctccttcatggcggtgacccctctcagcgcgggagaggcggcgaccgatcccggcgaggagacggcggatccagcgtcaccttcgccggatttggccatcccctggccagatccggccggagtgggtgctggtggcggaggaggccgcggagcggcgacaccggcgcgacgaggcggcggcgacggcgacggctacggcgcggcgacgcgacgacgacgacttgcacggcagccagcggcggccgccgcgacggtgagatgcgcgcgggcggcggtgctcgcaccgccgggggcgagcgacggctgcagcgccgccagccctggtggcagcaggccgagcgactgcggcgcgaggctcgcggacggcggtgactggcagcgcggctggtgatgggcaacggtggcggtgccagtggcagccgcggctgcggcctgaggcagcagcggcaacgcctgtcggtgcagaggcagaggcctcagagctcgtcgcatcggcggcgtcagcggctgctgtggcacggtggtgcgttcggcagcagcggctgcggtggcggtgaccacggtcgcaggaggcatgacggcctcggacgactagctgaggacatggcagacggctacatcggaccggcgtggcatcgtttggaggaggggtcggagaccggcttggcatagagtggcgcagccgatgacagcggaggccggctcggcgcgagaggcgcggccgatgaagggaggccagattggcgcgagaggcgcgtccggtggaggaggctggcttggcgcgaaaggcgcggccggcggtggaggaggcgacctcggtgcgaggaggagctaccggtggatgtggcgcggtctccggcgcatgaagactggccggcgggggacaccggtgcaggggtcccgcatgtcggcatagctggagaggtggtggagcatcggtgcgtcagccaaggattcgcaggtggtgatcggcaggtgaaaatctagtccggccttggccgggccgacaacgatggttcattccccctcctgagggcgttgtcgtgatgtctcacccttcaagggcggttgccggacgaaagcctagtctcggcttctttgaaccccgacggacggcggcggcggttttttccgtcgcttctcttcttgaagacgtcgtttttggcatcccttagagggcgatcttgtctgtgttcctttgttagtctagcagcggtcggtcacgcttagcggtggccggtccggtgctagccttctcccgggttgtgtgttggcgctgtcggtgtgcgggtggtggtatatttttttcctttttcctggttacaaccctatagagttgtaatcttgtaattttttcatgatctatcaatagaacttcgcaccgttaaaaaaaatttggaaaaccgtatttctccagcgtaaagtaataattatattaacaatcatttgaataatgaaaaaaggaacaggccactgatgcgagatggcgatgccgcagcctaaagtcgtcgtgccgattgctgtagctggccggaatggtccgcgtgaacagcagcgcgaggagatggctcagctgcctcagaggctgggagccggagctgcatagtgctacagcgaaaggcagcaggggaggcacgacgaaatgggtatgagaaaagcaccgtgacagcgtccctttctccggcgcggatacctacgtgagcgaaagtgcacatagggttggggtcggattgaagcacgcgggagcgggacagcggcaagcctgcaactgcaactgcaactgtatcagaaattcgtcgtatcagtccatcagaatcagaccgatctcctcgtgagctgagctgctgccacgcgccatttttactgccatctcgttcatcatcgatcctgtcaaaattacggctcaaatctccgttgatacaacatggtttggagtttggactgtaaattcgtgccgattcggaagcaatcagagagagatagagaggggatgggtggtgaggtgatgtcactgcttagttcctgcttcttgtccgtacccatccgccgctctgggaggccgcgagaattcattcgctcaccgcctcacgatacggacccccgatcgcgacgcatattccaatttatctcaaaatacacatattcccatttctctcatacattcgttcgcgcgagtgtgggctccgcaccggtccaccaacaacgtgctactcctacctgcaaccattgcactacaagtctaccacctcccttttaaaataattatcgctattaattaagtgatgtagtatattttaggatgtaacgagtacaatactactagtagtaacatcctaacagggcaacacaatgattaattaactcatcacctgcagttaattaattagtgagccgctagccctgactcacttttcggcttgtatcaacgctggcgatggccgcgatattctcgacgccgaccgctcggaccatcacatatacggcctggccatgatctctgcagcgcgacacgcaagcagtctcagtgcacacatgcaaccctatcatgcatccggtgcacagtgcaagccgttggatgtctgtcgattcagttcgtacgtacaccggcccgtgcgctacataatgcatgcatatgcacgtagtgtgatgtatgcaagctgtaggtgggtacatgtgtcgtggtttctttcgtaccgacccatggccgagtctgtacggccattaattgcacttggaattttctagtaaaacgggtcaatcttgattaattagccatgtgcttaccttctactccctccgtcctagaaaaaaagaatctagtactgaatgtgacatattctaaaacaatgaatctggacagatgtatatccaattcgtagtatgtatcacatccagtactatattgattttttatgggacggggggagtactcaattctaaaacaagttaatcattgatatatcctaataatataaatctggataaaagaaaatatcattatacatacatgatatgatttcattccaaaataatttaacttatatatagatcacattatattttaggttaagttattttagtacgaaggaagtagatctagaattggtggctaaaacacatcagctccatgcatggccagttggccacagaaaacatggtaataagtgcagggtgtgcagtacacgaaatgaaaccggagcaaatagcaaaatcgatcgtccacacctctttaatcactttagctgctttaatttggttatagtggatgaatatgcatgcatgcgggcgtgtgcagcagcagcagtagtaggtgcttgattgacagtttgagaatgagatccacactctaattaactctgaagctgacagcggaccccatgcttcctgctttccctgacagccgtcttctgcaattatcggagtcgaggtactccctccgtcaaaaaaatagacaaaatctgattttcgtgtccaacgtttgaccgttcgtcttatttaaaaaaattataaaaaaaattaaaaagataagtcacgtataaaatattaatcatgttttatcatctaacaacaatgaaaatactaattataaacaaatttcatatgagacggacagtcaaacgttggcacagaaacccacggtttgtctttttttttggacggagggattagctacctatatagtcatgctgatgcgtgtcatcgatcagagtttagtggccacataaggtgtgcactctgggaagccaaagagaagagagcagtacatgcatcgccatctcttatactccttccttccgtcccataatataagagattttgagtttttatttgtactctttgatcactcgtcttattcaaaaaaaaattagaattattattttttttgactttctttattatccaaagtattttaagcacaacttttcgttttttatatttgcacaaattttttgaataagacgagtggtcaaacattgcaagcaaaaactcaaaatcccttatattatatgacggagggaatactaatttctaaccctgatttgggtgttactttccacttggcaattcagccaactggcgtacattatactgtgtcttgtcatctgtcactctcctatctcaaaccagaaatcactttgccgtgcatgcaaaggcagagcaactccatgtgtagattcagtaaatcggtagtaacattagtcatcatgtatgatttagcttttcgaacatattgatctgatgtgcatgtcatgtaaatacagtcatcaagacaaatacgacgtcctcgtcttttaataaaggaaataaacctcatgtaagagagtcaagttagtcatcttcttcatttaaaccatcaaagaaacatcagagcaacttccgcacatttcttagataatgaaaaacaaataaacttcgctctctcgctcatacaagtacagccacccttgtattagccatgtcttggcagctactcaatcgactacaatctgcaggttgctagtacacaagaagaaggacaagaattacaaaattaagacaaatggatgggtcaagacaaaattaagacggccaagtacgtcatgtaaaagcgtcaagtcaatagtcctttttttccctaacatattgtcaaaacaccaaaggaattgaagttccacacgaacactagcccatccatgtagattccttggcagccacgctcaacaaatttatactatgcaaagaaagggagggaaaaaaattaattaagacaaatggatgtgtcaaaagttagctgaattcgtgcggcgcaagagagcagatgaccaaacaatgctagtcaactcaagtcatgcagctcccttgttataattaattaatcatcgtattcgtatatatattgatatactgaactaatctgtcgttgttgttgtgtggttgtcatgcatatactgtcatgcagcccaacgtttagtgcgatccgacgcaggcaagcacgttggctactttacaccataaaaaggcagttttttttaaagaggacaataaaaggcagttaagcactgagccagtcattacacacaacgctaatcttcgtcctttctcttgtcctgatctgcaaggaagagtatatacagttctgtgctagctaccactcatcagcctaagtgatcgagagatgtggatcgatttgatccaacattagtgctgtgtttaggccttaggtgcagaatcataatgacggattgcgaaagttagcaccgagtaagcagcagagtcgtttttagctggtggtggctggcgccgccgccgcgcgcgccggtacggtcttcttctccggcaccggtgcggtgatgggttggtgccttggcggaatccaactctgcactgcagtctgctctgcactctggtcgacgcgtgtagaggacaggacggaaggcccaacaagtgagcaggtaggtctcgacaatgtgtttgggcctttagaagtcatgggcccaagcgatcaagttgcgggaagggaaagaagtccatttccagtccctctatagttcaaaatgacaaaactgcaactttaatgagaaaactatcagtttgctgcaacattagcggcatgtttcagtttgctgcaataatagcgtgaaaaattatcacaaaactgtaacttttatgttatatgctgctacagtacatatgtcgtggagggccgccctgcatgccggtgtgcttaggaaaacggagaaaagaaaaaggaagggcgaagaagaagaaaaggcactgacatgtggaccccaccacgccgcatcagcgaaaatcgcctttaataatactgtctgggagtcattttgtacctgttttaattgttgaaaatgctgttcgtcggtcgaccgacgggggagcaaaaaatcgggcgctccccccgcggtccgtctctcacgcacatgcatgtatattctgggtcccaccatgatctttattcccacctaccatgtgtctccatcacatactccattgcaacaaatcgctcacatattttgaaaaccctttattaagggaattcgtttcattttttgttccaccaaaaatatttcaactaatgtattcacaatgtttcactatgtatagatataatgttgcagtgaaccaaaacattctttcacaactaatcacctacatattttggaaaaccctctatcaggcccggcctgagggcgtcgagcagccatgggcccccacctacccccgaccctcaccccccccccccccccctccccctgcggccggtagagcagcacgagcgcgatggccgacggggggatccact

SEQ ID NO: 75037 - DNA, 11872 bp, Oryza sativa
ggattcttgtaaaaggaatattgcaaagcattattatggctgttgttgctattccagctaaagaacccagaccaagatttttccaaagaatataagttgctagtgtaatctgtataggcatcatgaagaccatgttcacataccatgcaacattaacaatcctctcgatgtcaacactcacatagttaattatctcccctgaggtatgtttctgccttgactggcttgataaataaaggaccttttggtatacctgagatatcagagatgttcttaggcgcaaataaacctgtagacttccaaagaaccattgtctgtaagcaagagtttcaatagccttcgcacctacaaatacaagaacaagagagtagcctctttcaaatccattatctccacttagatagcccacgaagtccttgattaagtatgcccccacaaaggaggcgactacacttaggactccaaaggttgcattgagtgccgccttcttccaaatgagaaggaaggctgctttacaaatcgatgaaactgtcagaggaaaattccctttcacaatgatattactgaatattctggagatgtgttgggcactttcctcctcaccaacatctggtatgtcatcctcattcaaaggcttattggcacctttagcaagaagaccattcatccaagagaaagtgaaatgttgtgaaatagttgcctctccataagaagatttcctcctgtttttcacattttcttcttttgaagcatctggaaatggttcttgtgtgccgcaggtgaattggatccctgttttgcaatgaacaaacgtgtatttgtacaaaaggagaattaaaaaaatctgatatttcttctggttcaaatgataattgacacaagtgtgccattttgcaaaaaccatacctttaatttcattttatggtacgtatgccaagtaaaacttgtgaactacactatttagttgcttagtcataaagaactcaagtattctttttttgaggaaaagccttagaagaggacagggagagcctgttttcattaaagaagaagagacttggcccagtttttgaggggaaaccaggcccaaaaacctcagaactcaagtattctattatatgaaacttaataaactgcgtcaaagctgtggtcttcttttctgttgttgcacatcgcaagtttaagcctgaaatatgttatttttccatgttgcccatttctcaataatggaagctttattaaaactcagtcaaatacaacaagatgatacattctaattgagcccactcccgacctctgcaagaaatgcacacagccacaaaacatgacctatctagacccccattgccttcttcatgctcttaatttctgtaacatactgttcacctgtctggctatctgggatttttcaaggtgtacacctacggtcattttgatggaaggtgaaggggaattacctcaactgaacagaggatgctggttatacagaactactaacatcgtaagaacattctatgattctgatgcagacatacagtacagttttaatctaatcaaggaggacgccatatgtgggacaccgcagcgaagtgtaaggagtcctagaacatctaccttaggagttaagagaatctatgagattgtatgtataaacatcaggtttctgcaaatactcttatctaaattcctaatgcctgtattgcaaatacatactttcagttcgcattaaagtgtgatagtatgtatgcacctttgttctcaggtagcttggcaaaatggcaggtcagacggatcaagctgctcccaggtattgtgttctatatatcattttcttcttgtgataatgttgtattgaaatgctccatcaaggagcgcctttataattcctacgtgtaggttaatcttatgcagtattattgattctattgtgtcccaaaaaatactatctattcaacttgctggttctaccgtatctttgtggggacatagtgaaatggttgtgatctgctccggaaggtaggaattccttccaaagtatttataaatgactaggaataattatttgaaaaacttctatttcagtagaaagcacacgataaagcaagattccattcacatgagcatgacaaaaattagcatgaatcttacctgattgatttgcagtttctttgtacaccatgttgaagccgttggcttcagctactgtttcgactagagattgtccttagctgctgaacagtaacattagtgtaaatcagcttacaacttagcacgggggactgccttgctagtagtttccattaggttatatacttagatgtcgtacttggattagtacagtcattaagtgcttaagtgcgtgtaaagtatgcgccctctaatgctcgattacttggctaacttttctggctcgacgcgtgtaaagacagtatcgtatgattcggatccaaccttgaggctcagatcaatgacagatcggcaccggtgtaccaatctgaatctgtgttgtggtggatgatcaaacgatcgagtataaatattccgttatctaatgtgatagctctgctttcattcgctacatgcaaccttttcttcataacaagtttttgtaaacttataaagctataacatatgtctacataaactagttcatggttaaaaaaatctacgctacagtggtatttacaactctgtttacatggtcactcacttcaggtcgacatgaaaaagatcgatttatcaagccggttaaaataattgcctaccatagtacttaaataactcaaactatcaaagttcaaagataatggtgtcttagttcgctcgcacgataggtaggccccaagttgatttgtgagaattgatagacatgtgtgcgcacctagagtagtggaatggcatggaagaatccggacacatacttgtttggtgccggaacaagttttagtttaggcaatttgtaaaaggttagtaaaaaaaaagttcatcgatccagtctacgaacgtggttgcatacaagtgtgataagcactggtggagaaaggggctttactcccggttttcaaaccgggactaccaatccgggactaaagatcactatctttagttccgggtgaaaaaaccgggagtaaaaatacatctgttaccaaccgggactaaagatagagctagcctagctagctagatccggttgctctattatttttttttcttcattatgtttttaatatattgattttactatatccccatcccaaaatcccaaataaattatccccaatcctcaaattccaaatcggccatattcaaatagatcacaaaatcttaaaacaaaattacatcacaacttctacaaaattcatcataaatacatcacatattcacggacatcatacacaaatcaaatacacagatccgaatcacaaattcttaaaaaattattgaattaaaacacaggctgtcgactgctgccgcgccggccgccggcgcgccacccgccacaaggccccgcggtccaccgccgcgccgctgcgccgccccctgctgcgaggcctccgccccgccgcgccgcccaaggctgcccgggcctccgccgccctccgcgaggccgccggcccccgatggatactgggaggtaaccagagcagttacaggccgcgttagagcggacgacgaacaatggcttattggggagggaaggagaggagttagaggagaggaggaggaggaagaggaagagatgggatgaagagataaggtcagtggaggaagaggtgaagagataaggctgcccgtctcctcctcctcgatctctcagatggcagatgcctcgtactctccgccacaatcttttgttccggttggtattaccaaccgtgactaaaaatagatctttagtctcggttagtaacaccaaccggaactaaagatagtaggcatcttttttcccggttagtgttaccaatcgggactaaaaatagatctttagtcccgattggtgttagattaaaaagcagctctaaacttttgaactgggactaaagataatatttaatcccggtttttattgcaaccgggactattgtggattttggctaaccgagcaaagatcgtttctccaccagtgaaagttactctcaaaactaattcaataacatgtggtgagcaatgtttgttatcataaagtgataaaccattgccgtgacaatgaccacactcgtgacggtaagcagggaaattctgtatggtggcttcccaaaataaatcaaacaattattccctctatactaaaacataaggatttctagaacagtgtttgtattgtttgtgatatttaaacacacattgtattgtttgcactcacaaatacactgtaaagtataaatttactagcttaaaaggtaataggattagtttcgtatggaacgcaccgtttgaaaaaagtgctaaagaaaccgaggtaaactctataccttaatgagagaagaacagtgcctaccatttgtaatttttatccatagttcttcgtatattttatattatgagacgttttgaattttttttaaaattaatcttctctgagttttattaaatttgtaaaaaaaaagcaacatctataatactaattggcttcattaaattcaatgttggatactttgtctgtttcatacgtaagtcattctaacatttcccacattcatatatatgtatatatatctagatttattaacatatatataaatatggaaaatgctaaaaagtcttacattatgaaatggagggagtatattttaataatatatttgttttatctttaaaatgttacttttttatataaatttagttaaaacgtcttaaaaaagagagggtagcaaactatacctggttaccatgcgggagtcatacggcctcatcttttcgtttatgcttatacttattagctaaattttgaattttcaacattaaatttggagttgaatttagggttttttcagcctttgcttttagatcactaagaatacgtatataaagtctttattcacatattattttccgtttgtaaatatgcagtttcgtttattccgcgaataagcgaaacgatggggccagtatactcgtatcattcgttgttaagggaactagctgttgttgcaccgtaacgccgtagcggccggctgctgcagaaaaccaagccccaactttttctgaatggcaaccacatctagcattactaccgagcgaagctgaatcaacaacaacaaaaaaacacacacacacacacagacaccactaccacatatacgcgcgtatcgtccttgtagaaatcagaatcggccgacatgatcgcgactttttcctgcgctgtatggtgtgtgagtgtgagccacattggctaataaaaaaaacgagatttgaaatgagaaatgtccctccaacattttttaaaaagaaattacgatttgaaggaagatgtttccctccaagtattttttaagagaaagttgtgaatgtgttaagaattgaacatgaaatcttgaagttaaaactacaccccttgcaactgcattattaacaatgtgagctacattgctaataagaaactgttatactgctaaaacactgttgtggcaataagctaagccaaccacacacaatgaaccataccacagttaccacagttaagttaacgtgacaaaggccatgttcggaactataaattctcacttttactcgcatgtttcgctatgcacatgtttttcgaaccgtaaacgatatgttttataataaaataaaagttattttaaaaaatcatattaatattttctctaaaagaaaaactaaaactttattaattatattatgagttaatggactacctcgtttttcgtgcgagcataagcttctttcgcaaacacagccacgaagttatacaaattttgacaatttgaccctttgcaaaaattaattatacaaatgaaccgtggccaaaacttattttaaaaatgacccttttgttcagtgcgaaatcccatggcgctgaaattagacacctcagcgccaaatagcacggcgctgaatacacattggcgcgccgactcagactcccatccacggtggcacgacattcaattccagttgacgtggcgctgaggtgtctaagttcagcgccataggatttggcgatgaacaaaagggttattttttaaataagttttggccatggttcatttgtataattagtttttgtaagagcaagtttaatagtatagccaactactaattccaaattatctatagccaatgtaatagccaattcatacaatacttgcttactatatatactattaatacctgatcccacctgtcatacacacgttacgtcttggagtccgtgctatggttacagatctgtagtccgttactcttctctctcttcctttatctctttaaaatattactcttctctctcttcctttatctctttaaaatatgtttatagttggcttatagcctgctattgtacctactctaaagggtcaaattgccaaaatttgtgcacaaagttaagcactgaaccaaccactggctcacttggcacgccagttttttttaagagagaaaattgtcagataggcaatgtggtgcaagcggttagatcaacgatggacgatcccgattagcccgcctcgcggttcatccggagaatcccaatattctgaccgccaccgtgtccctctacccgccgtcacccctgggcttcgccgccggcgagcgaaccccgccgctccccttccgaatcccgggccgacattgcaagccggtgggcatcgccagttcgccaccgccatctggcttctgccctgaccctcccgctcggatcagcgcgtgttaccgcggcgccggatgaaccgcgaacgccgcctgcctgctcgacggaatgcctgagtggagtgaggcacgctggcgcgtaagtcccctcgctgaaaatctcgctccgttgtattacctttatttgtttttcaagcaattacattcggactatgagtagcttcgctgcattgcatgagttgggggaaagtttcccccacttcagcttgagctcatacttacagtactctacataaattgtgtttcttttctttacttggggatcatcctgaacctaagagctagccaacatcaacggtaggccccttagttggtgtatatttctgtgggttttgtgcgttctttgtcatttgggatcgtgtggagtgcggcccctttctacccaagtgtgttgttgtagtgcgcttggttggcttcatgctgttctcctcgcttttcaaattgtagtgtgccgcactgctaaaagccctttgatctccgtgaatactcctttatgagcctagagaattcagagttctcgttctccagtaatttcaatggtgtgtcgtactctatgattcttcctgctcgtcagataagagcgcacaatttagtggcatgtaaaaaactggcatgtgtttgtcaagggtgtggcttaccttcactgaagacaagaatgagatcactgtcaataactgtgtgaattctatgtgctattgtcagcacggtgcaatccctgaattcatcgcggattgtttcttggataattgcatctgtagaggagtccactgaagcagttgcctcatcaaggatgagaacattacttcgttttagcagaaccctcccaaggcaaaacaactgtctctgcccaacgctccaattttccccattttcgacaactgcagaccaaatcttatttgatcatttcataacttgtggtaggatttctaatctgatccctacttttctcaaattttaccactgaacccaaaaaggatacattacctgttgaatccagcttcttcgggctctgtcgaactatatcaccaagctggcatttatccaatatctggccagaaggagattaaacaagatagctaatcaaataatagaataattgtattctgataaaaaaattaatagaagaattaagtttcgttttctatttgacacagttactactcactatacatcacattcttacagtcttactatatccatattgatttcatagcaggtacccattatccatacatagcaaggtgttatttaacatggattatgatttataagcaataatagctatgatatggctaatgatatgtagagtaaagctctctacttcatatgatgaaaaacattttatttatcatgaaagtgtgcatagttggttaattacctcccatatacgttgatcagagtattcattcactggatccagattccctctcactgtgccttcaaacattgtaggatcctgtggaatgatgctaagtctgcctcgtaaatcatgtaaccctattctgcaaatgtcaatattgtctatctcaattgttccctcccttggttcaacaatccgaaaaagtgcttgaatcaaagttgactttccgcttccagtccgtcctacaatccccacctttttccttcctggaattgtacatgatatgtttctcagaacagatgggagatgctctgcatatcgaacctgtaaaatagtaaaagtgaagacggcatttggatggcttcatttgagcaaagactactaatttaagaaaatttataaataaactttccttttattgtaatattgatttctttcattatacagaaatagaaataaattgtcacttttatcatttctgtttccgattcaagacactctttttctcttatgcaaacatataaaagtgaaaccatgacaagcctacttcagagatttttgtatgcgttcttgttctcctcttcaatagaatattatcaggaaataaagcaccttcctaagatatgttttccttttgaaaatttttcccgagtagtaattttcatttaggcatttattgttctttttcaaacttatattgttttctggtgaactcatcctgatgataaaatttattttatttctgctaaataaaattatatttgcattataaactttcttgtctagattcacagctcatagcaccattgcacttacctccaagcatcttatattgatatttccatcaagtggccagttgtttggggggcggcgataatcaactactagaggagcctcactagggatccttgagtactgcaaaattctttcaactgatatcattttgttctctgtgttgcagatgttccaaataatagatgccaactgtgagttgaggttcaatgcataggtcaccgcaagtccagcaatgcctgcatgtacaatatataagtttgaaaacagccaacatagagtgacttaatgcttccataatcaccaagagcctaagttcttcttagagcttacttggatttataaaaccttcaggaaggctcactagcagggtcaaagagaaagcaaagacaaagttggataacatgtttagcctgaaagaaagccattccattgaagaaatgttatggaaccatggccgggagtgattgtcgacaagtccaaggtttgattttctgaaacgatctttttgtccatatgctcttatacttgatgctcctgtaagcgattctgcaaaatggtgtaggatgggagccctttggatttgtgataaacgagccaattctcttgctgttggtatgtagtatcgctgcacattacacagagtatatggtttcagtattttgtgaatgaacgctataatttatggagaaaaggtgtacctatagcttcttggaactcatcgtggtgcacagagtgacttttgcacatggtgctatggtagtacaaaaggctagtaataaagtttttttttcttgttgggagttcatacctgacacatgaaacagaccaccgttactggaacgaagatggcaaaaactggccaggcaacctgggacataacaccaatggtccccagaatttgtatgactgaaaatacgcaccaaccaagcttgtttgctatttccagatctagaacactttggtcattggaggcctgttaaagcataaatacacacctattagtttaggggtggagagagtacgtgatgcagtataaaatggtttacaaactaagtcagtcttaaccctgttcagaattcttccagtaggcgtggagtcaaagaaggacattggggctcgcatgatgcagtggagcatgttcttgaagaacttttctgatgttagtagcccaattagtgaaacaagcatggaccgagcaaagacacacaaggcacttccaattgacaatgctatgtatacggcaaacatgagccctaatccgacagttggcctggttgctgatgttggaggagatgcccatgccatccaatagttgcttgctacctgaaatatttggaagaaggactgtgctgcgattgtgactggcactaaggcacctccataaactgccctcaggtatgcccagtaaaccttcttgccaatacctcccttttctcgctcttcatcttgtgttaacctccctttctcattgatgtcctgtgatacatcatgtgcagactcttgctttgttataccctgaatttgatcatctgtttcattttctgcttcaaactcatcatcagtatctgctggtttactgttctcagtggatgtcactctgctagaactttcggcatttatgacagactcaagagcctggctgtgggctcccactatggcttcaaatcctatgttctgttgaagaagctcatcaaatttccctttctgaacaatgttcccatcctgcatcacctattttttgcatcgacgtgttattatttaacaacactaaccttttgacatgattatctaccaaaaagtattttagatacataccagtataaggtcagcggtaggaagaaattcaacttggtgggtcacatacagtattgttttgtctttaagaattcccatcaggcaatcctgccaaggcaatttgtttcatttgcttagagtctaacgattattggtctaaaagtaacgaaataggttttgcccttttttttattaacgttatgccacgaagaatggagttaatgccacgaagaatggagttaagacataaccttcatacttgagcatttattgaaagttttaaacaaacagaacaaaccttgaaaagttggcttccagtatgagcatccactgcactgaaaggatcatcaaaaaggtatatgtctgcatcttcatatactgaccttgctatctgaattcgttgtttctgtccaccactcatgttaattcctctttcaccaatctccgtcaaatcaccatttgcaaacaactcaagatctttagtcagcgcacaagcttgtattatcttgtcatacttttctttgtcatatggatttccaaacagaatgttgtccctgatgttcccagacaggatccaggcgctttgaggaacatatgctttgctcccactgaccctcacagtcccagctagctttggcatctccccaagtatggatgataatagacttgattttccagatccgaccattccacagattgctactttcatccctctttttacttttagttctacgtctttcagagttggagatgttgtctcgagttcccagctgaatattccatgatcaatctcaatatcatattctgtgtcattcctgggtatttcaataactgcatcatatttcaattcttcttcctggaggtatttggccaccctatcacctgaaacttttccttgagcaaacactgaaagcaagtcgggaagagtgaagattggatcttgtagcatccggaatgtagcaagagcaggccaaacagtaccagcagtcaaaggaattcccatcaatatgcatgcgcccaatggtaaggaggata

SEQ ID NO: 75038 - DNA, 3293 bp, Oryza sativa
ttatttagacttcattctcctagtcctattcctgattgttatttcggattctgtgcctgggtggtatcttcttactattgattcaacctcttcgggcaaacgttgtcacttcctttatttgaaaaaaaaggggtctagaactacagtgatctgataccttcttcccttggtctgggtaggtaggttatgtaggctacaactgttcataggttgttcgatcgcaaaatgccaaataatcgattactagtatgccggatattgcctggaggcccttctccctatgtttgactcatcctagatgggttcacacttgtcgattccggtcaaagaaaaaagctttttcacggtcccatcacaccaatctacgccaagataaggaatgctgggttgccaggaacaaaccctgtgattcaaggttttgcctagaattgccttaaaaaaaatgcaccccattaattgatccctctttagggtagtataagtacatcctcgactatagcacgagtagagtcgagttctcgtactaacctaagagcagatatgccgaaatatttccacgttcaagcagctaattagtaaacgacttctccataacagtttgaagattggctcgcaacgcaagtagcggcaagaaaggagagcaagacttccttttctaaaagaagaaagaactagacttctataagaagattttgataatcgtagatcgtggaatattcatctatcttattaggtaactactttagctgctctcgaaactgaaccatcgtgaatagaactagcgcttaaggaagagtaggatctgttagcaagtcatattcaatcacccggtcttctccttcctagcttttagatagccctgattctttattggattttaatacacttagccgtgtacgtatcttggctaaactcgaatctatagtttatttaatactgatgtactcggtaaagaatcaaaaaggtacttgaagacgactttgaatgggaggaggttttctttttatccccccctaacctgattttgatgtcttcttcgttctcagtccctatggtccattgtaggatgatttttctaaggccttgaattcgttggaaaggtgatcagggtcctctccctggtcctatcgaaccagtgacttctctcctgggattgaatatgttttgcctttccccgatggttccgcattccaatgtgggtaggatttgccaggatgagcggcttatttagcctatgcgaagcacgaagcataagagaagagtgtagcgaagcgagtgtaatacttgtagcgaatataagtagtgtcaaagcctacactggcttagctctgcagatgttttcaggacgaagacggtgatacgataccactcgccagtgatgataaggttcactcatagcataggtggaagatccatccaattttctttatagatttatttgttcaaagaaaagacgcctaaaaatcattcagggctcttggtatcctttaccacattcactttccatattccctttttttagttcagacgctatcatacctcagggaaaataaaatttctatcaacgattcccacccaactttggaatgactctcccctctctcccttaacatatcgaaggcctcttatccgtcaaccggaccttaatagctcagacttccaagccttgttggatgatgcagaagggccaacatcagaggatcaattgaataaccaactctcccgccccgctgccgctactgctccaaagccaacaaatgcacttgctcatcccaagcatcactttccacaaatagtacccagcgtgtgtcctagccgccgagggcactcctcttgaggaggcagttttcgaatctaatctttctgtctgcccataagagcgggacggtgaattaccagtaggggcaggcccagaattccatgtacgcctattccacgcccctcccccctgggtgaggattagctcctatgatttgccgatggtagtaggatttcctatcacattgatagaagggaaggtcatctactaatagttaaacggaataagattagttacgaggacacctgctaactattagtaaagaaagcaatagttgggccctagtcgatgtgctcttatttgaaatctatagctttttggccgggtaagaaaatgaagtagtagtctatcaggcagtctaattcgtcttctctaaggtcaggcagtgaggcattaagaaagagcagcagcgattttgtcaagcgaatagaaagagctgctcgttaagcaagggatgggtttgtttgcctgtataggtagaagcaccggtgtattaggtatcaaaagaaaggcatctggataggtatttaatcaaatacttcttccctcataccatacttatctacttcgctttatttaatatgtttattgacccgtaaatcaatgttctactctctcatggaaaaccttctttgtagtaatatgaaagcttatcgcaaagcatagaaattaatagagcttataatcaggtcagatattccacttgctcctagaaataaggtaaggttagttagcactttcatgccaactttcatcagcaagcacttatataaggggggtgcgttaacagaggaacttgaattcccgctggaaaagtgaaatagattcagcaccaggcggggaacaactactccttttttctttcctcaatcctcaaacaaaataaaagtattccgttctacttccaattccagctttcgatacacagaaggaaagccatcccaacctagagatgaagccaacaaaccactatctatattttatgtcgaccaacaatcatatgtctgagagtctggtctaactaagcggattggaggcgggcattttcatttcaacgtagcagtagggaaagtgattttggggggttagtacacatgggcagttgggacagttacaggtagttaagtttggtcttattcttatgggcaagtggtcctagaatctctctttccttctctaaagtatagctttacgaaactagaatatgagtaaatatagaaatagaataataagaatatcatatagccgtttattagtaaggataggttttggtgagtagtagttcttggcattagtaagctagcttcactagactatctatgacaggaaattcggtaaatgcacaatatcttttcaatgaagaaagattcataggaaatgaacaatagaaagagtactattcttcagttactcttttttcttgtcttagaatagacaatgtgtcaatggattagctgactttactatgttcctg

SEQ ID NO: 75039 - DNA, 33542 bp, Oryza sativa
  unsure (1)..(33542): unsure at all n locations
ctttgtgctcctgaaaatgcagggatcaggctggacaggcagttacatgaagcaatcaacaacaaggtgagtactaatatatgagcaattccaagttgttcttcctgtcagaaacaaaatgctcaaagattgctcatttctttgcatctttgttccagcaggagatcatgcgtgactcaaaggccgagcaatcactaaatacagctcgtttgatgaacaagcactgcacatccgatgggcattgcaactcaggtacaatggagcagacgattcccagttcttctgttgttgcgaaggatagcgaagtggtcagtgcgattgctcggtctgtaccaaggttccatgaagattactacgggccaagtggccatgaacctaatcaccattaagcacagctagctagctacatatcgccttaattagttttgcccttttctattttagcagcagcagcttactttcttagtagtgatccgtagtagttcttctctcctagatcgatgctgcgttttggctggaaaatgtaaagggagaagtattatgtagttcttcaccaactagctatgatcattagtaccgtgtgctacttgagtctagttcattcatctcactgctctcttccggataatctctgctaattgcatgcatcggtttccgtgcgtggcccacagttcgatcgatcgattccgggcagtaacgatactactagtcagtgatgtcagaacagtatgagatcccacagtagaaactcagcaccacagtcgccgaaccggcatgaatgaacatttgggatcttgtaaaacggctgtaaactgtaaaattgctagtgacgctagctgcagcttttcgcatctttcaccttcctctggcagctttaacccgactgttcttttacgacgtttgatgcaggaaaggtacaaaggccagtggtgcaggctgaggcaggcgcagcagcgaagcagcagcagcagaatcaggtcagtccactagtacactgcactccctgcaggctttcggagattcagctgagcaatcttgtcttgtcacgcatgaaaatggaacggattaacttacctccggcgatgtgaatatctttgcagagcctagagagatcaggtgatgccaatcagcaggagcaggagacggcgccgcgacagcaagagaagacgtcgtcgacggctacggcgacgatgacgacgtaccctgacatcctcgacatcgccggaatggactattcgccggcgacgagaaagccgccgatccacaactgagtggcacgcacgcacgcacgcacgcagtactagctagaaagctggtactttcactggcttagtgcttgctgtattagcttagtttagcagtttagctactagctagctagctagctatagcttagccatagctagctgctagtattagctaagtataattagcttagctagcagcgcgagtcctgatcatcgaatagaatagtagtgcgtacagccagtgaccgatactgggacagcattgcaggaaatgctgcaccttttgtgaagaagatgatactacaaagcttggcgtctctctcgtgtatcccgcggatgtaacatgcgcgcctgtgtaacaccgccattttgaccgctagctagctaactaattactccgtagctcgtttgagatctctcccattcgtcaattcgtttttctgttcttgatgacattctccaaaagtcttttttttttagaacactccaaaagtccaatgatactatattcactcagtgagatggagtagaccggttaattaagttgcacaccaattctacttgtgacgcgagtgatcatgattggtactatattccagcatgctaatcatactatctccatccaaaaatatatacgatgctgttaattttcatttaacgtttgattatttatcttatttaaaattttagtataaatatgtaaaagtacaagttaagattatagtttctttatgataaaataagtcacaacagatcgaatgaataaatatttataattttttaataagacaaatagtcaaacctcacataaaaactaacaatgactgaaatgatgtgacactacgtataacgaatctaaacatatgtagtgctacatcctaatttatacccatccgtctaaaaaaaggtcctatactagctgtgaacctagatatatatgtgttcagatttgtagttagagtttgtttttttggatagagtgataatttggaacgaatgaggtagtagatactactattaattaagagatggatgggttggtgagagaatttgtcacatgcatgccgggtgtgttagccaaggtttgcggcaggacgcgcgtaatgggcgcggcccgtacgtgttggctcgtgtcgccggctggagcggacggatcatggatgcgcatgcatatggccggctacatgcatggacgaccctggcacacgttgctgtcgcgcgcgcggcggcgagacatcgctgtccggcgagaggcgcgagatatctgcgtgcgccgaccgatccatgcatatctcttctcgtcgcgcggcggccactccgcggcgagatggcgatgtcaagtgggctacggcgtgccggcgccggaggctgcagcgctcgcgtggtagaccagcgccgtgcgacgcgagaggcggccggccggcaagacagcgaagcgccatccgtcccgtagccgtcgacgccgactcgcgcgccgcccggttggacgtccggtcttcacaaaccgtttcttgactcttcaaagccaataaccccaccgttgcaaaatataaaatgcactattctctccgttctaaaatataagagagtattttgtttctttaataaagtatctaatcttattaattaaaacaccatttatgtgatacaagagcatgttgataaataggtatttaaggatatgaatatacaaatttaattttatgtcacatactttcactatttaattcttattctatatccggttttaaatagatggtgtagtttacttttaaacatatgtttgattgtttgtcttattaaaaaaatattattatttatatttggtgacttgcttctcattaaatgtagcatgacttattatttttaattttcatatttgtacaaataattcaataaaacaaatcgttatttaaaagtcaacgatttcatctattaaaagccggagccagagggaatacacaagttaaaagaaatttgtagcacaatattataaaatttctttttgttatatatgataaacttgaccgaagagcaataaagtgcctggttaaccgttaactaatttgctttgtgctcaaggatgtaaggtgtgctgcgtgcacacaattacgacgttggcaacttgtcaattgtcatgctaccagcttatgaacctgtcagccggttgttgtcaagcgttggaacttggaagtgcagtgaaaaaaaaagagagagtgagagagtagagtagcgccagtatacaatgggcctgaagtaaacggcacagagcacgtatgcttgccagtatgccactgtaagtttctgatgttttcttactcgatcgatcgcgttacagaattgcagtgtcgcagactcgcagaacagggattaactaggccttcacttctcttctgtcgcagcatggtctcatgcgttggaatgtgtactgttctagttgcagcagcagatagtgtagagacgaagcaccatgcacatttgtggcagcaacctatatatattttcagtttctgacgcggcctttttgtttactgttttctctgtgcttgagttattcttgtaggctgtatgctgacaaccagctgacaattttgatgattgccttgccttgcctgcctgcgtgtcatcagtcgtcactctgaagcctgatcgattggagacgaaaattagtgaggagtcacatgaaacaagacggatatgtatgtattcagtgcacgcccatcctgtcctcgatttttctactcgaccagaagacttgataacccctactgaatgctcacgacaaaccgaaaaactcaaactgtttcctgaatatatttagctggatttcggtggaggatacacatgttgacctgtgcataccctcaatcatttccttgttttatcttctttcagaaatttaggtcgattgatcggaggagaattctgaagtcacaaaacgaagaaatttacttctgaactcaagttctgaattggtgtacactccggcttggcccattaatctttaggcccaacttaaactccaccaggctttcatgggccggatgccattgggtaggcccatttaggcccacaatgggctgattgggccagattacacgtgcgacgtatctgtttgacctcccgtaagactgaccggaaataggaaagcaaagctgcatgcagaaacgcctggcgctgctgctatttatggaccagttttggcgggtgcaaaccgcggggcccaccctggaggttcgtctcctcgcgcattgccatcgccgagctcccgaaaatggtgcggtaacgggagcaatcgcagaagaggactggaggagatcgattccccattgaggacgtgaaattggattctgtggcagaagaaagatcgatcgatctggtttggtctggtctcctgtaaaagaattctcccatggcgccgccggccacctcgctcatcggcggcggcgtcggcggcgtcgcctatgtcgttctgctcttgttcctcgccaacgcctgcgtctcggatgctgggttcgaggtatccagccgtgttctgatgtcaggtgcgtgcagatagcgtatccatcgaccatggcttccttcttcaagcctgatcagtctgttgcaattcgtgacttgcaccatggtgacatccagatgagcaaggaagaagtgggttgctggctacatggaggcgattgatcgtcgagacaccgtcgccgggagccggtgctgacgctgctcatccaggaaccaaatctcttccgctggccgcggcgaggactcaccggagagaccccctcgccaacctcaccatgtacagcggcggctggaacatcagcgaccagcattactgggctgtaagtacaccaattcaattatttcctactcctgtaattcagtaattaattgcttctccatgtgaccattaattcttttgatcttgtgcatttctgttccttgtgcagtctgtggcatacaccgcggttcccctcatcctcgtcggcatgctgtggttcatcgtcttcgggatcgtcctgctcatcatctcctgctgctgctgcttctgccggaaaaagtacaacacctactcgccggcgacctacttcatctcgctgatcctcctcataatattcaccttggccacaatgtaattactcttaaaccatatttcagttcttatctccagttcgccattactttgatcgatcgttcttgccttgaactgaactgatgaagaatctttctccttttgttctccgtttggtgattaatttcagagccggatgtatcatactgcattgtgggcaggagctattccacagtagcacgatcaaaaccgtggactacattgtcggacaaggcaatctgacggtggatagtctgaggaacttctcaggtagcttggctgcagccaagaacatcggggtggatcaggtcttcctaccagttcaagtgcagcagaagatcgacgtcatcgaggataagctgaattcttctgcaaatgagttctccacgcgcgcgctcgaaaactccaagaagatcaagcatgtgatggacaagatgtgcgtatgatggctgcgtaataacccaatcagcactgaacttttacctggaaaaatctgaacgtattcattgtgatttcccttttgttttgttccttttaggcagtacaatttgatggttattgcagctgtaatgcttggccttgcgatattcggattccgtaagcattaaccaatctttgacttgattctgcttgtactgtcaaagcttcacttgcaactgatcttggcttcttttttttttcccgtgcagtcttctccatcctggggctgcggtttcttgtttccctgtaagaaaagctgttctaatttgcagctaattactgtaactgaatatgttcctgttgtttgctaatctttacaaactcccatctcacatgtatgcaggctggtgatcgctggctggttcgttctcgtcatcacaatcatgatgtctgctgctttcctcctcctgcacaagtaagcctgaatttttccgatgaagaaatgcattcgcagcgtgttcaggcactgacactgacagaactgggctggcagcgtggtcgccgacacatgcgtggccatggacgactgggtgacgcacccgcaggcgcacacggcgctggacgacatcctcccctgcgtcgacgtcgcgacggcgaacgagtccatgtaccggagcgaggaggtgacggtgcagctggtggcgctggtgaacaacgtcatcgtcaacatctcgaacagggacttcccgccgtcgttccggccgctctacatcaaccagtccggcccgctgatgcccaagctctgcgaccccttcaacccggacatgagcccccggaaatgcgcccccggcgaggtcaacttcgacaccgcggcggcggagtggaagaagttcgagtgccagaccaccgggccgcccgggtccgaggtgtgcgcgacggaggggagggtgacgccggcggcgtacgggcagatgacggcggcggcgagcatcagccaggggctgtaccagtacggcccgttcttgatggagctccaggactgcagcttcgtccgggagacgttcacggcgatcagcgacaacaactgcccgggcctcgagctctacagccggcacgtctacctcggcctgctcctcatctccggcgccgtcatgatgtccatcgtcttctggatggtgcacacgcggcagcggcggcggcgctcgctcgggctcggcaggtagatgtgaagagtgatactgtacatcgcaatatggcatgcctgccatggcagccatgccccgcacctgttcatcaatctgatctggtgatttgtactatatgatgtgaatgatgtcaatatcgagtatattttggaagtgaaaaaaagaaaatgtttagctgctctcttaagctagagaaaatgcgaggttaaccactaaaaaaatcaagaacaaaaaacagatattccaaacaaacattttgaattcagataagttaattttgctcgattttgatcagtggtaaaaaaaatgttactcctgtacataaaacagccatattgtccagccagaattaagaagaaagggggagtgatgagtgactaaaaacaggtttgcatcgtgcaagggaaaaggacaaatcatggtgtgttcgggatttcagtgttcagatgttttgcttctccgtgactctgtaagctttgtactccctccgtcccaaaaaaaaggcaaaccttggtttcccgtgccaacgtttaactgttcgtcttatataaaatttttttataattaatatttttattgttgttagatgataaaacatgattaatactttatgcgtgacttatctttttaatttttttcataattttttcaaataagacgaacggttaaacgttggacacggaaatcatagtttgtcttttttttttttggtacggagggagtagaccagtcggataggccatactttggttgtttcttactacagattggactatgctatgcatgcttgaaaactgaaataattgagaatttgagatctcatgaacaatttgagaatttgtgaccatcgtgcagacttggagtaagcaaatgcaatgcaccttcttcagtagagcatgtgtgatctagtcatctacaaacagttcacatgttacctactactactaggagtactgcatttggcgaaacatatggagaaaacttcatggtgagacgacatacgatttaatctgctgatgtagggggtacgttatccgttaggcttaggcattgattaccttcatggagacagtcctagtacatgacaaaagtcacaagcctcacctgttcccttgcccgtgctgccgtccgattcgtactccaggaaacggacggcccagatcacccgcagttcccagattcgccagtacaatccttcgcttgctataaattccggcgacttgtcactcggccggccgatcatccgatcgggcagaggcggagaagagagtcacgtgagcggagaagattccggcggcggcgaagtgaagtgaagaggcgatgggaatggactggtacgcgtggctgtcggcggcgaggctggaccaggcggtggcgtacgagtacgcgctggtgttctcgcgcaacgagctggaggccgacgacctcgcctacttcgaccacgagttcctccacagcatgggcgtctccgtcgcaaagcaccgcctcgagatcctcaagctggcgcgccggagccgccgccgcgcggcgctgtcgtcgcgcctcgtcgccgccgtcgaccgcgtcgccaggtacgtgcgcgcgctcgtcgtcgtcgtcgtccagggccgggaggacgagtcgtcctcggcgctcgtgctcgtgccgagccagcagctgcagcccgacgtcgacaagacgccgaggaggagcaggtccaagcccaagtcgaccaaggaggtcgccgccgacgccgccgctcccaccacaccgaaagccatgcggtcgccggtgctggccatcggcggcagggccgcctcgacggtgcacgccgtgaaggacggcgagaaaggcggtgaggacatggtcaggtgggaccgcctgttccaggacctcaagcccaactgagcgcgcaacgacgacgatgccgcgcgtgatcgcggcgccggcggcggatgcagcggtgtgttactgttagggtttaatgcttgttcatctccatgctttggtaatggtcgagcactgtgctctttcttcctcctgcatgcacagttgtgcactgctccggcgccattgctgcatgtacaggaagcacggtgcatcgtgccgatgcgacgacagcaattcacgccattgggagcggtttgggttgctccacttgtctgtagactagctcgtggtgaggttattgctgtacaataaatgcacatggagtggttaattgcgattaatcgtgccaacgaaaatcaacaatgcctcagtaatttccgtgatatttggttcatacacgttacatgtccgtgtccccggccgtaacagaaaaaaagaggtactagtggcgaatctccgattcactaaatttctgaagagcctccggccataacacaaaaggagatacttcaatctcactaaatttctaaagagcctcctgccgtaattttattttggctgtggctacagtgtatctgtggatgcaactgtaactctcaccaattttagctgtcttccagacttcagagcagaaattgatggtttttttgtcaaatactacctccctcccaaaataagcgtagtcatggatatccgtgtccaacgtttgaccatccgtcttatttgaaaaaattataaaaaagttaaaaattagtcgcacataaaatactattcatattttatcatctaataacaacaaaaatactaatcataaaaaatctttcaaataagatgaatggccaaacgttggagatgaacagtgcaaaactgcacttattttggagggagtaattaagtggaggttgctcactagccctcttgtagttgttagtacgatcgtatactaagttttggttgcgtcagtacagacgtactgtcatgcttgattggtaatcatagagcagttaaacatctttttctttcgtatatgtgtggatgtgtatttattatatccatgtatattggatgcttgtaaagcggcagtataatctgatatgcaagaaatgagggcagggatgcttcaaggttttaaaaaaaaaaactctcccaaccaccagaatgaaggccgagtttagttctaaattttttcttcaacctttcaacttttccatcacatcaaaactttcctacacgcacaaactttcaacttttccatcacattgttctaatttcaaccaaacttccaattttggcgtgaactaatcacacccgaagtggagtatacaagaaatgagtgcatggcataaagaaaggaacacagaatcacaggcatacagtaaactgacaaccaccagaattccaagtcctgagattgtctcgtaggagtaagtaaaactcttatgttttcatgctagtgtaaactgtagttgttcagtttttattgtcgtgtttctgcttcacaggaaacagcctgctggttggttgttgtcggtagatggtgctattgtagacggaataactgcagataaacttctgtaaatacaatccaaccaaacaaccgtacgccaattcataccatttaagaaagacagtaccacaaacattacagcggtgtgatttgcggccggtaaggccacttttggtagattttgtggatgtacgggcagtgaaaacaaaaatgtaagcaaacagtatcactttgacttcagaggtaactggaatgtgcaattcaagccatgaaggattgcatttgtcgtaatttaccccccaaaattattattctagtggatgatgaactctagccatcggaaaaatatccgttttgacagtttcaacatcaaaaaagaaattagagctgttatagcttccctttcccaagtaaactctttagagttgaaagtactggcagaattgatttctaacatgaaactcttactaaaatactcattcacaatagtagttagttcatggcaaacatctagagaaaaaattggacaaaatggtcccaaagctacttatgctaaaaaggttaaaaaaatataatagatcagagttggagatataggggaatttgaaaagatatttctctacttaccgtgattcgttgttgaactgcatttcctctgtcacttctgagcataccgtacgcaattgttcttctgttctctgtttcttcatgctctgtcatatgatgttcttcatttccccaactttgtcttcacaattacatatcttttagcattactaagcatgggacttcatttacaccctttgttagttcagtaacaaaaacgaagcatgttcagaacagctatatagtactatatatggtctaacatttccttcacgatccaaatttgaaactattaattagccagctagtacttatctagtagtatctcctttatggcgtcacaatactaattttatagctaacagtcggcgactttgattttttttctatttttgggttgggggtgttggttatcatggcaacttctaacaggaagaataaaatcagaagaacaaaaatgatattagataaatacatactatcactgcactacatttcttgcatccagcgctggttgctacagtatgcatctaaagtaatctgcagtaacaacttcctcagtatcctaaaaccatagtacattcttgtttcatgtaattcaggagcattagaggttagttttaaagtgaactgacaaatgcatgggaattatagcctgtctcagtctcttaacattcacgactcaaaatttcatataaactctgcaagagtaatatagtaggccaaacgcttgcattatcttcagtgttctttagtattccttcctttcccacaaaaaaaaatggtaaggaatcatattcagttttaagttatgctgaaaggtataatgcttaaacttcacagagatcaagtattgttgtttggaaaagggtataaatttaagcttcaaagtagggagtatgagactaccactacttttttcactgaaacagagtaatggagaggaggccctatctgaagatatatttttttttcaaaactctattggcaatctccaaatcaaaatttccatagcccacaataacaatcatcggcaaagcagaacatatgaatatagttgttcagcagctggattcaactagaaaggtcaaataagaagacagaaaaatgcactactttactgtagtcagaagaaactagaaacctaactgtatattatcagactttgtggacataagaaaactgaaactctaaaagtgttgagaacaaaggaatatatacctgacatcattgttgaacagttaaaaatgagcacaatgctacattacgagctccacttgaatatgtgtagaacatgcctaactagtgattaaagcaaatggtgaaatggtaagcataatgaacaaaatgctcctggagttctaacttttagtctaatttgttgtaattcaggacatgccaaacatgccgtctttgccgtagaacattctctcagaaaatatgcaatagaacatataacttgcaaataaagactagttatagatgtagctaatagaaacaggacaaccatactatgcgtgacacttgtatgattacattcgacatggtatgtgatccaacatttatgatttattatgtcataagtactaatgaagttagatattggctagtcaaatgaattcattaaccgataaaactatattagacagaagcagctccaatggaggcttagtattattagttgcataagcattccatgcgatgctgggggactacagactactatgtacattgcgaaatactgtgaagcacacataaattcttcactggtttcggcttaccaggcttaagtgcacggcgagaacatccctgatcctctctccttccttgtctttctctccttcaaagtccgaaaatagttccgcagcggcaccttcctgaatttcctcaggatccggttcgccgcatttgatgagaaaattatggagaagacagccagcaaccacaacatacggcagtgcctcttggcactcacccttccagcattcgtcaagaagccgccaccgtgatcgcacatgcccaaatgcattcctcaccagccgcatcccgtgtgaatgcacattgttgaagatgctctctttggacatgccattcttggcgtccatgtcattatacggcgtcacgagccatgggagcattgggcagcatgctggccccaagaagtagcgcggcactgagccgccgatgagctcgccgtgaggagcgttcgcgagcaccagtgactgagagctgtacagcttcgtccgtgggaggatttccgccggcgccatcgcggtgtcccacccgacggagacgtcgagaaagcggccctcggcgtccaccagggcctgcgcgatgacggcgtccccgatccgcgcgtagccgagcgcgccgcagcagttgggcagggagagcgcgcagaatccggggacggcgcgggcgatgcggtcgggcgcgccgaggtcgagcaggatggcgaggcggtcggcgatcgtgcggcagacctcgtagaatgcgcgcgcggcgacggccggggaagggaggccgaaccggcgcgccacggcgcgggcgggcgcggcgtgggcgaggcggaagagcgcggcgccgagcttgtggtcgggcggcagcgcgagggaggaggaggaggcggcggcggggtcggagagcgcgagggagtggaggagctgaaagaaggccggcctggacatgcggaacgcgtcgcgccaggcggagtccgggagggagtgcgactccgagaggagacggaggaaccacgaggatgggagcggcggcgacggggccggcggcgacagcgacatggaggtgagcgtgagggtctggaggtggagcgggagcatcgcgagcaggcgggacacgccgcgcgccgcggcgaggacgagcggatcgagctcgagcgtctgcgacgggtgcagcagcaggtcccggtccgacgcgaacctgagggcgagcgacaccgacgacgccagcagcgccagcaacgacgtcaactgcggcggcgacggcggcgacggcgtcgccggaacgaccgccaacgcgctccgggaccggcgcttgcggccggcggccaccatcctcggggcgcgcgctgcggttttcgcgggtggcgatggcgactggagcgagagagagagagagagagagtgggagaagtgcgcatgcgtgtggctgggtgggtcaagatgggctagccgctgcgcctcgggcttgatgacgacatgggctttttctctgcggcggtcggtggtggggcccactcgtcttcctcctcgggagaggggaagcacagcattgttgcagctgcaccgcacctgccacccacttcgtcgtgcagtggtcacgtcggagtaaattgcagtcagggctcgggtcggggttccaagttccagccggatttttttttttgacatgcttccagccggatttttggtcccgagaaaaggtttttgttttgtggggagagagaaaaccggttggttcttgtcaatacttgggttccgattaggccgcaaatctgtgtgggcgttgtggcccaacctgaactgtagcctggacggctgaaaaaaattggaatgggccactttaaaaatagtatagctgggccaggccagggaaggtcagatggtaagtcgtagtctcatcggttgccatatttcttaataagcttttttttattgggaaaattggaaccatgtcattataattttgtaaaatttgagatatgccatcctgatccacatgtcatttacatgtcattgagataccgatggcatatctcaaactttacaaaattataatggcatggttccaatttatccttttttattaggaaacaaaatttaatttgtagttaaaatttttatatattgttcgtaatgatttaaagccaacactaaaaataacttgcattgaaaatatcttaaaattaaattaaaaaaaattaaattttaactttgctttgacttattaggtcactcgtctctcaccgttggccatcattgttggtttaacttgagcttcccaatctctcttttcccatcccttgctatgtggatgaagcgtcacttaagaatattctgactacggctgtcctcgaggaggatatcggctccaacattgcgcatgaaggacttcgttggtggctgagaactttgatggcagtgctcatgtgcattgctacttgttatagaaggaatagacgaaaaagaagagacgaaattatagcgactaatagatggttgttgatgggaccaccacctcagttgccacgaaggcaaaaactattgtttggactggtttggagggggttgtaattgaacggttttgacaagtgaggggtgttggatgtctggttttatagccgacgaatgtattttatatgaacataatagttgaagggtacaaaataaacttgtccttattttatggagtatgtatctatccattcagatttgattgttttttaatattaagaagtttgtaagagtgcgatttgcaaaatctataataggagtactgagtggaagatgcacagttaccattacaaattaataatcccttaattagctttgttataaataaaatagaagtcttacattggccaagagtggaactgtggaagaaactcttttgagacaccaatgaagaaaagcggatagaaaagcgcctactttacaaagtgttatgaaaatatatgcacaacggagacacgaattttacgtggaaaacccttgtgggaaaaaaccacgggcgccgaccggcaatgatcactatagaggagatgattacaaacgtaggggaatcgtaatgggaacgtcaccccttcccgtacggcttacaagagtatatatagggataaaagaaagacacctaataggactcctactaggaaactaatccgaatatattgtgggcccaaaattcggatcacatatttaacaatctccaccttgagacgaatttcctcttgtagcataaaaacatcaatcaccaaaaatacctcatgtaggtaaaatcaccgcacgccaaatagtctctaggactatactgtaacacccaccaagcttgagcaaagctcaaacttagtagcaggaactggctttgtcatcatatcagctgggttatcatgagtacttatcttgcatactttgacatcaccttcagcaatcacacctcgaataaagtgatatctcacatcaatgtgctttgttctctcatggaacatttgatcctttgtaaggcatattgcactttgactatcacaaaatatattaatgcaagacgtaactccacaaagctcagtgtataaacctctaagccaaatagcttctttacaagcttcagaaatagccatatactctgcttcagtagtagataaggcaacagttgcttgcaaacttgccttccaactaacagcacatcctccaatagtgaaaacataacctgtgagcgatcttctcctatccaaatctccagcaaaatctgaatccacataaccaacaagtccatctctagatctcccaaactgcaaacaagcactagatgtaccatgtaggtatctgaaaatccattgaacatctttccaatgctctttgccaggattagccatgtatctactgacaacacttaatgcatgtgataagtcaggacgagaacatatcatggcatacataagtgaaccaactgcacttgaataaggaactctagacatgtactcaatattataatctgactgtggacataaatctgaagataatctgaaatgtgcagctaaaggagtactcactggttttgcatcatgcatattgaaacgacgaaaaactttttcaatataacctttctgactaagatataacttgtcagaatgtctttctctagtaatttccataccgagaattttcttcgctacacccaaatccttcatctcaaattcactactcaattgtgccttcaactttgctatctctgatttatcatttgcagcaatcaacatatcatcgacataaagaagcaaatatatagctgaaccatcaacaactttgagataaacatagctatcataattggatcttctaaacttctgagaaagcatgaaagagtcaaatctcttataccattatctaggtgactgcttcaacccataaagagattttctttaacctacaaactaggttctcttttccaggaacaacaaaaccttcaggttgctccatataaatgtcctcttctaactccccatgtaaaaatgcagtcttaacatccatttgctctagttcataatcatgcattgcaacaatactgagtaaagtgcgaattgaactatgcttcacaacaggggaaaagacatcattgaaattaatacctggaatctggctatagcctttagcaactaaccttgctttgtaccttgcctcatcacttggagacataccttcctttcttttgaagatccacttgcaacggatatgtttcttctcctttggcaacttcaccaattcccaagtatgattcttttcaagttcttctaccacactcaaagcataagcaactatgttcgcttcttcaatatctttgaggaggtttactatttcttttgggcttatcttttgcaatagaacgttttggagactgctgaacagtagaagaatctgaatcttcaataacaggtgcatcttggttaatagcaacatcttctttttctggtgcatgccctgaattgatcaagtgctccacctgcacacttgctttctcctgactctcaacaggaacattagtagaaggtttgtcatgtaacataattgattcatggaagacaacatttctactaatcacaacctttttggtttcaggacaccataacttatagcctttcacactagacggataaccaagaaaaatgcacttaatagctctaggctccaatttaccattatcaacatgagcataagcagtacaaccaaatacttttaagtctgaataatttgctggggaaccagaccatacctcaattggagtcttcttattggcataactgggtgatcgattgataagataacaagcagtagaaacggcttccgcccaaaactgtttaggcaaacctgcattagacaacatacaacgggcctttgatataattatcctgttcatacgctcagctacgccgttttgttgaggtgtgtgaggaacggtgtagtgacgcacaatgccttcagacttgcaatatgatttaaatatcttagaacagaactccatcccattgtcagtacgaaggattttcaccttcctttcagtttgtctttcaaccatagttttccactctttaaacacattaaaagcttgatatttgtgcttcaagaaataaggccaaacttttcgcgaataatcatcaacgatggtcatcatgtaacgagcacctccaaaagatgtcttacgagcaggcccccataaatcagaatgcacataatcaagaataccttcagtagtatgtgtagatgtgttgaacttcaccctcttatgcttgccaaagatgcaatgctcacaaaatttgagcttactgatgctttgtccatctagcaatcctcgcttgctcaattctgccaaaccaatttcactcatatgaccaagacgcatatgccaaagattagtagcatcggaattagataatgaatcagaaactgttgcaacattacctaatatagttgtaccttgtagatggtacaggttggcagatttaatactagctttcatcacaacaagagagcctttagttaccttcaaaattccgtctccaccggaatatttgtaccctttgcgatcaagagtacataaagagatgagacttctcttcaaattcggaatatgccgcacatctgacaatgttctgatacaaccatcaaacatcttgatctgaactgttccaatacctgcaacctcgcatggtgtatcatcacccatcaaaacagtaccaccttgaacaacttcataagtggcaaaccaatccctattcgggcacatgtgataggtgcatgcagtatcaagaatccactggtcactagtttgtgcacaaccagcataagcaacaagcaattctgcatcagacttctcatcagtaacaactgcggctttaccttcctcttctttcttaccttttggtatatattttccggttctcttgtctttatcctgtagcttccaacacttagagatatcatgtccatctctcttgcagtatttgcatgacttatacctgcctctggactttgatctcccacggtagctacttgagcttttatctcttgatttgttgtttgtgttcttctcctgttggctaccccgaacaaccaagccttctgcttgtgaatttgaaccttcagagggtaccatcttcttcatcttttctttggcatgcaaagcatcataaacttctttcaaagttagagtatcacggctataaagtatagtatccctgaagtttgcatatgagctaggcaatgaacacaatagaataagggctaaatctttttcatcatactttacctccatagactcaaggtcagcaacaatttccttgaaagcggagagatggtccatcacagacccatcatcttgcaacttgtgcaaaaataatttttgcttcaggtgcatcttactggtcagatccttagtcatgcatatctgttccagcttcaaccacagcccagcggctgtctcctccttaagcacctcctgcaaaatattgttagatagatgaagatgaatatatgacatagccttacgatcccttttcttctcatcgttggaccaatcctgtgtcctcttgtcaaatccagaaagcgcatcatcgagttcttgttgtgcaagaacggctcgcatcttaacttgccaaagtgagaatcttgtgtctcggtccaggagcggtagatcatacttcaaactcgtcatgggaattaatcctgaaatttgctagtaagaaattagggtaaactagcaaaaacgcgaaacctggtacacttctcgtgtgcatgtagtgtagatctgaatcttcctggtagacaagcttgtgtgcgcgtagcaatttcaacgtgaataaaaattcacatgtacaggagcgctctgctcctatctcgatggctttctggcttctgccctacttttcctcggtgaacgtgcactgcagatggaagggttttctctctgcttgcttttcctctcctgacgcgtgcgctgctgctgctctgattcttgcgcggtaggaaggacgaagtcaactccgctttggattggatttcgccgaacagaatttcgacggaacgacgaacacgactatgtgtgccgccgattagatcgatttctatgatcgggaaaaatcgccggtggccaggactgcagtagatcgatctccaatgctctgatactacttgttataaaaatagatgtacaacggagacacgaattttacgtggaaaacccttgcgggaaaaaaccacgggcgccgacaggcaatgatcactatagaggagatgattataaacgtaggggaatcgtaatgggaacgtcaccccttcccgtacggcttacaagagtatatataggggataaaagaaagacacctaataggacttctactaggaaactaatccgataatattgtgggcccaaaattcggatcacatatttaacacaaagggtgtaatttatctatttggagcaaaggaagaagaacaaatcttcgtatataagagctaaaagtgtggaattgtataacttattatcgactatgagggtaaacaactgtatttttcaagcatatcataagtacggcaacaaaataaacgactatacgttgtttgcgtgttgtatcctaaactaaacaacctacaattcgatgcagacgtcgattaaaattagaaactcagctaaacaaatagagattttaatgcggatagtgtctaaatctaataggccggttcgagttaacaacgtaaagacgtttatactccgtacgtttttttgagacttctatcaacacgggacaaaacgaaccggcctatcagaagattggacactcgagaatggaatgctcatgtcgcaaatagagacatctatccctcatgtcgcaaccgctcgagaatggaatgctcacttcgcatggattccgtttgtgcaaaaacccgacaaaacgaaattactacgaaagtgtctgacgggaagattgacgtaatgagggaaaactgaacacgggacgacacgccccggagtcctggacgttgggactcggtggaggtggtcgagttaactctcgactccctctttcttgcgcagggagtaagaaacaaacgtgtcttttcctttatgcttcctttcttgcgcagggagacaaacgtgttttttaactttctgaactcgaagtttttctatctccaacagaaccatcacagactcaggcctgttcttttctcgtaaacatatggagtagattttacctcagttttgttagcacgtttttcagttttgttagcatgtttttcaaactaaatgatatgtttagtacgaaaactttttatatagaagttatattaaaatatcaaatatattcatttgtcaagcttataataattaaaacttaattaattatatgctaatagctttttcgttttacatacgctaacttaatattcatcttcgtgagtttcacacacaccttaagtacataacccgattgaaactaccacggcaacagatctactagggggcctctgttcggcggtgggagtttgtgagttggtttgtttcgttttccgcgcgcacgcttcccgaactactaaatggtatattttttaaaaaaaattctataggaaagttattttaaaaaaatcatatgaatctatttttaaaatttaaaatagttagtactgaattaatcatgtgttaatagctcacctcgctcgctttgtgtattttctcaatcttctcttctcatctcatctcaaacacagccagtactagtctgcttttagcagctgtccagaatattgagctcctcaaactgtttaaattattaaacatcaaataatcaaataatttatagttataaaatctagaaaataaactacaagttgaaagctaaatgatctaactttttcatattcttagaaactaactaacaatcagttgcttctgactcagaatcttaagctcccaaacggaatttgaaatttgagatttgacttcatcctcacaaaacttgtaaccttacaaatttgaaatttgactaacacgaacttgcaaagtaaaaacaaaacggaaacccgataacaacggttcaattttcgagggtcccaacagtaacaactacatacacaaattgaactcaactcaaattatgtgaaataatgctgccaacaaatgggctcacaaacggataaatcctagaccaaagtgatgactgacgtaagatcaaactaaatcaagactaaaatcatcactcgatacaacaatgcaatctaaaattcaacaaatcataatctaataggaaaatataacaactcaaattggtttggtaatgaattcaatttgttcctggttataggtcgatacaacactagtataaaggagaaaagaattacctaaggggtaaactgtgctctaataccacctggtgtgaataggtgtttgatcttccgataggttcgatttggaggcttctggtcggccgatcgtcacctcgcaactattatatctgcatttagtcattattgaccactctctcaagtaattgaccttatcacgaaggttatgtttctgcaaatataattgaagaaattcacaaaaacaaggataatgaatgattggcacacaaaggtgaggttgtttaaatcgatctaccggtgaaactgcatgattgtaaaataataatataagtaaaactctcactctaagcgatgacgactactgaatgtatacgattagaggtgtcctagagttagccctagagcgcacacctctttggcttagcccacaacacggtcacaaggcccaaggcccaaatctaatttggactagatgatgtgcataacttatttggatgattacgtacatcttagaaaaaattttgaaatgagaccaaaatcaacaaaaagtagacttcataagcttttcaacaaatactcatgagcttcgcgagtctttattgataaacaactagatccgtttgaaatagtgttgccgaaaggcctaaatctgagtccaaaatatgtagaattttatcgcttgccttatgtggctcaataatgacgtggttgtgttgaaataggtttggggaaggccatagtttaatctccaatctttttttaaacaaccaatacaagcactcaagtaaataataatacgtaaaacctatgttttagtgtaatttgtttgaatatgtagaaggtaaatatgtaccctttagcttattattgatgtatagaagtatatatgatcatacctgagccgacaattccatatcagaatttaaagcatgtctcttaattaaaaaaaatgcaccaaatctgatgcaaaataaatcatctataaataagtataccagaaatcttagcccaaacgaactctatccaagtcaagagtgccaagtctcctccatagacaatcccgttccgttcgtcttgccttttggctgttgcaatctgttgagcacacaccaaaaaccgcctacgccgagccaaaacccccaaccccgatcagtccgatggcgtccgacgaggcctccccggcggcggcggcggcggcggcggagaggattcgcgtggtcggggcgtgggccggctccctggaggtggagctgggcggctggacggtgccgatgctgcgggcggaggtggcgcggcgcgcgggcggcgtggagcccgaccgcatcaacctcatcttcggcggccgcgtgctcaaggacgatccgcccgcgtcgctccagcaggccggcctcaagggcaacgccaaggtgctctccaccctcctcgcccccgatcgcggcaaggccatcgccgcccaggccgccgcggcggcggccgaggaggagcataataataggctcgtcaggctctggtaaggaggtctccgttcctcttcgatcaaattctagaggatcgatgggggattttgaggattccgctcccatgtttccagtcaaaattccagtcatattgggcaggatttgcagcctgaaattaggaaccacgattcacttattactctttagttgcatactcaaccgcaccactgaacatagaatccatcgtgccccttggtttgggtactgattactgaatgtggtatcaagtcgttagtcatctttacaaaaggattactctatgccaattctgggatgttctaatgaatatgcaaagactattgatttggtggttgtttgtaaccataccccatggttacttgtatgttttgttttgtgtgaagtagtaagaagcacaaaaaaaggtattgagtaccattgtttctgagtaattgatcacgaagcatgcgggtgcagagcctggaatagctcctactgaatctgaaagaaggctgagagtctgcacaaattgtgtgcccctattgaacagtgaaatgatgtataatgtattaggattaccacataattttgttggtttgctagaaactcacacacttcttttggtcgatggatgacacaataatttttgtaggaatgctgcagaagcactatgtcaaaggcatactgatggctcctttcatgaagaagatttcaacttagatcttgaggatcagagtggccagaaagtgatgtttggatctgtagatgatctcaagtaagagattgaatcgtctaaacagttttctcatactatgatttattattattttataatataacatcatcatctgttatctctagggcggtaaagatggctttgatgcttcatcaaaaagccaaaacatttatcaagagggacatgcacaaggaggcacttgatgtcttagcaatggctgaggtatgtatgtttgcttgatcctaccatgcttgtttgactgtttgtttccttccaatatcagtaagcatgtgcagctttttaattggtctgctttatatgcaaccaaatatttgtatatttcctgacccttttgttgtgtgaacaacaggaagctttctctctttgtgaccctaaactcattgaggtaaattgaattgcaagaagaacattttttacatgtatcatagagtgctgcaaatattttacctacactccatgtatattctgcagagggttgataatgtgccgatgcttcagctagatatagtttggtgctatttcgtgcttcgtgatgtatcacgcttagaagttgcaggaactcgcttagaaagggctcgctcaggatttgaacgttctcatggtaaagactctgctcgtttcagattactccaagctggccgtcatgcagatcttgcaatgtgagcacttactatcaattctcccttctttttaccatattagagtctgaattttcattgagaagtgagaactgttccttacctatgaactgatgaaagcattcattctctaattttatatatgaaaagcaatgttacaattgtataactttttatagtggtgtttatcaaggttcaatcttacacattctagttttgacttatgctgttttccaatgcatgaaaaattgccatgtgttttagatatgtaaggctggagcttttggaaggagtggtagcatatcacaatgngaaatactgtgacaaggcgctgtgaatcctcttactntctgcccaagctaaaatacatgctaggtattttcagttgttaattttgtctgctgcgttttctattattattttgcattggaatattttagtaccatagcttctagtaacttcttgactttatatttcctaactgcatgcgatatttagcttcaagtaccagatgaagctatatcaatcttaatgagcatgggctatggagcacaagctgcaaaaagagcattaaagatgactggctatgatatccaatcctcagttgatctcttatgtgaagagcgtgaaaagaaaattcgtagagtacaggaagatatggagatgcaaaaagagatcatgtgagcttctcatcaaggggtttctcttctattctcatttgcttttcctttttgctgaatagtgtgaacttccttggtgatgtcctagggaacaaaagaaatatggtaaaactcccatgaacaaggcagtgaatatgcagaagttgaaaggcttggttgcaattgggtaagaatgttggtcttattacattaatcctgaagttctagatgttgattttgtcatgatgatctaatatagcattttgttaccagccatgaagactagatctgttgagaactttagggcacctattgcttggcagtccatacattatcttctagaaatattcttgtctgttattgtcttattgactaatgtattgtaggatcattgtattataagtcatgatggaaatcttagtcttatgacactcaatataatctggataccaggcataccatcttgaaatgcttgaaagttctctctttgcccttttccttttagcaatagcttttacagtctacatgcattgtgaaagaaacaaagggacaaaatatatattgactacccagttgcactttaaattatggatagtgagtgctgatgtaatataaagcaaaataaattgcactcagttgtttgtggtagcgctctttttacaattccacatatttatgctgtcgtacttcctatttgtgactaatcagttgtttgtatctttaaggtttgagaagaaacttgctgctgaagcactccgcataaatgaaaatgatgctgacaaagcactagatctcttgacagatcctgagcaaaattgcatcctacaagtaattctttgcaccgttttggaactcatattgagatactctgcagttgttaactctatttctgtctctttcactttcagcacaaaatcatgtcaaaggcgaagcgattatctcgcggtatggatcataatacattcatgattgctctgtaaaatcagaaggtctcagatgaaaacgaatttatgcccctttctgttctcgttgttcttgctaggctcgggctcagggtcatcaagctccagggctgctgctgccacgactgcttcaggggtaaacaattcacaggctccggttgacacttcagctaatgttccagatggaagcgctatggaggagagtcatgtgttgcctgtgatcaatgaagaagctgcaaacaacgtagaggctgtgaacgatgacgaaactgtgaaccatgaggaggaagatatgagcgaggagtcagctgagggtgaagaagaagcaaatcctcctccagtcagggatgtggcgatggaaaacgagcttgcccatgaaatgacgggggatgccttggatgactatgatattgatgttagcaacgaagggcaggctatatcagagtacctgagcttactggattctgctgcttaggcttgatgtgcaaacatattactcacctggtctagatagtttttatcaaacctcagaaagaaatatagtcagcctcaatccgagagagtttgcttaatagggtcgatttgtacatgagtttacctttctgccacctggaaacttattaccgtgtgcttaagtaatttctcatggatagcaatctcagctttagaagttactccttgtgctatcaactgtatcttaatatgtgtagtacgtatgtagttcctatagttcctatagggtaactagataagctcgcgagtatagcacaaaacattgcaaacaagagttacatctgggaattaaattaaatagttttacaatacatgcatacagtacaattgatgacaatttccggagccactacatgtacaaattaacattgcaaaacaagaaaagcaaatccaataaaaaagaagttcactgaataattgaacatcccagaagcgagtggcttcatcacccgaccgatttgaccaaattaacgaccgaccttaatttgattgaagctaaactgtgtactcgagagagaataatgaatgcgtgcatggcttgggacgtgacgtgcatggtttgggacgtgacgtgcatgaggatggcttaggcgcaggtgtagccaggcgggacgtcgcagccgcagttgacgaggagcttgagcgcgatggggatgtagatgctgatgtcgagcaccttggccttgatggcggtgcagaggcaggcggcggcggacaggccggcgatgtccttcaccagcgggcagcacgtcacgtgggcgtcgccgatgtgcacctcgttgccgaggaggtccacgcacacgccgagcttgagcgcgtcgatggggcacgtgtccgaggacgacggcgtcggggtggacggcgtcggcgtcggcgatggcgggcacgccttcctcccgccgtgtcgcttcggcgggctcgggctcgggctgtagccgccgccgccgctgccgccgccgatgattcctccgacaaccggggcgatgcctccgacgacgccaccgacaaccggggcgacacttccgacgaccggggcgacgccaccgacgactccaccgacgaccggggcgacacctccgacgacaccgccgacgacgggagggactttcccgacgattccaccgacgaccggagctactcccccgacaactcctcctacaaccggaggaactttcccgacgattccaccgacgaccggagctactcccccgacaactcctcctacgacaggaggaactttgccgacgattcctccgacgacgggagcgacacccccgacgattcctccgacgactcctccgataccaccaccaccacccgagggcgcgctgccgccgccgcccgacggtgcactgccgctaccgccggagccgcacgagccgcacgcgagggcgagcggggaggaggagagcgcgagcatggcgagcaggagcatcgccgagaccttggtggactccattgtaatcaaagaatcaaatggagctcgcttattcgctgctacgaactgcgaggtgtggcgggaggcgaaggccgtggcgcgcgcgctcttttataggcggggaaggcgagcggtccgggaaagtattttcatcacttgcttcttgcatttcgggtttgtttactttaatgtcatttttaaccttactaaattttagtaaaattactaaaaaaaatagctatatttagtttgctgtcaaattttgttaattatataagaaatcctgctaaattttttggtaactattgccaaaatttggtaagttttttttttgacatcaaaatgaacaggcccttcatcgtctaaatagttatataaaattagagataaattaatataaaatatacttcctccgtttcacaatgtaagtcattatagcattttaacatcaatatgaatgtgagaaatgctagaacgacttacattgtgaaacggaggaattatcactctataaacacatgtagcttcgaattcaacttttataagttgtaacgaaaataacaagtagaattatgaattaatgtatgttaccctctccgtctcaaattataaggcgtcctctttttaagaaaaattaaactcgataacttttgactaataatcatattaaccatatatatgctaactattatgcatgctatattactagatttatattttaaaggcttttcatgtgatgttaattttatatttgttggtaactaaacatgaaataaattaatggtcaaagtatatcaatgaagaccatttaaaaaatataggcattataatttgggacatatggagtaattatttttagtttaatttgttcttttatgacaatttatagaagctgaatttagttttgcatatttgtatattctatattaatctatgatgttattttaataatgattatttagatacggaagaaacgaaatgatgatgccctgtcgagaaatgaaaaaccatctctgagcaatcgagcggccaggaatggtcgagagctttgcgcgcgcatgccatgccactgagcgacgggggcgtgggttggcgcgcgcgggaacgaacgaaccggccacgtgaagccagtgggattgccagtgttgggaggcttggcccgttgccaagccgccaaaaaaacaggcgcagcggcgtgtgacactcgcttgtccgcgcccgtcgccatgagcgtgcatgattgcaacgcactgcttacttcccttgctctctgtctaatctcacagctcacggcgagagcgaggccgtagcgcgtgctgtacatgcatgaaccgatgaacctatcagagaagtttttttttattacagtttaattaattcgttccagagttcaaatgggattcatggattcctctctgatccattaataatgttgcttaactctgttcagagatgtggtactgctactccattgtattttcatataatccatatgcagtactgctcttcaatctgaatcatcatgtagtgttgttcagttggagcgggcatgtatatatccatgatttttttttgatgaaaatatatatccatgattgattcagagaaatatgcacgcgctcaatatttttagaatttctgaaccatctcgctataagagaacttttatggtgcttgcattccaaaaaaaaaagtaaaaatccaacgctcctcaataacaggtaccatatgaaaagtatttaaagtatttaagtattagtattggtacttagatactaagggtaaaaatacaaatatattagttgagagaaatggtagaattgtccctaaatttttatcggtaccgcataggtaccagttaagtgatttgcccagtactagctgtcctcattttcatgattttctatagatttatgttgtgttctttgagattctcatttgcatgattttctttatatttacgttttgttccgaagaaaatgttattggagtaaaagttttcatttgcgttcatttctatagatttacattatgttctcaagaagacgtcaaaacccctctgtttaattcttttgagatttatatcttttttactagaagagatttgtattgtgtttcataaacatgattggttaaaatatcaccgaaggtttgcgtcgatttaaattatataatattttataaatttatccctagtaaagatgaaacttcttcctcgactacataaataactaattaactgtgtaaataagtcatggatatctttgaaggtagagaagaaaggagatatgatctttgatttttttttctctccgatacatattgaatcaatcgctaaattaacggggtagccatgatttacgtttttatttctctacaatggtatcgatatgtacaacgataccggtcaatagaaccaggtattcaattcacattaaatacctataatttactagttaatactgccatcatgttataataattttattccgtaccttatccctcttttgatcaacggttcacattaatccaccttttaagtacctcacaaacaccgtaaaaatctaattgatggcacttacattatggtaagaactattaacaagttcagtgcacctgacaaagatattcagatgcccattgtactttcctctagtagtattatctaaagggtgaccatcaatgccagcacattgctgaaggagtattagccatattggtatactggtctgccagcactagattttgatttggtcgaatggtggtgataggaattcagtattctcatgctatcaaatgtttagagaactttctgcagcgattacatcaaaagttcttgactagaatgcgagacatatcgttacaccgcatagcaaactgatgaaggcctgctcactgtacttagtttgcttggttttgcttgcaccaagctaacccagatcgatacgcagatctggttgtgggtcgaactattactaaggcagtcaagtatcgatctgcctcgtctacatgcccccagatgttcagccatactgccataccctcatcctaatcgctgagaccagcgcatagagtagccccatactgacgagttgttcagaagcgaaatgcacatcatcatgtgacgaggacgtgcgccatgcaggttttaagatcttaattattgaccaacaatatcagtgacagttcttattaattattgaccaacaatgtcagtgatagttaagctcgattggacgtgcgtcgcgtcacatgcattttctgattataagtgttgcaagatcgagatgccgtcgacatagttcagaattctcatatcatggatgcaaactctatcaccatcgtagcctcaatcaagttcttttttttgttttgttcttttgttcagatgaactcgaagcacagtagcgaacgcagtaagtgactgcatttttatggataatgcaaaagcttgtacaagggtaagcaaaagaattacaatgctgcttcactttggacactaaacgaaattataaaatgcagagcaattttacgttccttgaggaggtatcacaaggtaccattttttctattgtaaatttagtatcttatggtacctaggtactatgaggtatcataagatactaaattttacactaaattttttgtatctcatgataccttctcaaagaccgtagaattactctaaaatgcagatctaatcagacacatttgaagccgtcagggagctccgtcttgcaggtgctgacgaggacgctgacgccgacggtccactccgtggggatcccgagcacgctctccttgatggtggtgcagaagcacgccgccgcctcggccgcggcgagcccgtcgacgagcgcgcagcacttgctcccgaggtgggcgccagcctgcacgcccacgacgcccagcacgccggcgcacgcgccgaacttgacggcgtcccacgggcagaacgggttcaccggcatgtccttcccccacagccccctgcgcggcgacgcgccggccgccgccgccgcgcgtcgacgccatggtgagcatgatggccagcgcgagcgccgcgacgtcgcggcggctggccattatcctttgcttgtgccgtgtcctcgttctcgccgcgtacatttttatactgcataactacgtatgccactactacgtatacgtacgatacgacgtaaatacgtatgtactgaaaaaaaggttacgtactttttttgcatgtacggtgtagttatattcgttctagttttacatggaactacatactattgtggtaacatagtaaggtacactagaagaatctagaaatcgctcgtgtgttcgacagtgcactaggctctgcatcaacgacgtgacgatatttccgcttgcgtagcattataacgatggtgatggcaccggaagattgcaaattcaggtggtccatttgccatggtcccgtcgcaaaacacaaggtacgcgatcaccactctcaccagcagcgtacgcgagcgcgcgcagtagctcggtcatgtgaggaggaaatggcttcttcgatggagcaa

SEQ ID NO: 75040 - DNA, 1860 bp, Oryza sativa
cctaggcataggttccatgttattgtaaatgattctagctacattatgatattttatattatataatagaaatataaaatatgttttgatagttaattagaatttgactatgggtcgttttagtttccaggatcttttgttatattaaattgcaggtatatatatttttgggtaaaaaacactaatgagaactagatgataaattcctacaattaataacactgaaatcttgtgatatccagtttcttttctttcataattatgataagaagaaagatgaacacactaccagaaactagattacttaaattatgacggccaaaaaccgtcaggataaaaaaaacacgtcaggaaagttgtacatgacgtgtcaatgtcagaaaaataaattccgccaggactagcttgtcagagaaaaattccgtcaggatagaaaaaacccaatatagttttttttaacctttaactggaaaggaccaaggaggcatatacatctcaataattaatgggaatggaatgggagaaaaccatttttttatttccctatgctgttcttttgtcattgcttgcagactggatgtgcattgcatcggaaaattaaagaagaacattctcatttattttaaagcctctaaaaccgtgtaagatcaagtttaataagaatggtactccctccatccaagaaaaactcaagttaggaggggttataggttagttttttttggacggatggagtagttgctatctgtaattttgttcattttgctagtcattaattaagagtctagatatgcgacaccctacactatccctaatacacttattccaatactaagaatttattttacttgttttctctccttttctcttggagctcgatcatgtgcaagctgcctcttctatgaggggcatcatatatacccggtctctctcctctctttcgtcttgacactattatgtacttgctctaatcatcaagccctttttcatcattttctacatatggcgccactgaatttctgcatatagtgcctttctaaataacaggtgaacttataggcctcacactgttttttgtaaaaaaaattgctacgtgacacttaaaatatatgatctttgctgctagacatctgaaaaaactaatacggctcgtggacacattagaaactgataatttgttaagggacactgttgtgattattttattattttcagaacaaattgagagagaaatagcattgaaaagacgagtttttgcccctctcctcctctctgtatctcccgaagttgatcagcagttcagcaccagcccatcgcgtctgtgcatgagaaatttttcatgtgcggctgtgaaccggtggttctcaaaccataggaacttgaataatttttccataaaatttctttgttaaccatttaatttgctgttcttcctctaaacacagaacccccacatgttcttcttaccatgcatggatgagttgatgtttaaaggaaaatgcctaaaatggagatagcaagtatatattgagtgacaaataatcaagtgatagactgatgagcagttaaagccacatttattaagtggaaaaataataactgggtcgtcgtgcacagcgccgcacatacgtgtcggtctcgccctgcgcgcccgtgctcgtgctcatggccctggacaccattgggacacggttcacgttgcgttcgcggagacgcaccggtcgctcgacccggtggcgctgcactgcaggaccctgtggcggcgctgaacgtggtcgcggccgacgcgcgtcaggctgatcgtggcaaggttgacctaggagctagaggctgcacttggcaacaacatcgaggaagccg

SEQ ID NO: 75041 - DNA, 5789 bp, Oryza sativa
gtcattcggacggcgaacttttgtcaattaatgccaatattggcacacgagggtgcgatgttttgtactgtaatcaaaaagttaaaaaagcgccaaaacatgatttttggacatattggagtgtattgggtggatacaaggaaaaaactcacttcgtgattcgcgcggcgaacttttgtcaattaatgccaatgttggcacacgagggtgcgatgtttttgaccggaatcaaaaagttcaaaaaacgccaaaacatggtttttggacatattggagtgtatcgggattgttcgtggcaaaaacacatttcgtgattcgcgctgatggacccggagttcctctcaacactcaaggcttttgttggcccgatctttcggtgagttgtgataactacaatttgggagaaacgttgacgatccgactacaaccgtacgagacgttgtgttgcgccttagcgatcgatacacctctctgtgggttgttgatcttgccggtgcagatcaaccttattcctgcaagcaaatcgaagaaacaagcaagaacaagataaaaagcaatctgatattgcaaataggaatttaatacaaatgataagttggggttccgaagaacaagcagacggacggtctagccgacacgcgcgctgtaagcaagtagcaatggctaaactttaatctatcaaaaccccgagaaactctaaaggggaacctaactatttaagaaggtgggaggacgacctaagggaaccctagggtcgtgctccacctggttggggcgcaccccacttgggccccacttgggccggggtcccagacgaagttacaagcccattataggtgacgcagcaccttctttttgtgatttcggccgactgggatggaatttggtgatgaagctggatccatttgaaagatgactccgagagctttccatcaagtactcatggacccaaaagggagctcgcatgcatatttggcggccgtctgaagtcgattctgttgcaggtggctgaactggattgcagaacttggacggcctgatcttgatgtgaacgacggttgtatctatagtagtcatggtcacatcacgcgcggcgaacttttgccatataatgtcattattggcatattttggcctacacgggtgcgatgtttttgaccggaatgaaaatgttcaaaaagcaccaagacatgatttttgcacatattggagtgtattgggtgcgttcgtggcaaaaactcacttcgtgattcgcgtggcgaacttttgtcaattaatgccaatattagcatattttggaccacaccggtgcgatgtttttgaccggtatgaaaaagttcaaaaagaaccaaaacatgatttttggacatatttggagtgtattggttgcgttcgtggcaaaaactcacttcgtgattcgcgcggtgaacttttgtcaattaatacaaatattggcacacgagggtgcgatgtttttgaccggaatcaaaaagttcaaaaaacgccaaaacatgatttttggacatattggagtgtattgggtgcatacatggcaaaaactcacttggtgattcgtgcggcgaacttttgtcaattaatgccaatattggcacccgagggagcgatgttttgtactggaatcaaaaagttcaaaaagagccaaaacatgatttttggacatattggtgtgtatcaggtgtgttcgtggcaaaaacacatttcgtgattcgcgtggctaacttttgtcaaataatgtcaatattggcatatattagcccacacgggtgcgatgtttttgaccagaatgaaaatgttcaaaaagcaccaaagcatgatttttggacatattggagtgtattgggtgcgttcgtggcaaatactcacttcgtgattcgcgcggcgatcttttgtcaattaatgccaatattggcacacgagggtgcgatgttttctactggcatcaaaaagttcaaaaaacaccaaaacatgatttttggacatattggagtgtatcgggtgtgttcgtggcaaaaacacatttcgtgattcgcgtggctaacttttgtcaaataatgtcaatattggcatatattggcccacacgggtgcgatgtttttgaccggaatgaaaaagttcaaaaagcaccaaaacatgatttttgcacatattggagtgtgttgggtgcgttcgtagcaaaaactcatttcgtgattcgcgcggtgaacttttgtcaattaatgccaatattagcatatatcggaccacacgggtgcgatgtttttgaccggaatcacaaacttcaaaaaagcgaaaacatgatttttggacatattggagtttattgggtgcgttcgtggcaaaaactaacttcgtgattcacggggagaacttttgtcaattaatgccaatatcggtatatattggcccaaacaggtgcgatgtttttgaccgtaatgaaaaatttcaaaaagcaacaaatcatgatttttggacatattggtgtgtattgggtgcattcgtggcaaaaactcactacgtgattcgcgcggcgaacttttgtcaattaatgccaatattggcacacgagggtgcgatgttttgtactgtaatcaaaaagttcaaaaagcgccaaaacatgatttttggacatattagagtgtattgggtgcattcatggcaaaaactcacttcgtgattcgcgcggtgaacttttgtcaattaatgccaatattggcacacgagggtacgatgttttctactggaatcaaaaagttcagaaagagccaaaacatgacttttggacataatggagtgtatcgggtgtcttcgtggcaaaaacacatttcgtgattcgcgtggctaacttttctcaaataatgtcaatattggcatatattagcccacacgggtgcgatgtttttgaccagaatgaaaaagttcaaaaacgccaaaacatgagttttggaaatattggattgtactgggtgcattcatggcaaaaagtcacttcgtgatttgcgcggcgaacttttgttaattaatgccaatattggcacacgagggtgcgatgctttctactggaatcaaaaagttcaaaaagagcccaaacatgatttttgacatattggagtgtatcgggtgggttcgtggcaaaaactcacttcgtgattcgcgcgacgaacttttgtcaattaatgccaatatttgtatatattggcccatataggtgcgatgtttttgaccggaatgaaaaagttcaaagtcaaacataatagttttttctcttttctttctttcttcttttctttcctttccttttcttttcttttttttttgggtgcggcttttcttttcttttttttatgcacctttctgcctttttttttctttcttttttttttattttattttacaaaaacagattcaaggacctcaatgtaaggctatagggactcaaacataaatataaaatttacagtgactcaaatgtaaaagtctaaaaccaaaattaaaattatacaaaaatggaatgctgaatttatactggttccgtttttctgaacggatatcgaaacggacaccaaacaaaaattcaccaaggtgtaaggatggcacggtgtagattgaaccgaaaggagagggagtcggactcaaggggggaatgccgcatggaaggtggttggactcggtgagaatttctgaaggaaggaaaccgattccttttctgcgtggccccaaatagaaacgaaagtaatctaatctagtctaatcttctccttccatcttcctcatgtgcatcttctcccttcttcctcacgcgcacatgcacggcagaaacaaacacacacaaggataggcaaactctagatgcaacacaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaaagccagcagctcgacgtgacgatgcaacacaaaattcaacaaagcaaaaactgaagagaacaatgcaatggcacaatatggctaggtaaatgatacaaatttttttgtatggctattttctggttatgggtagaaaaaaactcaccgagcaacgaaagtctctgataccacctgctgaaccctgagttcctctcgacactcaaggctgttgttggcccgatctttcggtgagttgtgataactacgatttgggagaaacgttgacaatccgactacaactgtacgagacgttgtgttgcgccttagcgatcgatacacctctccgtgggttgttgatcttgccggtgcagatcaaccctattcctgcaagcaaatcgaagaaacaagtaataacaagataaaagcaatctgatattgcaaaaaggaatttaatacaaatgataagttggggttccgaatacaagcagacggacggtctagccgacacgcgcgctgcaaggaagtagcaatggctaaactttcatctaaacaaaacctgagaaaccctgaaggggtaactagctatattgacattaattgacaaaagttcgccgcgcgaatcacgaagtgagtttttgctatgaacgcacgcaatacgctccaatatgcccaaaaaacatgttttggcgctttttgagctttttcattccggtcaaaaacatcgcaccctcgtgtgccaatattcgcaattaattgagaaaagttcgccgtgcgaatcatgaagtgagtttttgccacgaacgcacgcaatacactccaaaatgtccaaaaatggcgtttttgaactttttgattccggtcaaaaacatcgcaccctcgtgtgccaatgttgccattaattgacaaaagttcgccgcgcaaatcacgaagtgagtttttgccacgaacgcacgcaacacactccaatatatccaaaaatcttgttttgccgtttttttgaacattttgattctggtcaaaaacatcgcacccccgtgtgccaacattggcattaattgacaaatgttcgccacgcgaatcacgaagtgagtttttgccacgaacgcacccagtacactccaatatgtccaaaaatcatgttttggcgttttttgaactttttgattccggtcaaaaacaacgctccttcgtgtgccaatattggcattaattgacaaaagttcgccgcgcgaatcacgaagtgagtttttgctatgaacgcacccgatacactccaatatgtccaaaaattatgttttggcgctttttgaactttttcattccggtcaaaaacatcgcccccgtttgggccaaaatatgccaatattggcattaattgataaaagttcgccgtgtaaatcacgaattgagtttttgccattaacgcacccaatacactccaatatgtccaaaaatcatgttttggcgttttttgaactttttgattccggtcaaaaacatcgcaccctagtgtgccaacattggcattaattgacaaaagttcgccgcgcgaatcacgaagtgagttgttgccacgaacgcacccaatacactccaatatgtccaaaaatcatgttttggcgttttttgaactttttgattccggtcaaaagcaacgctccttcgtgtgccaatattggcattaattgacaaaagttcgccgcgcgaatcacgaagtgagtttttgccacgaacgcacccaatacactccaaaatgtccaaaa

SEQ ID NO: 75042 - DNA, 9481 bp, Oryza sativa
attcctgcagcccgctagggacgagtgcttggaggctctcgtcctgacgggatggggcgaggcgtgcgtcagaccgcctgtcgccacctaacccacgatttgaccggtctgtgactgatcacagaccggataaacgagcgcgctgcactgcgttacatgcggcgtgacgcactcgtccaaaccgcaataaatgtggttaggtgagccccgctatgctcacctaccccatatacgcggcgcaacacccacaaggggtcggggcgcctcggccctcggggctgagacgggagcggtccgacccctcggggagacaaagagaagggcggccgtatcaccctcgggcccgaccccccccccccccgagggggttaggccacgtgggtgatcgtatctgcctcaagtctctaagtcatgatactctcggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgcaaatcacgcacatcggcaatggttactcggctgtcaataatgagcggtctcttcaagactgccacattactcgagtaacacgcgaatcgggacgagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagtgtgggcgcgagaaacgagggggcagatagagggcgcgagaaacgaggagccgggcatagcgttggcaagggtataaagtcaccgaggaagagatttgcttccttcttttcgccattattccccttgtcttcgccgcttgcgccctgactccttgtttcctgtgccctaccttcgccacacgcgctcgctctcaaacatctcttcttccggcgtcatggtagcgtgctgccgccttcccgcatcgtgagcgagagacaagccgggctgccgcgccgcttcatgccggaatctgccaccggccgggagatagtctcgctgggcgagggatgcccggcgccacgctacccggggcggtccgtcttcttcctcccttttgctatggcagggctggttccgctattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtccttcgcaagaagtgggatgactggaagagcgactggttctacacccccctcgccgacgaagcgcgcctccgacttccgagccagcccccagcgcaggcctccaactggcggacgccggtagatctgggagatggctacgacgccgttctcgaccgcctggcgggcctgcgatcccaggggctcacaggggccatggtgttcggcgactatcttcgtcgccggatcgcgccactccagcggcgcgcccagggcgcctgggagtacaccgggtccgaggactgtatgaggacccaccagggggtcagatgggactgggctcctgaggacttcaagaaagtggtccaacgggtgctgaatctcagctccgtggaggcatccctcattcctcaaggagtcctccccctctgctgcgatgcagaccgcgcctccatcctgaccatcatgcaggcggtcggggcgtcggaggagcgggctcctcgaggccacgatggcgcgggcgggagccgcaggggggaacaatctaccctgggagggggtcgtgcttctgggccctgcgtcgggggcccggggatcggccgccctgccgacgcccgggggaagaggaagtaggaaggaacccctcccccatctcctccccgagggggcggggcggcgcgtgccagcagcaggcgcccggagggggccacgccgacgtcgcagcccgagggggagcggaagaagaaacggccccgcaagatggggggggacagaaccatcccggggaaacctcatttcccctccaaggtggtcgtttaaccgaccccctcgcaggttcgtcccacgcccatcgtggccgtattcattccttcaatgcgagttttcactcatccatcttgtttgtcttctggtctttcttctgtttcagcgagatcccgtcgcgtccctcccgctattccaagtccagccagtctgaggccgaggacccggcgaccacagaggcccggaggcgggaatctgaccggcgagaagccgcggatcgccttcgggaagccgaggaggctgctcgggaggccgcccgggctcgccagaccgaggaagccgttcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcgccaggccgaggcggcgacgacttccgaggcagctcgcgacgaggccgcgggcgcatcgcttgggcccaatccctcgggcgacactcaggacaagcccggtccgggggacatccctgagtctggcacgtccatcggcgggccgagccgcgcggcatcctcaccgaggcggctcttccccacaccttccgttgctccactgagcgcagaaccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtagaggccatggtggaggtgggccgcaaggcacaccgccggcacgtctcagagctcgaagcccgtcggaaggtgctgggggagatcgccaaggaggtggaggaggagcggagggctgccctcattgccaccaccgtgatgaacgaggcgcaggacaccctccgccttcaatacgggagctgggaggcggagctagggaaaaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgctgttgctattcgggaggtcacactggcggtgcacgaagccgcctgtgcggaagaatagtccgcgctcaccgagcgggagcgagctctcgaggaggccgacgccgcggcgcaatggctggcggacagcctgtccctccgcgaggctgcgcaagaggaacaagcgcgtcgcaatctggaaagtgcctgcgccgagagggccgcactgaaccagcgggccgctgaactcgaggcgcaggcaagggagctggatgcaagggcgcgtagcggcggggcggccacgagcgacagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgcgccggccggcaggtgggcctctgggcgggcggactgtgaagtacgccgccaaccaggggggcctcgcccagcgcctctcggagatagccgggactctccaacggctcgccgaggagcttgagaggacgattaagtcatcctcgagggacctcgcccgaggagcggtggagctcatactggcgagttaccaagccagggatcccgacttctccccatggacggcgctggacgagttccctcccgggaccgaggatggcgcgcgcgcgcaggtccgggacgccgccgaccatatcgtccacagcttcgagggttcgacccctcggctcgcgttcgccttcaactccgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacaaggatgtctgtgccacggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgctgattcccccccggagttcactacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagcccccgaccgaccctgcacacccgaggggggtgcggggttggcccgagcccgaaacctgacacccgattcccctttaggggtagaagcgacgaaggtgttcgatgttccacgggttaggcagctctgtgccgtcacccgtggccagccgaacagagcccggccgggggacgccgatcactcgatacggaccctcccacattggtgacagcttgctcaatccagcacgcgtttggacgcggcgtaggacgaggtcgtcgacgcagagtgatcgggcccggacgtggcgctgatggtagcgccgcaggctctgctggtagcgtgcggctcggagggccgcgcgtcgccttcgctcttccaagtaatcgaggtcatctctgcgaagctgatcttgatcagcctcgcagtacatggtggcccgaggggacttcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccacattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagaaaatggccatgaaagtggtatgatctgcagggcctgggccggctgatggatttgcttggcgtggaattgacacgctctgtatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgcacttcaggaggattccgttagccgcgtgccgatagagggtcccttctaccagcacgtagcgtttggagatgcgctggacgcgttcactcctttcgcggtcctcgggtagagtcttatctgtgaggtatgcttggatctcagcgatccaagcaatcaatctaagggagctgggagtgctcccctcgggtcccgaggcctggactccgacgggcctcggtggcctgtcaggcgcgtccgtctcccctaaggggtcgggtcgcgccgatggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtaacccccgcaccggcgccctgaagagacagggagccgtcgaactgcatcacccaatgggcggtgtgaggcagctgcggggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattttgcaagatttggccgagggggtaagacgtaaccaccgtgacccgatgcgccaggaaataatggcgcagttcctcgaagccatcagaatagcgtaaagcatcttctgggcctgagggtatcgggtcttggcgtcccggagggcctcactaacaaagtagacgggccgctgcacttttcggtggggccgatcctcttcgctaggggccacatccctggggcgctctttgtccaagcggcctcgcggggtgcactcgtcttctgtgccgacgacctcggggtcggaggacgacaggggtggccttcccacagtggcctcggggccgtcctgggggtcgggggttcctggcgtcgtcggacaagcgggcaaagggccaactccggtcgtcaggggccttaggccaccgttcggctcgggggcctcttctccctgctctctcccgggtcgaatcggcacagggttagcctcggggtcagagggcgataggtgcggccttcccgcagtggccctcgggccatcctgggggtcgggggcacctggcaccgtctgacaagcgggcacagggcctgctccggtcgtcgggggccttgggccaccgttcggcttgggggcctctcctccctgctctctcccgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagagcacgttcagcttcctccgtccaagtaaacggcccggagcgtttgaggagcttaaacaagggtagcgccttctctcccagtctcgatatgaaccgacttagggcggccatgcaaccggtgacgcattgcacatccctaagtttgctgggggggcgcatccgctctatagctcgtatcttctcggggttggcctcgatgcctcgggcagagaccaaaaacccgagaagcttgcccgcaggtacaccaaacacacacttatcggggttcagttttatgcgggcggagcggagactctcaaaagtttccgctagatccgagagtaaggtctcttggttgcgcgtctttagaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaactagagtatgcatctagaaaacacaaaaggtcgcaccccgctgtggagtcgacaatctgatctatgcgaggcagggggtaagtgtccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccaggacctcgtcgcatgtgactatccgctgcctcggggcggcgggggcggatgtgctaagcctctcgtcgccaccctccggcttggacgcggcggcgaggtggtccgcacgctgctccatacaagcaagcgcgactttgaggtcgccatggacagagatggggccaccggggcccggcatcttcatctggaggtaggcgtagtggaccgccgccatgaacttcaccaacacgggcctccctaagaccgcgttgtagggcagattgaggtccgccacatcaaagttcacccgctccgtgcggaagttggcggatccaccgaaggtgaccgggaggtcgatatgacctagcggccaagtgtgccccggcgtcacaccgataatcggctgggacggccggagcatcatccccggggccttgatggcgtcaaaggctgcgggggaaaggatgttgagggctgctcctccatcaatgaggacacgccccagctttacgttgcaaacagtgggggaaaccaccattgcgatctgtccttcccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatatcgccgtcatcgatgtcctcggcgggggccttctgcttgtcctcacttcg

SEQ ID NO: 75043 - DNA, 12895 bp, Oryza sativa
aggtccatgcctcctccttacgagccactcggtccgcgagctgaaaaagctccgcggtagtctggggctctttggaggcgatcttttcaagcatgcggttgtgccgcacaccccccctgaacgcgtagatcaccgcgtgtgcagggatgcatggaatggtgttgcggacttgacagaactgctgaatgtatgagcgaagtgactcatcatcccttcgctggactgcatgcaggtccgcttcttcacctgggcgcggatatgtgccttgaaagttcatggtgaactgttggcacaaatcctcccaggagtggaccaacgcgggtggcaagttcattagccaaccccgcgcctgtcccttcagggccatgggaaagaaattcgccatgaccctgtcatcacccccggcggcttcgatcccggtcgtgtagacctggagaaactcggcggggttgacgctcccatcatatttttcggcgatggtgggccggaaccttgggggccaacggacattccgaaggctcgccacaaaggctctacagccgacaccaccaaccgggggcacggagggctgatccccgcgtccgtgttgaggtgacactccggacgaggaggcgccctctgttgcgtggggagcacgccgaccattacgtcggcgctcgatatcgatgcgggcatctggccccccacgctgatcttcctgggtcggaggcgctgacgaaggagtgacggccgaatggcgagcaacagccgccgctcgccgcgccctccgccttgacgacacggagccggtggtagcagcgccggaggtcttggtggcggaggaccgcccaccagcacctaggcgctgccgtgccgtcatgaccaagttggccacgtcgtccagccaacgttgggctggagactccgggtcagggacaacgggcgggtgacgtaggagcgcgcccgcagctcggagcgcgccctggggcgtgctgccgtcgccatagacgaggaggcgacgctccccatctcggcgcccttctccatcacccgtggatgtcgaagtcgcggatccttcgaccctctcgagcgcctcctcctgcctaggactttggcgtggagggggcggtggagtacgagctcgacggcgtgggtttggctccccgtcgtcaccgctaacactcggagagaggttgtgcgcttttgcttgttcagccattgggctgaacagaaaaagcttggcgcacacgaaagagtgtgagagcttagaagaacacacgcagagtcccctacctggcgcgccagatgacggagcttggggctcctcaccgggagaccgcgcaggccccccctttgccggttcggccgggggccctgggtgaggttctaaactccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgggccagcccccgatcgttctgggatcgttttttcccctcccctcttctaagtgggcaaggtcctccttttatatctcaaggggataccacatgcaccatctctccctctctttcttttgtggggacttatcctatcttttcataaacagacggagacttgtatggttgccgtccgaatgaccttctgatgggacggcccacacctacctccacttccgccagaagcaggcgcaacgtgggaacatggctgtctgcagacgacatgaccagtgtcagaccggtcacaaatcggtcattcttgtccaccacgcgttagtttatcaatctgcatgttcgcccctcttcatacaatgtcttgcttgtaatggttaggatgaagcctggcatatatctgaccggaaccaatgtgccatctctaggagctaacacgccggctccggctagggacgagtgcttggaggctctcgtcctgacgggatggggcgaggcgtgcgtcagaccgcctgtcgccacctaacccacgatttgactggtctgtgactgatcacagaccggataaacgagcgcgctgcactgcgttacatgcggcgtgacgcgctcgtccaaaccgcaataaatgtggttaggtgagccccgctatgctcacctaccccatatacgcggcgcaacacccacaaggggtcggggcgcctcggccctcggggctgagacgggagcggtccgacccctcggggagacaaagagaagggcggccgtatcaccctcgggcccgacccccccccccccgagagggttaggccacgtgggtgatcgtgtctgcctcaagtctctaagtcatgatactcccggtcccatgtcaccgacaactgtagcaccacattattaacttatggcgtaattaggttcaaaatattcgtctcataatttacatacaaactgtgcaattggtttttttcgtccatatttaatgctccatatatgtgttaaaacatttggtgtgacaaaaaagttgaaagtttgaaaacagacccaagttacgaacccaaagggtaagcttgtcttttataaatgcttttttctccatttaaccgaataataataaaataatgatgatggtgtcccctaataaattaccaggtttttagagtgtccacgaaccttgtcacgtttttcggatgcccaggagcaaagaccttaatctttgagtgttccgtagcaaattttgttttttttacacaaacattatgaaattggttgttgcggtggtggcagatttaccacacaacctcgccatttgatatgttgagttatgaaccaaattcagttgcaattaataaatgctagcttctgctggagtttaagctttgctcaaacttaattggtatagtggtttagcccaagaggcaatataaaaatattaattgcgggagacattgaagtaacaattgatgaaaagtacataatatgcaccattccaaatttgcatgtacagacttgcatatatactttctctgttattaattagtgtgcagtgcagattgaaatcaggaatggaaaaaacaggggatgaacctaaaatttgttgctatgaaattcaggatcatatataacgttcgctgattgccattactcgagcaaaaaggggaagctataaggcagggatgcccaaatttggcataatcatcactataaatctacaatggaatgcccaaagttggcattgtcacccgaggaagtggtgaattctgatagtgggttctgataagaaagcaatcgaagaataccagtttttaaaagttgcacattttcatgtgatctgattacagaattatttgaagacccgaagcacaggcatcatgctgattactactacatccctgttccattttgaacaaggttgacgtgaaataattataacttttgactatcagaataatcatcttggagacaataaacacacgatttgtatataagtcttagaaagtactttaagaaaaaaaatatttacttattttttatatattataatataaactcagagttaaaatatgttttagagatcgtgtacatttttgttcaattattgaaaatgtcaactgaaccggagggagtatgtacctagctatgtatatacctattgggatgaagagccttaattatgttttatgttttaaagaaaatgttgttgacgtataagccccattcatcactccatggacactgcaatagtgtggctgagccattactctcacctctggtttaagatatatacatatgaactcctctcaatcattgctcagttccctttcaatttgcctataatagcatgtgtctaatcccatactgagatggtatattctagaacggagggggttcataggttagttggatatagtcgataggacaatggccctaattatattattgaacgaaaggtttgtagatacattaatgttaatacaaactccatttgttacttcatactccatctttccaaaaaaaaactaacctaggaggggatatgacctaggaagagatgtgatccctcatagtacaacgaatctgaataagtaggggtcacattaccttttacgttgggttttttgggacggagggagtagatatctgcaatgcatttcctttcttcttcttttttgtggggcctgagtgatttcctctcgactatgtatatatgagtccattccgtcgtccttggttcccttcagtttggctgcaatatattatacataccgttcgctgaaaaaagtatataaagttgagagcaccgaaagaaaacatgagagatgtttatctttcattttgaccatcacaatctttatgaacatgcccatctcgtaacatcaaaagatgttgttttggaatgggagacatcagcaataaaaaatcatggtattgtctgacggatccttttgtgctccccctgtcaccgaaaaaatcaacatagtgattgacgttgatacattataatactataaatcagaagctgcatctgtcctgaatcgtagtagtagaatgtgtcaatattcaagactaagttagtttttatgagacggaggaagtacaagaggccagtgtaacctgattatagtggtaaagaagcaagattacagtcgacctagtggataggctgtgatgtgcagtgccccgtggtatatcctttccgcaagcgataactgtcatggcattcaacggtcgttctggtaatcgttcatcatgaagaacaagaagaacatgtcaaaagctgcgatggaaatgggcattatggccgcatgaagtataatttgttaaacaataattagggatataattgtttgctatagaaaccatgcacgttgttgtatagatataatgtgatacatctgctccaaaatctgcattagcctagttctatagattgagcgagctaacatatgcatggtatcccatttacactttcatcatatcttgtgtaaaatggttaacccaaggtgatatgattggagcgcaaaggcttataagcatgccacttaattaggacctacgctctataaaagaagcaaatggtgttcgattcaaacattgttccaagccaactacatactacatgcttagtacagtggcggctaggccgacgtaagctggccggaccaaggtggggaagacacagaagccggcttagcccgtttcagggtttaggccaaaaagctctgtgagattaaataattggtttcagtattcaagaaattcaggagaatgttatggcataaaaagaagcaaaaagatcttaatagaacttaaaacatatgaaatctgacaagtttgaaattgaaacaagttatttgtgaaatgtgatggtgggtttaaagtttgaggtcaaaacaattttgttatgcttgaaatggaagaaaaatggaagagactccttttaaatcttgatgtgactatcttagatgaataaagtttcctttatcttaaaaaatgtgaggttttaagaaacttaatttagacgttatataacatctcttgctggttgtaatagctctaatttgtctcacaacacttagtaaatcctatatataaaatagttgtatggttgtaccaattgtacaaatcatatgaaattttccaaaaaggaacagttatataatgattgataaagtatgaattgtacagatcagatgagattaaaccatatttcattgctacaaatcaattccagtttgcacctctacttttgtgacatgcagcttttccactgcaacacgtggagttttcgcctggtgttttaccactgtgtcttaatgataacaacactactacttactccctaccctcaaatataagtatttttttaccaggtcaaaaaaaatataagtatttttacgacacaaaattttaagtatttatgatttcaatgcatgggaattaaaacatttttagccaattaggtgcgtaggagggaatccaagtaatattagaaattgaaaatttgacaaataactggtgacagctaaaagatcattattagaaaacatattttttacaaagagttaaaataaatttttctaggcggctcttcaccccgcctacacttcaagacatgtgaaaatacactattttcacaggcaccttctgtccagccgttggcaggggccgctgccgctgtcctcccccatctagccggatctaggagggagggagggtgggaggggaggggaggggaggggagtgctgcctctactgccgcctgcggtggccgccaccaccatcgcttccctcctctggccggatctagtaggaatggagatagggaggggtggggagcgccgcctctgtcgctcccctcctccggccagatctaggagcaagtgggaagggaggtgaggggagcgcctcctccgcactgtcgcttattgtgactcccactgctgcccctcccctcctccggtcagatctaggagagagggaggagagggctgtgctgactactatggccgcccgctgagaggggtggagggagagaggccggtcatagcgggtggaaatggaatctagccgggtaggtggtgatttttatgtggtatgaccttttttgcagatggacatcttaaggtctcctgcgaaaatcgattctcacaaacgtggtcttaagaggtacacctgcaaaaattatctcttatttttgctagcggaccacttaagatcatgcctgcaaaaattgcagataggactagatttatggtatctttatctatttttacaaacaaaatagatatgagggtagtgtccaccaatttggacaatgggactgctttaaaaagcctccatatgtcactgatgctcataatataataaaccctcatactctaatacaacctagctccctcctcatatcttttagctttcttctctttctctcaacttttgatccaaactgtatataatttctatgttatcttcatctactataggatggaattaaattttatatgtaacggtgatagatgatcaaccatgggacaatatatatgcatggtgattgcattggaaatgagcggcgtcagaagaacacaatctcgtcagtgaatgagagcttgaagcatcttgttgagcaagaagatgggtgcctgtgagtgtatgatggtgctgtttaactcacagtatcgtcttgcacttattttcgctggcttaatggttctagctgtttctccctccatcgtaaaataagccaacctcatactaggtatgacacatcgatcctaacactataaatctggacgatgtatcacattctagtatacgatgttggtttattttgggatggagatgttagaaataatcttgttgtattaggtgatcatgtttattttgttgcatgtcatcatatataggagtagactataagttgtcagctgcatgcgttagtcgttatggcatagcgagctaatctcatgtgaagcacaaaatttggaagaatgcttaaagtagattggcagccaagtagtgcgtacgtgcatgttgggactagtctcaggattatgtggtgaattagtcttgcatgcattaaactattggagaaaccatctttggttggtcgtccaaaatccacaatagtcctggttcgaataggaaccggaactaaatattatttttagtcctggctaacaacattgttatctttaatccctgttgatgttaccaaccaagaataaatatcatttttagtctcggttcaagttatcaggtcgagtcagggccccaaatatctttagtctcggttgtttattatatcagccgggaccaaaattcaccccgagaacgcaggcctcattttgatctcggtcagtcgtcgatcttatcccctcccccttcctcattaaattaacagcctcagcccccatctcagtctcgcgttgatcttatccatctcagcctcagcctccatcgatctcagtcatatcccctctcccccttcctccccttcccctctcctccccctcccgctccccgcctcctcctctccaggcgaccgagcccaggcggcgactactggagcggcgggccgtgcggagggcggagggcggagggcggcgggtggcggcgtggccgcgctggcgggcggatgggagggcggcgggagctgccggccagcggcgccctcccctctgccgaaggggaggcgggaggcggcagcggcaactcgattttgttgttcttttttttttaagaatttgtgatatattggatttcagaatttttagaagttgtgattcgttggtctgagaacttttagatgttgtaattcattggatatgtgatgtatttcttttagaatttgagatgtattttttttaagaatttgtgatgtgaatctatgtttgtgttgatactttgattttgatttggggatatgattggggatatagggagcatcttgatttgtgccgttccaactcgatttgtgcagttacaactcgatttggaaagaaacaatgaaaaaaaaaagaaagaaatggtgaccaaccgggattggcgttgccatctttagacccggtttgtatcaccaaccgggactatagatggatgtttagtcctaggtatttcacccaggactaaagatacctatctttagtcccggattcgtacttctggttataaaactaggagtatagggggctacaaaccgagaggaaaaacgctttctctggtagtgttagttagttgcagatgcatgtgcatgcatgcatattatttggttggtgcaagcaacgacgtctgggaggactcatgttcgaatccaattaaaaacgtgaataaaattttggataaaagtggcacgcttttcaaactgctaaacagtgtgtttcgtgtaaaaactttatatatgaaagttgttctaaaatttcagattaatctattttcaagtttataataattaaaactcaattaatcacatgttattaccactcgctttgtgtgaacacttaatctttatttcaacatcatcttccgtagtggagatgcggcctgagtcaagcagttgcgatacttgtggagttttgcggccaagtaaaccggacgtgggcgtatgtgcgattagtagtatgcatggattgtaaatagctgctccttgtaatcgtttgttttgtgaagaaatagcaagagaaaaggcactagttgtatatgtgcggtgccacaaatatgctcggtactgtgttctcttcttccctgtgttcttcacgtgcaattgtgattcgtgtccactgtgttcgcgtgagttgctttgatttccaacaggagggaatatactgataggctgggatggaactgggatcatatcatacaaactaataggctggttgtacacgctatctccacttccctttgatagtaacttgtgaaacaaaatcaaacggccttgtcatgtccaacagtgcagactgaaaagcaacatatcgcatcaaattgtggaagggcctgtagccttgtggttaccagagcctcaaacctcagaagcatctgaggttctgggttcgactccccttagaaacgaattttctaggatatatcagcgttttactcatagtgattagggtccgtcctttgattattgaggtgtgtactcgttgatccgaacggccgaatgtcgaatgtaacgtcaagtagaattgcgcatgtctataaagtaattaagatattcagaaactaaaataaatatatatcatctatccatccaaatcaatagcaccattcaccaaatcaacaccttgttctattctgcaagtattaggttcagacacacgaatgtcaggcagcgattaatcgcaccagattggttaccttttacattctgttaaaaactgtaagatattcagagaaatcaaaataaaaggattcaaggaaagaaccaaaaataagagggggtggacaggatgatacatataactacacatgacaagttgctatgagattccaggtctagcattgtaaacaccagctggttggaacacgaaaacacaggaaagataaggaagggatgcatgtaagaatcgccagtgtaatacaatgcgactgtgcctaaattctgcactatcacctgatgacgctgttgtgaattaaaatagttggttctgataacaaagcaagcaaacaaaaacagttgataaagttgcccattttcatgtgatctcattacagcattgaacacccaaaccaaacaccacgtagattagttcgtacctatatatagctagagggatcaatggccttaattattttattgaatgaaaggtttgttgaaatattagctccattgatgtgttcatcgatcctgaagccttgctattttctgtttattcacatgattattttctgttgttttgaagaacaggaaggaggtcttcgtgtctttgattgagaaggaatgatggaatggacaacaaaaaaaaagagttgacattgtttacccttgctaaagaaaagttcatttagtaaatttgatgtatgaacacttgaaatcacgttagctagtaaaccatcatatactaggttgcaaaacgtactaatgattacgaattctcagagatttatctcttgaactcggtgactgaatagttttatattttcaagtatatattgacattcatcaatcgtctggaaactgctaaacgttgcccattttttctttatgtacgttttctgaacatggggttttattttagttctaaagggaacttggggtttatttcctgatcacattgttacttttatgtagaaactttatgtaactcgccttacctaacaaagatcatatataaaagatctttatcctcctaattattcactccatttacccgtctggagggtggagcagaccctagcagtgtgctctatttattcccattcttctcctagccaatattaacaatgtcttcttttaaccattcatgtacaattaacatcattctttttaatggatcaagtgttttcatcggaatgagttgcatcgggatgaagctctctgcacagcagacatattctgcagaccaagattatggacctaaatcctaaggagtggtttaaataacagtgagctgaaacagtagtgaagatcgatgcagaagttgagaagcatgtgacaaagaagatgccaaagcttaattagttggggtattgtgatgatctatcttatgcggttcctagtagaaatggactgcataaggattatctgtttcctgtttcttgagcacaaggggatcaatcgaccctccataattcttctcgtgtgtgaaaaactaaaggattgcagtcctcccataaatctgagttcatttcttgaggttcccaacgtcaactccttaatttcctagctaggcatacgcttcctggactactaagcgattcattttttataaaaaagaaatatatgaaagttattgtaaaaatttatattaatctactttttaagtttttttactaatacttgattaatcatgtgctaataaataatattgttttcaatgcatggaagaatattttcaatctctcctcccaaacatagcaagtactactctagtccgaaaaattaaggggcggagtcaagacccagccaccacgggcgagtgccagagctccgcccactgcattattacgtaccctgtttgattaacaaggaaattagtaaagttgtggagattatggataccccatatctatatgacggttgtaatttagtcggatatacggtaccaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgtgtgcctcttggggggcgattctttttccaatttatacaatcaataacacactaggcggaatcatccccagacaggagtagggtattacttcttgaataagaaggcctgaacctgtataaaattccttgtctccaaacccatccactttcctagcttgatagccacccccttttattattgccgaaatcttgcttcgacagttggcgcgccaggtaggggtagcgtcaagttctcgccgactaagtgcgatgggtttcgtttctggcatcgacgacttcgccttccctcccgggcaggtgttccggtttggcagcctcaacttcatcaccaacgacttcggcaagatctctctccttgactcggattcaaaccagtcggggagagaccaggtccccgtgccgttcggtattccgaactcggccgaggcctactccaagatcatctctcccgactcggcttcaaaccactcggacgagatccaatctactcttccgcgaccagatcaagacgacgggtcctatccctcaatcctgacgaaacttcctgatgatttggccgctgtcttcacagtcaagacatctcccactcgaagatctaagcgagctccggcttcggccccgatccgatctagatccaggaaggttggcgttatactccaacctctcgggacagtctcgacggaagagttggatggctacctcagctcctccggcgtcagttctcgaccaaccgagatcctcgactacgatgatttcggctaccactacgaccacggcgacctcgacaacttcgacgacagctatgaggataactacacgcccctcttcttcggcgtattcaaggctaacaatgaaatggaggaacagcaccaagcccgagaagcggaccaagatcgcgcacgacaagaagctgaacgtcatcgactagaggaagagcgacagcgataggagcgagaacg

SEQ ID NO: 75044 - DNA, 6590 bp, Oryza sativa
cgcacccaatacactccaatatgtccaaaaatcatgttttggcgttttttgagcttttttattccggtcaaaaacatcgcaccctcgtgtgccaatgttgccattaattgataaaagttcgccgcgcgaatcacgaagtgagtttttgccacgaacgcacgcaacatactccaatatgtccaaaaatcatgttttggcattttttgaactttttgattccggtcaaaaacatcgcaccctcgtgtgccaatattcgcattaattgagaaaagttcaccgtgcgaatcacgaagtgagtttttgccacgaacgcacgcaatacactccaaaatgtccaaaaaacatgttttggcgtttttgaactttttgattccggtcaaaaacatcgcaccctcgtgtgccaatgttgccattaaggacacggatacagatggatgaagtcgttgcgacgatggatatctctgaggcaaatgaaggctaaacgagctgcggctcggtaatcgagatatctaggcaaatgaagactacacgggtcggtgcccgttagtcgagatgccatggcactggactagtacgcgggtggtctcacccctatgcgtgtggcgcacccggtctagatcctgttgctcggggctcaatcctggcctgcctgtcccgagataccggccgtaggcagggttgggtcggtacttttgttcacggctaggatgggtgaagggttatgtcacatgtttacgacgggttccaaggccatggaatgggatgtcaaaagaagcaccatctattgactcggctgacaaggagattcagccggaaaagactgtgccgtaggagtactgcgacacacggttgctgctgtttccccaacgaaaggacgagcagttcgctcgttttgtgatccagaagatccacatcaaagtgccgttgttggatgctatgcaagtgccaacatacgcccgttatctcaaggacatactcaacaacaagagaccgctgccaacaacggaggtggtcaagctgacggaacaatgcagcaacctgatactccacaagctcccggagaagaagaaagatccggggtgtcctatgatcacctgctcgatcggggcacaacaattcgaccagacctggtgcgaccttggagccagcgttagcgtcatgccaaaagacgtcttcgacaagttcaacttcacagtgttggaaccaacaccgatgcgcctccaactggctgactcatcagttcgttacccagcaggaatagcggagaatgtgccagtcaagatacgggatttcttcatcccggttgattttgtggtgctagacatggacatggggaaggagatgccgctcatcctagggcgtccattccttagtaccgcaggagccaacattgacgtgggaacggggagtatccgtttccatatcaacgggaaggaggaaaagtttgagtttcaaccaaggacggaacaatgctccatggtcagaataaagtacgggccgaatccgtagaatattcaagtggtcgaagtggagccacccaaaacggacagcttggtgatatttatgcagaatttcctggagaaggaaacaacgatgcccaggaaccgttattggaaaacgccggtaaaatcacccgtaccggccaagaagtcagatcagccggctcagaagaagccgccgtccgcaccaaaatcaaaaaaggtgtggaaggaaaagctaaagatgcccgctccatcacctccggagacgggtgaaaaatcagtgcactaaaccgaaaggaggtatgtatccgcatatttgctttcaacaatttaaatttttgtatcaccacatatttgaatttcaaaatgcatttaggctttttgaatttttaggaaattcttcaaatgaattttccagagcaaaccaaaataaaattttcaatgaaaatttattgtgccacgaccacactgaccgttggaatccaacggctgaaagtggggccggttgggcccaccaggggtttggccgaacaccctggttcggcctaaccggccaggccaacggtcggctgcctctttctttgaggcaacgtgatgaaccctgagttcctctcgacactcaaggctgttgttggcctgatctttcggtgagttgtgataactacgatttgggagaaacgttgacgatccgactacaaccgtacaagacgttctgttgcgccttagcgatcgatacacctctccgtgggttgttgatcttgtcgatgcatatgaaccctattcctgcaggcaatcgagaacaagcaagaacaagatagaaagcaactgaattgctagatagacaagacgcacaaagatgaattgatacacgataaagtggggttctgaacaagcagatggacggtctagccgacacgcacgctgcaagcgaagtagcaatggctaaacttacaatttatcaaaaccccagcaaccctaaaggggtatctagctacttataggggtgggagaatgaccataaggatcctagggtcgtgctccaccagattggggcgcaccccacatgggccccacttgggccggggtcccaaacgaagttacaagcccaaaggcccatgacaggtgacacaacaccttgttgcttcaattgcggctcaataagatggaatttcgcaatgaggctggatccgttggaaagaggactccgagagctttccatcaagtactcacgggccaaaaacggagctcgtatggagatttggtggccgtttgaaattagcagtgcagcaggtggccgaatcggattccagcatttggaggccttgaccttgatgtcttcttgttcatccatgatatgagcaatgtttgtatccatagtagctatggtcacatcatcctccccttcttcacggaaaatcgtcgtcgttttttccatatggtgctcttcatatagtccattcaaaataacctgtttcatccaatcaaaactagacaaactcgaagtagtgtgattagcaaaaacatgtttctgtaaatgcgaacaaatgaaaatgctatgcaccaaatatattcctctatcattatattcgccaaagatatgaaaaataacattagttggacatggcaaatcaaacttagcaaataaattctcctccaaattattgagctcacaaaaatcatcaaactgaacatagcccgagtattgaaagaagttatcaatttacgttcctcaatatcattagcaatgtgaacaacatgcttaaaatcagcacacaataaaacactagaaatagcatgttcattcactagttgtggcatggatataagtgaagcattatcacacaactcttctctatcacaaggaacagcaagtaaatcaacttgtgacaaaggcatctcagcaattggttccactaatagttgctcttcactagcatgacaagtggaaaaatgtaattcatcagaagcatactcatcttgagtaatttctgcaccatttaatttaccttttatgccctcttcagataatgtaggtgcatcagccttctcctcattcgcgagtgatggaagtgacatctcaaacatatcgttcttctcattttggggactgttctgaacttcctgcaaaatatcagcgataggaggcacaagcatagcttgttgctccattgggttctccaaaattttgcgctcaatattgcaagcaagcatgaacaattggcctatatgattatatgtcacattaacaagcccaacctgaatattggaattaagccctctgaaaaatctagtcattgtgttctcattagattcttgtaaaccactataagtgatacaaattttaaaatcatgaaagtactccctaacagttttgtcaccttgttttatatgttcaaatttctcaaagagagcacgtctatagtatgaaaacacaaatctttttctcatcagtattttgcattcatcccaagtttcaagcttatttcccacagtatgccaccaaaaagatgcagaaccgatacacttattactaacagccttaatcatttgagcattagaaaaatcatactcatcaaattgtttttctactgctagctcccaattaacataagcggcagaatcatacttaccatcaaaaactggcaatttagattctacccttgcaagatcattatcaggtacctcatatgtgatgcgtgaagaagtcgctatatctcgttgatggtgaagatgttgacgttgagcatgaccatctcatttccccgtgcgcaatcctgccatggttagtagcaaacaagaaacatacacaaaaatatgcgcgttcctattaactagtaggtagtggcagctcaaaaatcacacacactcaagcttttaaccaagctcttacaacatcttaccaatgcaagcggaatggtgacatacaccgactcaaccaagcaccccaatggaggttggatgtatcgatgccttggcaaacacttactgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgtgagcctacacacaaatgataccacaagatagcactaggagcaactcatgcacaactctgatatatgaagttcagctcaatgataacaaaatgattttctccttttcttctttttttctctctctttttttttgtctttcctgcttttcttttctttttcttttctttttttggtgcggcttttgttttctttctttttagcacctttctgccttttttttcttttttttaaattttttttcagcaaaaaccaactcaaggaccttaatgcaagattacaaggactcaactgtaaatatacaaattacagggattcaaatgcaaaagtgcaaacccaaaaattaaaattatacaaaaatggaatgctgaatttatattggttccgtttttccaaacggatctccaatcggacactctgaaaattttcaccaagctatgcgggaagacacggtatggatctaaatcgatagaagagagggaggagtcggactcggaggaaggaaggcaccacagagaggtggagctgaatattgcggccagcactagtgtttggattcagtgcacaaaataaaaggaaacggatttccacccgatctaatcttctttttctttcctattctgttctttcctttttttttctttccttccacccaaccgaatccaaacagatcttctatattcctttccccttcttcttcctcaagggcaaaacagaaccacagcacaagcactaagcctgggtaaacaacaaacccttgatgcaacaccaaaaccgaccgataaaaacttttgaaaactacaaaaatagaaccatggcagcaagccgattccgttttcgtaggtcccgacgataacagagacacggaggcggcaatgactctggtataaaacgtgaccagaacacgaaacactaaacgaactagacgctaaggcgcaacacaacgtcttgtacggttgtagtcggatcgccaacgtttctcccaaatcgtagttacctacaactcaccgaaagatcgggccaacaatagccttgagtgtcgagaggaactcagggttcagcaaaaactgaatagaacaaagcaatggcacaaagatggctagggacatgatgtaaatttttttgtatggctattttctgcttataggtagaaaaaaactcaccgagcaccgaaagctctgataccacctgctgaaccctgagttcctctcgacactcaaggctgttgttggcccgatctttcggtgagttgtgataactacgatttgggagaaacgttgacaatccgactacaactgtacgagacgttgtgttgcgccttagcgatcgatacacctctccgtgggttgttgatcttgccggtgcagatcaaccctattcctgcaagcaaatcgaagaaacaagtaataacaagataaaagcaatctgatattgcaaaaaggaatttaatacaaatgataagttggggttccgaatacaagcagacggacggtctagccgacacgcgcgctgcaaggaagtagcaatggctaaactttcatctaaacaaaacctgagaaaccctgaaggggtaactagctatattgacattaattgacaaaagttcgccgcgcgaatcacgaagtgagtttttgctatgaacgcacgcaatacgctccaatatgcccaaaaaacatgttttggcgctttttgagctttttcattccggtcaaaaacatcgcaccctcgtgtgccaatgttgcaattaattgagaaaagttcgccgcgcaaatcacgacgtgagtttttgccacgaacgcacgcaacacactccaatatacccaaaaatcttgttttggcgttttttgaactttttgattccggtcaaaaacatcgcaccctagtgtgccaacattggcattaattgacaaaagttcgccgcgcgaatcacgaagtgagttgttgccacgaacgcacccaatacactccaatatgtc

SEQ ID NO: 75045 - DNA, 3226 bp, Oryza sativa
ggttccgaacaagcagacggacggtctagccgacacgcgcgctgcaagcgaagtagcaatggctaaacttacaatttatcaaaaccccagcaaccctgaaggggtatctagctacttataggggtgggagaatgaccatgaggatcctagggtcgtgctccaccggattggggcgcaccccacatgggccccacttgggccggggtcccaaacgaagttacaagcccaaaggaccatgacaggtgatgcaacaccttgttgcttcaattgcggctcaataagatggaatttcacaatgaggctggatccgttggaaagaggattccgagagctttctatcaagtactcacgggccaaaaacagagctcgtatggagatttggtggccgtttgaaattagcagtgcagtaggtggccgaatcggattccagcatttggaggccttgaccttgatgtcttcttgttcatctatgatgtgagcaatggttgtatccatagtagctatggtcacatcacaaaggctagtgggccccacaggttagttttgaccgttgtggatgcactatttaagccaaccggccgggagaggggactccaccccatttcaacacatttccattccctctgcaaagtttgctgtctagttcattcaagctgtgatattttccctcaaatttaaatctttagttgcatatatacaagttgctttggtgaaactaaccggcaggtgaaactcttatcattcctaacccccgccgagttagtccgttcttgcttcattgtgcagaatgaggaggcgattgtctcaactgttcaaagggtccggcccttcatcaagtcatcatgacgggtctagcactcgttcatcagctaatatctcgatggaagacgccgaagctccgcgacatgatacggacatcactacctcggatacacacaacaatcctccaatggtcattcaaggactgatagcaagagctcgtgcgcgacaattaaatttagaggtgagctcgttcctatgttcttctttgtatgaattcgagaaaagattgctacctaatgaatatattgtgattagaaataatagaggggacaaggagacacttggagaaggacttagagccatggaggatcatcgaggacgtccaagtcaaggtggaggcccaaaccaattcgacctcggtgcaattcggagtctaggaccagtctgcactaaaacgggcgcccaggtcgcatacgtgctcggattggggcgttctttatatgaatggaaaactaagaagataacctttccaatggttttggtcccacatccaaatactttccgagtcaatgggtatcgaccgaacaagttgacatccagaatctgtcccggtgctgtgtcaccgtatttgggcctttgggccatgtatcgtgttggaacccattagggttgcgtcgagagggggttgcacgagcctaaactctatatatcagtaccgctaccatctttaggttttagagttttgcttagattattctgtcgagaacagtttcgccgctagatcggtttgtaagaccccaactcgtgagcttatcattcatctgcaattttggttgttttctatctcgtttttgtttgtgttcttcgattggcaaatagggattagccttcttggcgaggtcatccgcgtttcgacacgggtgataaccagaggagacgtggtgttgcgattgcggggctcaagagcgtgcgcgttcaagaagccggatcgatttgtgtcgcgactccgcccaaatcattttttatcagaacctttcggaagatcgggaaccctagtgcacatcaagtggtatcggaggccgttgtaaagtctgtccaagatgccttcactaaaatcggcttcctgaaccacatggagaggttggacaagcagatatccacgctaactgatcgggttgccgcgttggagacaccttccaatgaggaagtggtgagtggtgatgacgatgctcattcggaagacacggtgtatgattccagtggctatattgacacaccagctacaaggcaagcacggctatgacgtcgcctacgcataaaccgcacaggtatgggtggcactcgccaccaacaaggtaataataatcgtgtgccagatgatccttatgctaaggttaagtttaaaataccatctttttcgggatattatgatgctgagaaataccttgattgggagatggcaatagaacaaaagtttaatgcccaccttgtacctgagcaacatagagttaaacaagctagtagtgagttcaaggattttgctatcatgtagtgggctgggttatctgatgagggggtactacctactacttgggaagaacttaaggtagctatgcacgataggtttgttcctccatcttatcatagagatttacgcaagaaattgatgcgtttggaacaaggggataaatccgtacaggattactatggtgagctacaaaagggtgtgagacgctgtggcatagtggagggggtcgaggatgctatttttcgtttttattctggtttgagggaggaaattcaaaacattgttgattataaggaatttaactctatgaaccagttgttttggtttgcaatgcttgaagagaaggaattgcaggggcgtgaccatcagggcaagaacaaggcaagcacatacactccacgcacgatgccatctacgggactacccagggccgtttcttttcgggcgccttcccagccagcgagcaagcgaccagctgcattcggagcttctgcggcaccaaaaccatctccaccacaaccagcagagtcaggtaatggttcttcgcaggtacccgccaagagtgcctcatctgtcgcctcgacgggacgcattcagtgccaccgttgccaagggtttgggcatgtgcagaaagattgccctattcaacgggcctatgttgctacagaagatggctacatcaccacctccgacgtggaagaggaagaggaggaagaagaagttgaggatgaggatggagaagtctttggccgtgatgacacaactgactacaggaccatcgttgtgcagcgggtgctcagcatgcaggtacagcagcctgagaggttgcaacgccataatttgtttcagattttcttcgtcatcaacaaccgtcgtgcacgtgtgatcattgatggaggtagctgcaacaatttggtgagttctgatttggtcaag

SEQ ID NO: 75046 - DNA, 2748 bp, Oryza sativa
cgtgcaatgtttttaatcggaacgaaaaagtttagaaagcaccaaaagatgtgttttggacataatggagtggattgggtgcgtccatattgaaaaatcactccgtaactcgcgcggcgaaagtttgtcaattaatgccaatattggcctacattgccacacgtgggtgcgatgtttttagccggaaaaaaaagttcaaaaaccacaaaaacatgagttttggacatattgcagtagattgggtgcgccctcgtcgaaaattcactccgtgactagcgtggtgaacttttgtcaattaatgtcgatattggcatatattgagcaccgacgggtgcgatgtttttttgaccggaatgaaaaagttcaaaaagcaccaaaataagacttttggacatattggagtgtatttggtgcgttcgtggcaaaaactcacttcgtgattcgcgcggcgaacttttgtcaatttatgcctatgttggcatatattgagccctcacgggtgcgatgtttttgaccggaatgaaaaagttcaaaaagcaacaaaatatgattttttgaacatattggagtgtattgggtgcattcgtagcaaaaacattaacgaacaattgtcaattaatgccaatattggcatatattgagcaccgacgggtgcgatgtttttttgaccggaatgaaaaagttcaaaaagcaccaaaataagacttttggacatattggagtgtatttggtgcgttcgtggcaaaaactcacttcgtgattcgcgcggcgaacttttgtcaattaatgccaatattggcatatattgagcccgacgggtgcgatgtttttttgaccagaatgaaaaagttcaaaaagcaccaaaataagacttttggacatattggagtgtatttggtgcgttcgtggcaaaaactcacttcgtgattcgcgcggcgaacttttgtcaatttatgccaatgttggcatatattgagccctcacgggtgcgatgtttttgaccggaatgaaaaagttcaaaaagcaccaaaacatgattttttgaacatattggagtgtattgggtgcgttcgtagcaaaaacattgacgaacatttgtcaattaatgccaatattggcatatattgagcaccgacgggtgcgatgtttttttgaccggaatgaaaaagttcaaaaagcaccaaaataagacttttggacatattggagtgtatttggtccgttcgtgccaaaaactcacttcgtgatttgcgcggccaacatctgtcaatttatgccaatgttggcatatattgagccctcacgggtgcgatgtttttgaccagaatgaaaaagttcaaaaagcaccaaaacatgattttttgaacatattggagtgtattgggtgcgttcgtgatgaaccttgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcacccctattcctgcaagcaaatcgaagaaacaagcaagaacaagataaaagcaatctgatattgcaaataggaatttaatacaaatgataagttgggttttcgaatacaagcagacggacggtctagccgacacgcgcgctgcaagcgaagtagcaatggctaaactttcatctaaacaaaacccaagaaaccctgaaggggtaactagctatatataggggtgggaggacgacctaggggtgcctagggtcgtgctccaccagcttggggcgcaccccacatgggccccacctgggccggggtcccaaatgaggttacaagcccataggcccattacaggtgtcacagcaccttgtttcttcagttgctgccgactgagatggatattggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcatgttgagaccccacgggtgcgatgtttttgaccggattgaataagttcaaaaagcatccaaacatgaattttggacatattggagtgtattgggtgcgttcgtggcaaaaactcacttcgtgattcgcgcggcgaacttttgtcaattaatgccaatattggcatatattgagcccccgcgggagcgatgtttttgactggattcaaaaagttcaaaaagcatccaaacataatttttggacatattgtagtgtattgggtgcgttcgtggcaaaaactcatttcgtgatttgcgcgccgaactattgtcaattaatgccaatattggcatatgttgagaccccacgggtgcgatgtttttgaccggattgaataagatcaaaaagcatccaaacttgaattttggacatattggagtgtattgggtgcgttcgtggcaaaaactcacttcgtgattcgcgcggcgaacttttgtcaattaatgccaatattggcatatattgagcccccgcgcggagcgatgtttttgactggtttaaaaagttaaaaagccttccaacat

SEQ ID NO: 75047 - DNA, 777 bp, Oryza sativa
tcgcacccgtgggggctcaacatatgccaatattggcattaactgacaaaagttcgccgcgcgaattacgaagtgagtttttgccacgaacgcacccaatacactccaatatgtccaaaaatcatgttttggtgctttttgaactttttcattccgaacaaaaacatcgcacccgtgtgggccaatatatgcaaatattgacattaattgacaaaagttcgccgcgcgaatcacgaagtgagttttttccacgaatggtgccaatacactagaatatgtgcaaaaatcatgttttggcgttttttgaactttttcattccggtcaaaaacaacgaaccctcgtgtgccaatattggcactaattgacaaaagttcgccgcgcgaatcacgaagtaagtttttgccacgaacgcacccaatacactccaacatgtcaaaaaatcatgttttggtgccttttgaactttttcattccggtcataaaacatcgcacccctggggctcaacatatgccaatattggcattaactgacaaaagttcgccgcgcgaattacgaagtgagtttttgccacgaacgcacccaatacactccaatatgtccaaaaatcatgttttggtgctttttgaactttttcattccgaacaaaaacatcgcacccgtgtgggccaatatatgcaaatattgacattaattgacaaaagttcgccgcgcgaatggtgccaatacactagaaaatgtgcaaaaatcatgttttggcgtttttcgatctttttca

SEQ ID NO: 75048 - DNA, 29856 bp, Oryza sativa
gacgtcacggctgatgagacgagaaacaccgcctgcgcggcacaattgactgcgagtctgccactctgcaacctgcacgcggccgatgtaaattcccctggaaaagacaatgtgaaaagcgtcaaactcgcacagactccgtggccactcctccctgttcatttcaccggcgtgttcagtatctgcaccctgcagcaagcagtcaccgccactggatgcgtcgcgatggagcgagcgaacaataatctaaaagccggttttctgctggtgccgtgcgagcgttgaaaggtggggggcgggtggcacacggtgtggcggcgacccggaggaggagcggatcggataagaacgagtaggggctgctacgagacgagacgagcaatatagtctccccgcaaagcatccgggcccctgttggtttaccaccaccacccggtgcggttcggtgatagttgcaaacctttctccggtctacaaagacctcagctttcctacctccacttcttctttcttccacaaagcccattccttttcctcccgttcttctcccctcccttctttttccacccactcgaatcctcccttcacattctagttctagctccgcacctttgctgcgcgcgcggatttggttcagggtttggaaatggcaatagacgatgaatcgccgctcagaatcaataccaccagaggcggcgccatggtaacgtgatttctctttttcttgctggtgttggctcgatcggtttgttcgttgttgcttttttctttcttggctgattgattgatcctaatggcggcgttggatcgaatgcggcagggaggaggaggggagtgcgacggggcggagaaccagcggtggccgccatggctgaagccgctgctggcgacgagcttcttcggccaatgcaagctgcacgcggactcgcacaagagcgagtgcaacatgtactgcctcgactgcatgaacggcgcgctctgctcgcagtgcctctcctaccaccgcgaccaccacgccatccaggtgagcaagcaagcaagcctcggcatttcttccttctcggcattggattagctggagcagctgattgcaccctttctttggaagaaacggcagctgagctgctgctcctctgttcggttcccattggaacactcaaagagctaagcgaagcttaactcgaacgagaaaaaggtctcttgagacttgcagttgcagttgtgtccagttcaaccaacggcctctctttccccacacgcattaggaacagtccaaggatcggaataaccaactttcttgaattggcagcgaatgcctctgttctgttccatctccagcagcttatctctgacgaagacgatgctttctctttttggtgttgtgcgcagatacggaggtcctcctaccacgacgtgatccgggtgtcggagatacagaaagtgctggacatcaccggcgtgcagacgtacatcatcaacagcgcgcgcgtcgtgttcctcaacgagcgcccccagccgaggcccggcaagggcgtcaccaacacctgcgaggtctgcgagcgcagcctgctcgacaccttccgcttctgctccctcggctgcaaggtacgttacgtccccccgttggccgccgccgcacgaacacctggtgttgcatcgcattgtgctgacagatgccttcttggacgcgcagatcgtcggcacctccggcgactaccgcggccggaagaggcacgccggcggcggcatcaagaagacgaagaagctgcacaagggcgcggcggcggtgccgtcggactcggacgactcctccacgaccacaagcggcgggagcgacaagagcagcgtggtgcagagcttcaccccgtccacgcctccggcgaccgccaacagctaccgcaccggcaagcgtcgcaagggcgtcccgcaccggtcgccgttcggcagcctcatggtggagttctaaagcagggcagaagcaatgccgccatgccggcctcgcccccgaaacagtggtacactgtagcatacacatatccatatctatctctatagttatagcatacatagccagtgaaaaggaggagcttagtaataacaggatcccccattgcacccctgtgcttctggatgaggaggccggtgcaaatgcaatgtgggacagttacttcatagttacagttactgtgctagtaacaacggtttgggtttgggttctctcttgtggaagaggagaggaggtagtagttactccctgtcataactactaagttttgctgaaaccttataggtctttattactcttttagttactctgtgtttgatatggtagatgtacatatatgtatatcacagatggtggggggaatggtagtaggagatggtgctcccggtgttcatattcgtgcttgcctgtaataaagatgagaatgctgctcctgatggccttcaatgtcagtcagtaatttccttctctgttttgcattgcttggtttctgcttcttcaccccttcttcccttgtactgtagtacagcaattgggagtggctccggtgaacgagatcgtgcaatgcacggagaattgttgagaactagggtaatgcgacttgagattcagagctctgtagtactgtatgtttgcaggtgaaggaatggctgctgtggctataggacggggtcgatcaagttgcgcccgccgtgcggcccccgcctaactccattgacccgccgtttggcctgtggaaagcggccgcccggtgatgccgacgttgtcatcatcatcatcgtccatgttggttgcttcctcccatacgggagaggagccatccgtccaaccgccgtccgggcatttaacgcggcagtggtgggcacactctccctctctctctctctctctctctctctctctctctctctctctcaataaagagggatcgatctagaggcgagatccgtcgtacaatgcccaattatacgtgtatatactggcatgccacgtgcgtgtttgtatatatatatgtagactcgagattgagattcccaatcgagggaaaggtgaggtgcacgcgccggacggcccctgccgtaggaggatgccggggcgaatgcgtgcatgtgtccgtccgtccgtcccgttgtgcggcgcacacgcgcgcaccgtcggcgttcggcagcgcggcgcaaaatggtgacaggcgggtggtgtgggaggtgggctccgtggatctgagttcccccatgctcccgtgtcgcgcccgtcgggattggatcgatccgccgctggcgaattcaccgcggcgcgcgcgggcttgagccgagcccatcacgcacgacacggccgttctgcccctgcagccgcgcgcgtggcgtgttgccaccccccgcactcaacggcccccgtatcgcacgcacaaacacacacgcgacgactttttccctcccacgccgccgcggtgatgtcacgggctcacggcccccgcttcctcctgggcgacctaacccctcacgtctcgccgtgtcgcggccggtcgcgggcgccgtccgtgacgcggccgtgtggatcactacgggtgggggggggggagggacgcagattgcggtggggttaggttttttccgctgatgcgtgatgggccacacgcgggcgctcggccggtccggtggtggatggatcggcgagcccgagcgcgaggaggatttggacgcggacgtggatcggggtagatcgcgcgtaagctttgggatatttccgagtttctattggctttccacaatgaaagcaacgcgggggccgggccaccgtacttgcttcgtttattctatggcaagtgttaggcggcacgggctgccttccacggaatctttgccaacagcggctgacaggtgggcccatcagtgacgctaggcacagtgacaaaatgtggccattcattcaaagttcagttgattataactgtcactgtgaaactgtggtggcttaatgggggttcagctaactgctaaccacgccattgagagggatccgattcaggtgcagtagctagtgtgactgcaagataagcagtcacattagcatcacatgattcaaaatggacgttccagatatatctgagcactgtagcaaaacactgtagcgatttactgtagaaaaggaactgttctgattttactgtgctgaatccttttaggccgttagattttgacatggagggcttggattgtgtgcagtagttaccatgcagtcctagtagctactgcatttgatctcaatcccattgagagcatatttctctccttgcctttttctgctatgcatttgtgagtggtcactggtcagtgggtggatggactgttggagttcatggcttcatggccaccattttgtcatcatatctccacacaaaggaattccccccaagcaaatgtgatagataatcgagagctgtagtggtgtggtgacagtcagtagtatcccactccttcgtgggagcacctcttttcgatcagataagttcagaggtagaacaagaaggttcataaataagagaaaacaaatgaaaagttgtggaggcaatagatcctgagcaatctttgtgacagggagagaggcataggatattagcatgaggaaaaaagtgtatgcacatacaaaatcagtagccttttaatatctcatgagccccctaaactcttactgcgctctatagttctttgtatagtccatcagatcgctttcctcgctgcagaattcacaaggcacgggcagccagtgttttgtttttcctccctcgctttgaagtccaacgaagaaaagttcagagatgtgtgactttggtgaggccaagtggtgtcggtattttcctcacaatatgcatactagttcaaaagggggacgttgaaaggttctgcaccaaaactaggtcccaggaatcaggcgttgtcaggaagctccttccttaagaaaccagcaaagctaaaaataatgcccgggtcctactgaaattaggcctgaatcaaatgacagtcatgataagctcctagcaggtgatcttagaatagaaacgacactagctacgtacattgtttctatgccaccaatggcacaagtcctcctggaccggtttgttatggcaaggctgtgtgtagttgcctccagttcctgaagttactttggtcttattatggagatggacactggatcttgacgtctgctctgtcggtctagcccaatcgtagcggaatgaggagacattgatactctgacagaggatacgatgcagaatgcagtgataagggcagtaccctcgatctactccagtaaaacaaaggcagtagtaggcccgtagtaaaaaaacagtatcgaatactcacccatatttagtggttaatagtaactggatatgcatatgcaccttcggatttggacgaaccaaatgcatttatagcacccagaaatatggttacttgttattcgtcaggcaacaggagcaatcttttttttttttgagaactgcaacaggagcaatcttgttattccttcagtgtaactgtttgtttgacaaggtacacttttgaagatgcgctgaatctggatgttctggtactttatatcctagcatgactgtgagtttggagtatcagtggatggccatgacatgtgtgaaaatatttcaagacattttgtgccatatgatgtttgcaattacagccttgcaggactgcaggttagcctctcactgtctcacaccactaccatagagaagaaagaataatcttcatcaaacagtcgaacccgtgaacaatcgatgatcttgacaggatcaacaagatggacaactaattttttggtccttggtctacgaattcatctattcatgagacatgataggattcaattcttgcacatccctatatggtctacgacgaacacgcagctaaccattattttcctcacttggattgggccccaaacatagggctatccactgggccgacgcaacgggccgaattacgatggcacacggccgtggcgaatcgaaactgggtataagcgtcgccgcgaccaccacatcgccgcctcacgttatccgcgagcgaaccaatggcggcgctctccctcgcgcgaagccccccccaccaccaccacgccgcggcggcgctcgcgctcccggccccgcgcattccccggctcgcgccgctcctccgcacccctcgccgcccccacccgctcatcgacatccgccgcctcccggccgccgcggtcgcggcctcctcgcctcccgaggcgcaggcggtcgaggatggtgaggaggaggaggaggaggggggagagaagcggcggaagctgtacgtggccaacatcccctggtccttccccgcgccggagatcgagaagctcttcgcgcagtgcggcgccgtcaaggacgtcgaggtgagtaaccggtacggcccagttgccatgcttatggaggcgtagctttgagttctgggctatggtgttctgagacacgcgtggcttttttttttttttgggtgaaggtgatcaaggggaaggatgggaagaagaaggggttcgcgttcgtcacgatggcaacggcggaggaggccgccgctgctgtggagaagctcaactccctcgtgagtttgtttactgttttgatttagcgtatgaaaacttcgcgctagtctatcgattagaatatgataatacacatgcactggatatcggattgatagagcacaaatgcggctaacgccctgtttagattcaaactttttttttaaacttacaacttttccgtcacatctaacttccctacacacacaaatttccaacttctccgtcacatcatttcaatttcttcaaactttcaattttagtgtggaactaaacacaacctaaatgctatttttcgcacgcaaagtggaaaatggttgcaaattgcgatgcatgtttagatgtgtctgttcatcttactttccttcaatccccacaggatgaggactaaacatggagacattgctatttcatgaatacatctggatgaggtctagggttatacttcgatccccacatccccatagacaaagctgaaaaaaaataatgaaaacacacttttatatatgcaaaaatcatattggctacttgtttctattagtggagggatggatgcctataaatggtggaaattcaataatttgattatatagtacaagcttatattatggtagactcaaaatttctcacaatagtatcagtcaggtacagttgaagtattgttcagtgatcttatcatcaacatgctagcagcttgaagtcagatactggcggtcctgacaagaatgatatagacttatatgtatctaagctcctgacaagaatgatatagacttatatgtatctaagctttcgtggtactcagcgatggagatcttattactagtttctgcatcactgatcttttgcaggatgtcatgggaaggaccatcagggtggagttttcaaagagtttcagaaaacctgctcctcctcctcctccgggcacaattttggagaggcacaaactttatgtgtccaatctcccatggaaagcaagggctcccaatatgaaggagtttttctcaaaatttaatccactttctgctaaggtggtctttgatagcccatcaggaaaatcagctggttatggttttgtttcttttgggacaaaagaggaagccgaagctgctctcactgaactcgatgggaaggtgataactacatggactttgccttccaattttacattttataccaagaatgataactgatcatttataaattaacttctgcaatgttgtttaaattatcgattgttgttaaagatttcccattaggcatattaagtaatgtactaacctttagtagtttctgccaccttccccccaattttttgacttcctatgaaataagatgctatatatgtaagattgcaagcacattggacaccatggtattaaagtttacatttctttgtcatgcaggagcttatgggaagacctgttcgtttgagatggcgacaaagtgtagatgattcggatgacagtgtaaaggctgatggtgaaattgaagatgcaaatgttgatggcgaggctgaaggtgtcactgataatggtactaaggatcatggtgaagataaacaggaatagtttaacaatactgtgtttggactcggagaaagttaccagcagcctcattaatagtacatatgtggagcctcattgtacagctacaagttttttacatttcctggtgcgtgactaatataatctaacttagcacctcatggttgatgcttcatagtcacactagatgattgaacttgttttatggtggaaagttccatttcttaacacgccaaaaaaaatcagtaatcttgtttcacctgctttatttagctcaactgcacattttcgcctgcatatatttataaaaaacccaaaacttcatgtttttatcatttgtaccaatcaatctttaatgcactgccacatggacacctaatatgcaatttggcgagcatctctatgtttttatctgccagaattggcagtatattatcatttaccattaaatgtctcttgttcgttaccatgattccataataatgtgagattgaaaaaaaatgcggtgctcaggcgaataatttgttgtttgagataaactgtgtcatgtagacacgccataatgttatgacaccatgttactttacatgcaacaatttaccatacctttggcattgaacagaaattcagatatggctcttttatttgtagattttaaacagaggagatattgtaatcaaatactgcaatatatgtctgtggttgacggcttgacgctgataaggagatgaggaacaaaagggtgccacctctgacctaaggtgaaaaattgttgttgaatggattaatattttaaattttagtgttcattttcagtaatgtatttactctaattatctgtaatttattgtgatcatcaatcttctcctgctgagacaattgttgtctcagcaacttttaggtattccctatagtagtccttaatttgcccaatgaggtactattaaaatacaagttactcttttgtcgtggacatcacctgtggaaaggataaaaagggaaatcatcatgccgtttactgtccccttgagttttatttccaaatagccttcaagatttaactttgactattggtttcacataaaatatattattaacagccgtgaaaccaatgttgtgtgaaaacactttaagtatggatctattggtgttattattacacactcaataaagttgtagtttaattataattgttggtcaaagcctacaaagtttgactcgtaaaattaaatagttcttatcaaaatcaactgagggattgagggagtatgttcctggaacgtttctctcctattgctgcatatgattctctttaaccctggagaaccataacactatttttcatctctcatttttgtagtgattcttgtaatacaaatctgaaaatactaaaagacgggctgaagactcctagaggtctttacagaatattgcttagctttactagtgttttgatcatgcacagtatgcagtacctgaatcatatatgtttttgccaacagatatgcatgtgctagtcactgatggtatgctagtcataatagttgttgatgagaatcaggatacccgttgcatttaagaatagaagcatctagtacccagacactctcattgcttgctaatgatgcatctgcctattgaaatgctttcaaaacttaacgattcatggtaagcccaagaaaggtttccttcctattgcaagatgcctaggctaagaaaaaaatagttgaaattttcttgcaccttaactttagaccttccactaatcaaacactatggagtgtgttgaaaactttaagcacttaagtacttgcaacttattaggttttgatatactactagagcatgtactcgatggttgcatgcatatgttgaggtcttggaagtgtcatccctcgatagcctatggtacacaggatagtgtaactgaagtatttctctgatgaactgaaccaaatagagttgtcttgacaacattcttaatccacaagagtcaacaataggctgtttcgtgaaactgcttgaaacagttcttaaagagttatgatccagtttagtcccctggataagaagttgtaatatgatgatggtctgatgactacaaaagcaagccatgcgcctgactttatgtggcacctctccaaggaggaatcgagtggcaaataggagcatattttacttgttaaactttaaagcagtcgctcctgcaaattttaaggaactaatgtgggcctgattgatccaaactgagatctgattttcgcaaatatgtccaggagatttctttaagtttcttcataggagtgttgagtcaaaaagtcatccctatcagtgagattatacttttggaaaagaaaaggatactcctattcctctattacctggtccaccactttatctgactgcaacaaaacttcaattgatctatttgcatgttctggtaagcatgttcaattcgagggagatgtagaatttaaaaatacccaaaagggttaaaaatatggcttttgtagtgtgaagcaaatgttctttttgagaaatagttaatcatcttagagaaatctaaacataattttctttctcaaggtcatccctcataaggagtgagaatgaacttgatttgatagtcctctgtaaataacccaggaaaatagaccttagtattagaatgaaaccgcacagtttcctttatctacatatgcacttctctttcctatgtgtatcacgcagtgttattcctgctgtagcgtcatacggaagtgatgatttgatcactgaaagaagataattagacatatcaaatctgtctgttcttcacaatggggactatcgtattaaaagttgcttgttccgttcaaaaaaaaagttgcttctaaactatttctgcatatccatttccttttgtccgatttcttctgtataaaaccatgtttgttgttctggcttaattatctggaataaaattacattcatgtgattcatgaatgcattttgtcttgaatcttgatttgttcccttttctttagtgtaatgtggatacacggtgaggctaaactgcatttctgtgcatatattctgcttgtcgatccaaattgccgtctgaatctccctaacgctaccctttgacttgaaatagaagtatatggtctctttttaattttacaagttactaatgcaagctatcaaacgctttagtgggcacagcaatagtattagtgctggaaatggataagtatgacgaaagctgtcaaatagtgctagtaatcattgtctccatttacttgaacaaatcagattgtttcgggagatttcaagttgtactgttctacttagtcccaactctgtcattcttacaggataatgatgttttagctgctgggctttgatgaaagttacttctttggcacttaagaaaagctttcaagtatctctttcacaaaagcctacgtcatctttaaattaggaaccagataatgaaattcaggatcatctttaaattttgaactagagtaaactttagctttcagtcaccaaactaatgaaattctgtcacgctagttaaagatgagaatgcacatgaccttatcacgctgggactggtagaatctgatactgatagttgtcatttatcccgtacagtggaaccttgtttggctgcgctgcactgatgcagcaacgccaccttcctcgtgattcgtgaactattctgcccatgttttctattcgtactatagtgtgttttaatcataccaactggacatcctctcttcatcttctgatctgtgttggtgttgcaaaagagacggtggagtttaaagaggaaaggaacagcaacggggcaaaggaaaagagaagaaagaagacctgcagcacccaaaaacaaaagcagaggtcccccaacacaaggcaacaaccgctcaatcctccacccaaattaaaaggagaaaaatctttgctttgcaacaagcaaactcctctcgtcctctcagccagaggcatcatcttgatatctctccccatcctctcacgactcccgacaccaagaaagcaagtataccatggattgaacatatacacggccgtcacacatctgtctccttccctcgtctcctcaccaatgattcggtccagaaacttgcagagatcctctgctagtacttgcacagagcctcagaccgagcactgaggaagcttaacatctgcctatcttctttctagttcttccctttctctctgttgttgcagtcttgcagctgcccgatttcgtgttctacgaggcaatggcatcctctgctcctgcttgggtcccctacgagccaacgagagattgctctcaagggctgtgcagcatgtactgcccccagtggtgctacttcatcttccctccgccgccgcccttcgacgtcgccggcaccagcgccgacgactcctccggccctgtcttctcccctctcgtcattgcaatcatcggcgttctggccagcgccttcctcctcgtcagctattacaccttcatctccaagtactgtggcaccgttagctccctcagggggagggtcttcggctcgagctccggtggcgctgcttatggcggcggtgccggtagcggcggccgccacggccacgggcagtcgaggagccacgagtcatggaacgtctcgccgccgagcgggctggacgagaccctgatcaacaagatcacggtgtgcaagtaccggcgcggtgatgggttcgtccacaccaccgactgctcggtctgcctcggcgagttcagtgacggggagagcctccggctgctacccaggtgcagccatgccttccaccagcaatgcatcgacacttggctcaagtcacactccaattgccccctctgccgcgccaacatcaccttcgtcaccgtcgggttggcgtcgccggagccggagggctgtgctccaggcgagactggaggtgacaatacacacgaggtggttgtggtgatggatggcttggaaaatctttgtgaagagcagcaggaggcagtgagcagggccagcactgccgatgatgatcacgatgcgaaggacgtcgcagaggggatggaggaggccaatggcgcagccgagatcagagaagaaggctcgccgccaaagaggggcgcgtcgtcgtttgatcttcaccgtgacaaccgcatgtgcatcgccgacgttctgcaggaatccatggaagacgagctgacggcagccagggagagtggcctcctcgcaggcggcgctggcacgtcaagacggtgccatggcgagaacagcaagggaaggggaggccgcagccgacgtgcattgcagctgcaggacgccatggaggctctgccggggaagagattgccctccggtgggagatcctgcttcagcagcaagagcggcaggggaaaagattcagatcatccaatgtgaggcggtcagttctcattttcttactctaggatactggacaagcaacctttgtttgcatgatgagatgcgaatgggaaaaaattgcaaggacaatcatcataatctggagatgtcgtcttgtgataatgttgatctgctgcctcactccatgtgatgccactgccaaatcgatcctctgcagtgcttggttggtaatgtctcttttgttcatagttgagaaggacctgagagctgatctctctctctctctcttttgctctgccattttatacattacattgacttcccaccgttcaatttttctgtggagtttgttcttctgtgagttcactagttcagtaccaaggctaaaacttttctccaccttgcgttttctttggtttctacgcattggcatttaggtggtgcggaaaagtgaaggatcaaatggaatggtggtgtgaactaggcctatgagtttgacataaaaaagtagcttttgttttcttgcatacaagaatcatttttttcaggtaaaacccaggagaatcagtgtttagaacatcatcatagtactgatggacctattacttattatgggcatggaatttgcaggaacgggttggagtttgctgtgaaccacgaattagtagcttagtactgacaaagttgcaaactgacaccaaattagccacgagttactgcgtgtttctagtcaggtttcagtctggatcaaattggaatttgttttttctctcatctgctttgcccaaatctgttcgttttaggagaccagcggttgcttctctacctagttgcatatgtatagacaaagtagttcggttgaagtttctgtgacagcgatgaagctggcatcttctgactaggtcctattagccctgcataacatgcgtttccgatattccaaatctgtggtcggggattaggttgatgaaatataagtgaattatctttgcacacgttacaaactcactaatcacccctagtctttttatttgaagtgttggcttcccaaaatgaaactggtttgcttgcaactgctgtagctttgaccttcccattagtattccacgaaaatgagcttgaactccctctaggtagacgtctttatcacactcgcaagtgatctgcattattgaggttgatttgtggccattatttttcccactaaggcggcatcatctttgtgcatgcaagcactaaagaaatgttcctaatttatcagcaactaaggcaatggagaaagcatgggcatcctattcctgccttcctgctgcttttgtactttagacgagagcttgatttcgtcggtgactcggtgttgtgttttgccctgaaatgaaatagtttctagtcggcgaaagcactactaaagatgcgtcaagatggtgttttaattccggtgagttttgaacacaatgcaggtggtggacgattgagtgttggtacttttgctctctttgcgcctttgttccgaattcacgtgaggaattcaggattcggcggaagagactagagagcatgaaaaacaaagtcaaaaggggaaaagaggccggtggtggggtttggatggaaaaggagtgtaaattagtgagagcaagaataagaatgtgcacattgtgaacacgtgtgataattattcgaacacattaattcccatgatctaaaaggacatgactatctgtatgcattggagaattagcgaggacatgactagctgtcagtttgttatgactcttcaccatgattctctgatcccacatggacgatgtggattaggcgcgagcatcagccaaatcacggaacaggtgaataagggtgtgtttgtcagtgctccaatttctaattttaacttcataagttgtttctgaagtgaagttgtgaagcagcataaatcctgttccagctctttagtttatttttcttttaaggtaatgctgaaaccgtttacttgaacttaagtctgtcaaacctgccctaagattatgactccaactactcaaagaaaatcctgtgttcaattgggccggaccatgtgctaatctcaagcccataggctgtgtacctagtcggcccaacatggagggacaagcaaggataaaaaaaccctctcttcaccgtctcactcccccggattccacgtcgacttccgccgagaaaaccgcaaaacgcacacactcgacggcaaaaaaaaaaaaaaaccggctaggattacaacgggccgcatgttattgcacttacacgggcttttgccctacgccaccgacccccaaatcacccgactcgcctacgggaggggagagatcgatcgagatccgctacactttacagatttgttacaccggccgccgccgcgcgcctatcttgctaggtggccacgctaaccggaggcctccccggcgagcagcatctgcgacgccgcctcggcgtcgatgatgcagagcacgtggtgcaccgccgctgcgatgtcgtccaccgtcgccatgccgcacccttcctccacctgcaaatgcaaaatccacacacaaaaatcaaaggattgcttgatgccacaaatcacattcacatccggccaacgcaacacaaagtacacaaattaatgcccgcaaggcaaagtgggcgattcgagggaaatcaaacggcgattgataagcaaaggtattacacgggacagacagagaggctaccacgagtcgatcgcctagtcacacagacacagaggctccacaagcacaaagccgaggaggaaaaaagcgaggcacaggcgacgcttttcaatagagcgatcgtttcgtaaaggcagattctctgctgtaaataaaacagcgcaagaaaaggcggcagcagcacacaatgacacacaaaactctgtagccctttttttcttttctgctgagatttcgccttggcaatctactccccagcagaaagattctccgtgacagtgctgtccatcgtcctctctctccctccctctctctctaaacctatctaggagtataaaacatatatatataaaattctgcatctccctttgtgagtatgaagtgccatggcttgatatagtgcagcaccagtcgactggggcacatcaagttcagagctacgtactcttaccactgtagtactgtaccacagatacagagcacagagaaagaacacacccaaggggccaagggaagcaatggcctttccgccatggaatctctggtcaaaagcaatcggccatggcagatatggagcagcatcaacagcagcagcagcgagacgcaattctgatcagtgatcacccatgcaatagcctctactagtatagtaaaatacccccggggatgttggtctacgtacgatgggtaacagaggagaatttatgacacgtttattgttctcgtgtactacactatataggcagcaacagatgcatggagatgattttgcttccctgtgtggctggcgagtatggcctctcatgattgtcaagacgtgtgcagcgccagctgagccgcgtacacgcaagcacggtgtatgaggctcatggcctcacgcatcatcgatctgtacacatgtggagtcgtgttggccatatgctaagggggtgtttgggaactagggactaaatttagtccctctcacaaaaatataagtccctaccatagagacttatacttttgtgagagggactaaagtttagccccactttagtccctccaaccaaacaccacctaagacaatccgtttggtagtttgtatttgggtgtagtagtttgtatatctgagctgatcagaagtatggctgtctctcttgcaaacttggttggtcagtttgtcacatcaggtgctgcacatatgtactacctccgttcaaaaaaaaaaaagtcaaacctaagtttttgtgttcaactttgactgtccgtcttatatgaaatttttttataattcatatttttattgttgttagatgataatacatgattaatattttatgcatgacttgtctttttaatttttttcatatttttttaaataagacggacggttaaacgttggacataaaaactagggtttatctttttttgggacggaggaagtactctactactagtactagcaagtagattatagattattcgtgttattaatctaactcgcggacatctcatgcgtatcttatgtggagtatgtatcttggatgacgaaacttctcagccttttttttctgacggtttatgcttaaaaaggaaacgcaaaagcaacaatgggccatatttcagcaagaaaacggaggaatttttttggcagcagactcctgtgtatacgtaccttgacgctgatggagtagagggcaagcgagccgagggccgtgacgttgaggtggaggacggtgagccggagcgcctgcaggccggcgaccatcttgagcagctgccccggccgccgcgccgccatcacccggatgctggcgtgcgtctccacaaggctcacctcgatgtccgccactccggcgcggttctccgccgccgcgcccccgcccccgccgccgtcctgcgccgggttgtggcaccacacgtactgcgggtacgtgaagaaccgcgcgaacggcggtccatcagccgccgccgccgccgccgccgccgccggagtctcctgatcggccgcgctcgtggagtccgcggcatcacacttgggctcccgctgctgctgcggtggcggcggcggctgcatcagcagcgtgcgcttctgcgcctcgagggattgcagcagctgctcgagctccttcacgaaatcaatggcgccgccgacaatggacgcctggtcgccctacacgccgaccaattaaaagcaagcaagtgagcgacagtgaagtgcagagacgacagatcaaatcaacctagcatacctagcatcatcgcgattctagagcgaagcagttgtgtcagcgagagtaaactagaacagtaataatgttactatgattcaagcaatgataatgacatggagggggcatgcacattaatggcacaaagtggccgaggaacgtatgccccatggaggaattaatgattcattattgggatagcatgaaagagacctggaaattcctcaatattcagttgacgagaaagagcaaaaaaaaaagtgcttaaacatcacaaaagttgaacgaatctttcttaaaaaaaaagttggatgggtacataatggtacgatttttatactagagaaaaatcacagtgcttctcgccgaaacattctcttgccaactccagttcagcacaacccaaaatccaatgtccaaatgagaatcaagctagggagatgaaccctaaggatcagttctcacctcagatcagagttccaagttcagcgtacaggaaatgtagaatgttagtaagtgctagtgtacgtacccggtggacgtaggactccggcatgagcgaccggagcacggcgaggtactcgttcatctggcggcggcggttgcgctcgacggcaatgtgggtcatccgctggctctcggcgtcctcccggctcttgcagctcctcgcccgccgccgccgcttcctcctccccggctgctgagcctgcttcagcagctggtccacctccggcaccgccccggccgccacctgcaccctcgtctccgtccccgccgcgccgccggcattattattcccgaagaggaagctcgccggcggcacaaccgccgccgccgccgcggcggaggcgttgaacgtgtcgtagatgaggacgtcgccgccggcgctgcacagggtgtcaagcgccatgcccgattgaacgaacccgcgcgtggcctctcgtccgtgtcacgacgtgcaaatgcaacctctcctcctcctcccttcttgctgcctgccttggtagctaagctaagcttgttgccttcctcttcctcgaaagaatagataggatgcagcaagctagctagtgagagagcgcgagaccacaagcagctggcggcctggcgctcgcgttggtgctacgcgtgcgtctctagcgcaacatgggagggaggagaggaagctagctagcgcaagattgggcaataatatccatgcgagagcgagagagcagtggacgtcgcaggagctaagctctagctgccgcctgccgctgtgcctccctccctcctctctagcgtgcgtcgcagttgcaggcaggatttgggggggggggggggggggggcagatagaccgtggatatatcgatccctcctgctgcgcagtgcgcaccacgcaatgctccaagagattggcaccaaaagctcgctttctttgggcgtcgtcgcggtgaaatcttcgcgcgcggggagctagctagcagcgaccagcgaagctctctctccacgtgaggagagatgggtggtggatcgacaatgcttctgcttctgctgctgctgcttcggctgaaaaagtgagggagagactgggggtgggaagccgcggaaaggagagtggaggagacgaaagaggtgtggtctcactcactcacttatctttcatcagcgacacatctctctctggcctctgctgtgattttttttcttttttcttagctttgtttgagatatgagtttgtggggaaactattctaatccctcgaggggatgttccctcgtttgctcaaaaaccatctaaatggttatgaaaaattctggaaaaatttgacaacattcatacagcacatatatacaacttcacaaaatcttaagttcaaactcaactcacacgtcgagatataaaaaagacaaattcagcgtatgaatagtagcgtactgtttatatctaaatttgtcttttttgtttctcgatgtgtagatcgaatttgaacatgaattttggtggactggtaggtatcattatactctacattgtcaattttttttagattttttcacaactatttacatcgaatttaaaagaaaaatgtatacgaggggatattcactcgagagataagaatccactcccgagtttgtgtggtgatgtccggttcttggtatggtatgccaagcgaaagtcaccgcggcaggggggggggggggggggatgctgatgctgcggccgagctgaggcaggagagaggggggccccacacggcagcatcttgtgatgaggggtcgtctctgattgggaatgaccgaacatggcggtcgggtcgggtcgggtcgccgagtttctttcacagccatggctcctctatctctctctcctgataattcacctggcttctccatggctccatctagcagtaggctccatgcttcagtttatcatccgattattgtgatgaattatttacatcacgttttcaaaaatatcattttaaaataaaacctcttctatcttatcgctgagctggttacttgtttcaaactatttcttagctttataacacatcatattaattttttaatcaaatatataaactatcggtttttatctgcaaatgatctactctctccagattaaaaataattattgttttggataagatctatgtcaaactttaaaaaattgactatagataagttctaaagtatttacattaattggaaacatgaaagacaatttatatagattaatcttaaaatgtactttaataaaattgtgcatttattaatatttatatatactataatagaaaatagtggtcaaagttaatttaaccatgcaattgtctgagatgacaattactttactagagggagtattcataatgctacgactaattcagcagcgccgtttgctggaagtgatatattttcagtggctgtcaagtgttaagatagtactgagctctgtggcagttgcttatgtgatggtgccacacaatcacatgcgtacgtgaagaagaattgatgtagggtgcacgtacctagccacatggattaacagtgggcacagaatgaggatggtaaggagagtaggagacaagggccacacaccagctatgcgtaccacggtaccagtgtactttcgggtttgagggacgctgtccggtggaccccagccccgcgcataagctctggagcaattttaatctggcaagctctttctatagtgcaatgttaaaaaggaaaatgattatatcgaagccttttggacggatgtagtagaagccggatatttaattaatgtttcttaggctgagcttatagcggctggcggttcggaaaaaggacgaataattcgtgcataattaatttatatctgtatctatatttatatttaatagaaaatagtataaggcttttcatttatcgtagtccattcatttttttcatcgcctttttttttatcaataatcctttacacacatggaagggttcttaatttttggtgcgcacacggtaaggcattcggtttttgattgtctggtcttttttctgttgccgtttttttatctcgtccgatcctatatccacggcacttgcgtgcagcgcacctccagccatcgccgggccgagccctagtatatcgttgttgcttcaatctatctctcgtgtgtttcatcctccaattaattaaaaaatcgaattcccgctccttatcatttttctcatgatgtcctctattaattcggccccaaatttaatctccatttaaccttcgccaatgatggctggccggggagcttccccaaccattgttgtcttgagttttgcagattcgcttcaattttgaaaaaaaaaagaaaagaggatatcgtgtgatcaaaatccctcaactaattttgggagatcgagaaagattcaaccgaatttgatgtgggatcagctcgggtttcatacgggcacgggtctatcttccatgggttgaatacggtagttggttgtgcgagctgggaatgcggttccactcgtgtgctggcccgaagatatgcagaccgagtggagggaggtagtggactgggttggggctgaaaaggaaagaatgaatgggttttcgctcaaaaccaaggaagaatatttagtaactttttcaattataatgtatatcgatactatatttcaatttgcccaactcctaatagctgctgtatcactgaaaaaacatctttacctattgcaacgcacgtgcattttttctagtcaagtataatagctataaatttaaaaatatatttagttgattatttaacaaaaatacttctatatactatagtagatatatactatatatatggacatagaatccgagcattaattgaaaagagatagttatttgaaagagaaatacatgagtgacattaaattatttagatcattcttaaatattgtatattacgagagcaaaggtctaagtagtagtgtaaatatcgataagattagggatggcaatttcccctgcggggccgggtcccctgcggtggcgggggcaggggcgatttcagaccccgcgggtgagtcagggttggggccccgcatttgagcgaggaggggacgggggagatgtttcacccgcgggtgacccgcggagccccgaggatgtatattagacttaatcatagtatgttgtaagcccaaaaggcccatctagtctatcatatatatacatccaaaccctaatttccccacccctccccaccctattctcaatctctccccacccacccaggcagccaccatctccacgactccaccagtgggcaacagcgtcggtggcggcggccaaggcgcgcggcggcagtggcggcggcgacggcagccaaggcgcgcgcggcgtctgcgacgtcgatggccaggcacggggggcggcatcaggcagggcacgtgcggcggcattgacagccatccgcgggcggcggccacggcgcggggcacggcggctcgcctctttgccttccagcttgccgccctcgtcgccatcgtccagctcaccgccctcgtcgccgtcgttagctcgccgtccaccggcccagtcgggtattgcgggggcccgctcacccgtcgggtcccctgcggggacgggggtgggtgacgttttccacccaaccacctctgcggggccgggggcggggggagaagtcggggatcgagcgggggcgggggcattctagcccaatccgccccattgccaaccctagtggagattatatatggacaccacccggtgtcttacatacattagaaactgctcctacagcagcatatttgaatagtgaccacttaccataccgaattggaatctcatgcagtttctatcgagattacaagtttcgagccatctattttattaatgaattagctataatactatatgtaaaagtaataaacaattttagtgccgtgagctacagtatccggacacgtttaaccattacgaagtagatccgaatctaatagtcggtactggactgcataagttacagttacactaccgactacagcggatccaaatcctaccataccaaggctgtgttcgggcactagggatgggaacgtgcacagtatttacggaaaatggagtaatctattagcatgtgattaattaaatattagctatttttttcaaaaattaatcaatatgaatttttaaataactttcgtatagaaacttcttttagaaatacaccgtttaccagtttaaaaaacgtgcgtgtgaaaaacgagatggaagtgttgggaacttgctcttgcaaacacagccccaagtgtgcttacaaaacaagcacagtttgcaagaatccaactgcatcatgcagaaatcatgttcacgcacaaatcgaaacgtgggggtgtggcaactccaaggacaccctctgcgtcgcgtagccttgaatattcttgtggtcgtagacaggcagctacagtcgtcgtcgtaattcagttcttttttttttttactatactcaccatgtgaatgctctctgctagacacccttctctatagaacaaagcacattgtaagctgatggccgccatattttgctgatattctttgtgcctgtagtaccaactatactaccaagtaacttgtgccgagaaagataccccttaagaatgtcttttgggatgcaaccagatgataaacagatcgaggaggcagctagatgacagtactagttcagaacactaagaaaccggatcagattaggatacaacttcgaaagaatctaaccagcttttagggcatatgatatgcatatactcaaggaaaaattggaatcatgccattataattttacaaaatttaagatatgacatcctgactcatatgtcattgatttatgtgggtcctacatatcattgagataccgatggcacatttcaaactttataaaattataatggcatggttcaccgtgagtacttcaattcgaaagagtacttcttatatcacagcacgcaaataaccgtgcaagaccagacctctgatctcttctgcagtggtttcgttctccgttactgccggcagaagcatctcggatcagcatagcaattgatgtatatgctattttagtagctaggcatctcccgaggtagcctatggcacaacagtatcccgttccccatacaaaaatgttgtatatatgatcgctttggcgtcttggttaacataatactccagtagttacatagttaacggaagttgattccacaaaattcacataagacagtagtcaaagttgattcttatggagcttgatggcttaattagctggatctgcatgcccttgagtatgagattgaaggattaattatagcccaaggcatgattatatttttaaagggaaaaacatcgctaatgttatagaagaacgatcttgatcaatatattcctgggagaatcaggaaactctcgtgcgatccactgagacccctcatgctaagggaaaaacatcacccatgttaacacgcgatgttagcacttaatagtacagtgttaaaggtatatgatttcaactccgatgtccgatatttaatttttaacatgttaataatttctttttaagatatgtttggaggaaggtctctcccaccaaatctcgttttttgctatccattgttaacaaaggggaagcttgagctgatcattctcaactctcaaattaaacgagttctgcgccgcgcgtcgtcgtgcgtacgtgtatgtaggcgctcaaaggaaaaaggcaatcctagaaaaggttggtatcactgctgcacggcgcactttccactcgcgagttttgttcgcgtctgtgtttggggagacagatttgcagctatttcactgttcatggcgcggtttccaaggagcaaaggtttcgctgatcacatggatcccgctgacagtttggaccatgcatatgctggtggtcgactaaccagtactagtacagtagtacttggctagctagaaacctatacgtacgcacgtattttctacaggagacaggagctgattaaatcagtttgtgtacccgaactctgtttcgtacgcatcgtaaaggacgtatgcggtatggtacgctacacccgaaactactactaccgaacagtgtttccgccttgtcgtatgcctcgtttgcattagtggtactgtatactcctcaaccctgtacacctgcatgcatgtagctgagggcgatcgatcagtactaccacactatcaccaggctatagctgcattattattcagcacgtacatgcttgctcgacggtaaccctataagccgttatactgaattactgcacgtagttattcctagaagccgttaattagcatgtgagcgaaagtacgtactatcgtgtaccgctagtgagagcatatggatggatgcaggagaaatcgatcacatttaatatgttattgcaatatctcactggagttgtctttctgtcgagctcactcatcaggggccaataaaattaaaccatgggctgatgacagatgacactatgacagatcggacgctagctagcggcctagcgctattaattaacgatttgcagagagagcaggccggccgttttggagtcatatacatgtacagcgtgtgcatgcatgcaacgagggctcgccggccggctggcggccgtccttgatcagagatgtgtgcagtgtgtgtgcgcgcgcgcgcgcgctgccatggtcgatccgggatggatatctggctggctgttacgtgccaaagcgaaatcaattgtgtttttttggtggcacgcgcgcgcgcgggggaggagggtggagcacggggcacgggccgtgtcgatcgatcggatcgctgcccagatcttcccggtgcagtgggggcataccgcgtacgtaagtactgattttgagttcttgcttgtaacgtttgaccactcgtcttattcaaaaaattttgaaattattatttattttatttgtgacttactttattatctacagtactttaagcacaactttttgttttttatatttgcaaaaaaaaatttaataagacgagtggtcaaatgttgcatgcaaaaactcaaaattcattatattgtgtgatggagagagtaggaaagagctcagaggagccgtagtcaatggcagatgcaggggtctgaccgggttttacagccttactgcaggaaaaacccctgcgccagaatattttattttaagatgatagaatgaaatatttcgatctttgctcacgagctacaaccaattattacaaggtttacataaaagcaaactcacacagtgtacatgcgcaggaaaataccctgtgccagatgtacggtcactgagttggtccaaaaggcataataccatttctccaatatatcaaaccactgtatttattgttcactatagtaattataagggtgtgtttaagggaagaagaaaggagaagattgagaaatacataatatgatatgatccattaccatatgattaattaagtactacatctgtttcaggttataagactttctagcattgcccgcattcatataaatgctaatgaatctagacacacacatatgtctagattcatatatgtgtgtgtgtgtttttgtgtgtgtgatgctagaaagtcttataatatggaacggatcggaagtattacttattttaaacttaaaaaatgtagtgatatgattttttttaaaacattttcttttgcaaaagacattgttttggcagttcgatatatatgtaaatgtaattcagtaattgtaaattaatcgttttggcatgattaattgtgcacgtaattcgcacaatactcttctcaatcgaataggcagagctccggccgttttatatttttgttttctaaaaagaagtactctcttcagtgtattcttattgagatttctacgacacttgagatgtacttgcgagtgtacgtagttgccggatatccctatatatagtcctgtgtttgattacaccccacttttgttcgtaattatcatacgcgatatttcttcagtgttacccaactttaggtatattttttctggtagtgctagtgcttgcaagctgtaacatcacccaggaaattaatgttttacgtaggtgctggacagatgaaaacaatattaggttcacgagagtactcgctgtcggatgcatgcacaccacagatcatgtggtctgccactcttccctgcagtgatcgagggatgaagcttgccgtagttggagatgagacatgatagaggagagacgatatccaaatcctcgcaaaagcacatcgtttggtgctatatttggattcaatgcagctatggaagtataactcgagttcaaatcttaatgtccataattacgtctgttttttatgttcgtaaaaactacaattttatcggggagagcggttctaacagttacaacttctttcatcttcaactcctctcaaacaagatatatttttacaccaattctaagatgatgtaagtacaaaatacagtaaataaaatagaagataaaaattgaaaaatccagcttttccggggattatcagaaactagctccctgtacgaggttcgttggatttgtctataacctctatatattaaaggtactcgatcgagtggtacgtggcttgcgcagttgcgtttgctcgttgttaaagctttgtatgcatgtgatcgaaaaataatcacgtacgtccgctaattaattacctccagtacgatacatgcagcttgccatgcacatgtacgtacgcatgaacccatcaacccacccccacttatatatgcaccgtgtcgcacaccgattctttcaggagaaggggagcaaaaccggccaaccggccggacacggtccaaccggggcacggtacgtacgcgcgggtggccgggtgtacgcgtgcgccgacgcctgcagaaggcgccgctcaactggaagcgaatcgtgatgacacggtcggcgacggtgtcagtcgacgcgcgtacggcatctcgatcgatctatcggtccccgcggccgcgcgcgcgcgtggacggcatctcagcgtcaccagttcaccacactgtgcgagtgtgcgactgtgcgagcgtgtatgtgcggtaccggtcgagcagctagtggcagcatgccatgcatgcgtggatgtcgccgttggccccggcctagcacgcgcgcgtacgctccaggtctccagcggtagctgcgtgcgccacgtgcagcgcaggctggtagtaccctcttggccccggtcgatcgagcgccgagagctgcaggctgcacggcccgatcacgaattcacgatacgctgcaaatgcacccgtttggaacaagggatatttgcatttttctgcgaggccagttgaactgagagtagggcgtgggctgtgattttaacgtgaccctgttgtgttttgggcctcaaatgagggaacacgtaggagagctttcatggattgcgtttgggcctttcaggccttctttttaattgttctcgtgatctttttttttaaaaataagtccactttgcctcccttaaaaagtgacccgaatctaatccataaccctaaacgcaaatccagatatctcgatcccccgaactattgaaatcggtgcaatttgacttccttagcggttttggagggcggtttcgctgacgtggcggtgttgacatgtctgtgggttgacatgacgcttagatgtcatttgaattaaaaacgtatatgtgggatccgtttgtcattcacacacataaaaaaggtggggcccactgacatgtgggcccaacatatcatcctctctcttcttcttcctcccctcttcctcccttctctgggtaccgagctcgaattcgccc

SEQ ID NO: 75049 - DNA, 24524 bp, Oryza sativa
cccccccccccccccctccccctgcggccggtagagcagcacgagcgcgatggccggcgcatgacgagcgcaattggcggcgtttgcgattcctagaacatgaaaatcggacgaggccgctgaatccttcgagacggtgccggaatacaacgagtagcagcaacgcacctcgccgatgtcagcagctaccagcaggttctcgtgcgattgctcaacggcgcgaggcagcaacctccgcggcgccgcaggcccaggacctgcaggccctctctccgcctcaccaagtcactgcctccgtctccgatgcatatcacatccgtacgtacagaaattttcaggttcgcaacatttttttagcataccatgaattcatgatacgaatgcaatactatctcatctttaggattgtgagggtattatgccattatactctcacgcaggaactctcctccgtttctgtctatttgattcctctatggccgcattcagttgattgactgataccgccatccgccgctgctcgggtgctctgatcatgtgtactgcactactcctgtctgtctcatatggcaaatgtacattgatgttagcactggccactaatcggtaagatctagattcgtttcaattaatatgttgcttttctagctttgtaatttatatgagtttagccattagtatattaattttctcaatcatcaatttgttcttttatcacaccttctagaaagtttaaatggtttgccattttatacattgagtaaatgatttagatgagattgacattcataccatctttagtaactatgcatttcaaacaaattttaagctgatatatatgaagttttcaatatggatattgattttggaatgaagtatttatatatttggtacatatatattgactattatttagatgtttatatcaggggcccctgtttttaattttgtcccgggccaccaaaacctcaggaccggccctgccctctattaagggaattcgtttcattttttgttccactaaaaatgtttcatcgagtgtacttataatgtttcactatgtatggatcaaatgttgcagtgaactgaaacattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagggggatccttttattgttggagttggagggtggttatacttggtttgaaggttacgaattagactttttccttgccggaagcaaagtgcgggccaacactgagaagaattcgaaatgtgagaggcccaaaaactatggatatgggccttgagaagaattcgacatgtcagatatttgggcctttagccaagatgggctttagctttccaatttcggctcggagcttgggattgaagatgaacagagatgggattaggtaagcatgaaaaaaaaatatttattaatgtactgaagatacaagttggatgattcattctgatatatcaatatatcatgcattacagtggtgagatatcagaaccgacaacacaagtttgatgcttcacttttctgcactctgtacacacttaatacagtgaatatattaattacaggaagctgtcccagctagaagaccttttcttgatcaattacaaagcgagtgctaagctaggactcgtcagactgatggcttgcgactcagtcagacgatgctttctggattctgatcttgaagcaccaatgccgctgctgagaagagcatttactggaatcggagcagctctacgtcttcttctcaaacgacgatccgatcctgcccggcgcagccgccggcctcttggcgtccctgctgctcgagctcgaagcggagtgatcggaagcagcaggggaagaagacggatcatcgtcggcgcgcttcctcttgagctgatcatggcggccaggcgagcgaagcagctgccgcagcacgtaggacggcaggtccttccggcggacgtgcgccaccgcgacctccatgccgggcctccagtagtcgtacatgtacacctcctccttgaacccctctgtcgtcgcgcggaggtcgaacagctgatgctgctgctgctgcggctgcgccggtggcttggacaagcccacgaagaaggacgacgtgcgccgccgccgccgcggctcgttgtggggctcggcggcgtacggctgcgggtgcaggtggcagagcagcatcccggacgtgtccgcctccaccctggccgacagcagcctcagccgcgactccacccagcccttccactcgcggaggtcgtcctcctccccgccggtcaccgtcacgtccacctggaggtagctcttgtacgcgccgaagaagttgaacggctggaacagcttgtcccacccgccgccgccgctgccggccttgacgatctcctggcagacggcgtcgccgacggcgagctgctcggtgatgacgcgcagggtggcgtgcgagacgttgtagccggagttcatgcacgggtacgccggcgtcacgatgggcatgaggtgtatcttgtcccgcggattccggcgggggtcccagaccgggaggctgaggccgagctcgccgtcgtcgtgctcgatggcgcgcagcatcaccgggctgggccacttccaccgcgcgaagacgcggaagaagcgcgggagcagcatgctgggggaggcgttggggtagagcaagcacacgcacgccacgaggatggcccagccgacgccgccgaggaagcccgcgacgttggagtagacgccccgcgccttggcccagtgcttcacgcaccgcagcgtggtgcggaacgcggcggcgtccgggaccagccgcaggatctcgtcggccacgcggacgccgttgaggctgcgcgcggtggcgaggtcgaggccgcggagcaccgaccggccgctgaggtccaggtcgccgggcaccacggggaggcacacgccggcgtacacgaggtccacctgcacgccgtggaacctcatcttgatcacgggaacgtgcgcgccgggcacgggctggagctcggcgacggccgccgtctccgccagcgcggcggcgagcgcgccgaagaagtcgcggtcgcagtcgacgtaggacgggccgacgacgagcgcgtcgatgtcggagccgcggccgtggacgccgaggcggtaggagccgaaggggagcaccagggcggtggcccggtcggccatgccgtcggggtacccgcgctgccgcgtgaggcgcttcacccagcggtcgacgacgccgcggaggccgcggagcacctcctcccgggccgccgtctcctcggcgctctcgtacaggccctcctcgcggaggagcctctccagccgcgccgtgctctccaggtcggccggcgtcgggccgacgagcgagatgggctccgcgacgccccgcgactgtggcgactgggaagccattctctcgtgctcagatcggcggcgcgccggcgcggtggcgaatcgggtggcgtggtgcaaaaagcgagggatcaggagagggatgcgagaaatggaccaaatgggagcttgacttgaagcctgcctccctatatactaagcggaaggcaatagctcgaatcctagtcggattcgggaagtcaacagcggaaaatgacaggtcgaatcctagtcggattcgcatggaaaaaaagctcgtacggaaacgcgaaaagctcgcatattttgccattgtggtaatgtggtcatttggattagaggtaaacaaactgaagcaaaagtacaaattagttcatcactaaacaagaaaaagaaatgactaagacatcagcatctcgtgactttgcagcaattatgcattcaatttgtaggtttgacacacaatcatccaaatcacatataaatatctatttttaatattacaccgttaactttttaaaatacgtttgatcattcttcttattaaattttttttataattattatttattttagtgtgacttgatttatcattatatattctataaacatgacttactttttatatgtttatacaaaaaattttaaataagacaaatgatcaaatgtttgtcaaaagattaatagccgtatattagaaaacaaagatactataagatgtccacggatataagatggtcttaagtctctcatcagggcaactgcaatgatcatattattacctttttgtttttacataactagtggcatactgccatccggaccgaggtcttcagtccttgcaattgtaattagagatattgtttccaaaatttacatgcttggccaacatatgtcaataatttacacgtaccaagtgaacaccctaatgccttcactaatttactacgcaggctgacagtaaccatcgcctgtgctgttaacactaccaagtaacacgatcaaacttggctatggtcaattggccactacactccaaagcaaaagcaaaatatacaacatatatacggctttagcctaaaaacttgcaaaactttatctatgacacgacctattgtacattcaatcgagagcttgttagctctcgaattgactgtacatccttatttgtcagatctaactgaccgccacgctcagctaccttctcaatcataagtctcaacaatgggatcgttgaaagagttgcagcggatcccaccatgatgagcttcttctgcaaaaataatcactaaaacttaagttgaaataaaaaaagggtagaaatgggagcctattaacgcagagtaatattttgcgttatcaaggcagttgtcattgacagagtttgcacatttgtgtttcaaatgaaaatgacaagcatctaagttagatcaaacatggcatgagtacatcagcatgtcttctttttgcaactattcaacaaaattatgtgttgataatcatgaaagaccaaaacaatttaattataaaagaacgtggttttgagaaatggttgaaatgggaaaaattcattcgatgtactttacctttgcacgtgtcaagacaacgttgatcctgtgccaatcaccaagcaaagaagaaccactagcccttgtattcccgttggaccgtacaaaagatactataatgcattctttatccctcccctgaaaagagtttctgttagagctgcaagttacagagaaaccacaaaactaaggaaccacaagaagcaaaacatggttgctcccaaagcctggacagtttttcactagtgatgagggtaacagaataaccataatgaattactaagaaacagtgcaaattcaaaggcactgattcttctatctttttaaataatttaaataactttttacttatgatctgaatggctgctttaaagatgcatgcatggagccatagatgatttgagatgtaaatgttcactagaaccatgtatcaaagaccaaaatcactcaaatcattgaaacaatcttgaagtgttcagatcattgaaacaggtgataatgataatgaagactgagaaaaaacaaatgctcttcatttatctaataaaaagatgaagggaacttttatcacctggtacttgtcaattgtatgaacctcaactgaagcgtctacatgttgctgaatgagatttgcttgggcattatatggagttattataccaaccccatcttgagctacacctctctttagcaattcattggtgatctacaaaaaggatgtgatcaaattttgaggatgaaagggaagtgatgatatttcgatttttatataattaggctcaatatatgtaggtaaaaaaaggatgcacaacactaagcctcagcacaagtttgtggaccagagcagtttaaatcaagcgatattttcctagcttaaaagatataagataattagatattgctaattatttagcatggcacaacaaaagggcagaagcagtcagcaagacagcagcactatgaagcagatgaactttttaagtacaggattttaactagtagctaaagtttactgcttgcttgctatattgtccacaccagacatagatcagggcatacccatgaaacaattaatgcttctgtaggattgttcacagttctatgttccttggcctcaaaagctggtacttcatctgcatgatttgcccacatgattagcattgaaaggcaaatcaaaaggacagactaatcaaactaatcaataacctgtgttcgcaaagacgacagccctatcagggttcaagatctgcaatttgaagtcaatgaaaaattaaaactgctcctggaagataaagcgcatggcagtagaaaaacacctgacataacaaaaaaatgtatctagtaacagagtacttatacattaagaaataggccgcagcgctacctctttcagcttcaagcgaacaggacctctgccagaaagcttgagtttggcatttgcaatttccaacgaaccacaggataacctattgccgtaaatcaatgaatttgagagctccataatgccagatgacattcggtactacaaattggcagttgcacattgtgagttttagtgaaacaaggggtcttcaactcaacagaaaataagtggaagtggaaatactagataagtaagcataagtgtgatattcaaatagagatacctggcatcgcaatgctgaaattgcttgagggtgtgcttctgacaacctccaaaataaactgacacccataccattctctcgagcttcagaactctgtgatttgtttgaaagaagtaataaaaaaaagggaaaggttggtataaaaagcattaagataatgagtgtacaagcaaagcagtgaaaacctgaacaagtggaggaagctgataatgatctcctactagaacaaactttgttgcaagcatcaaaggtcccagagatacctagtgagtaaaatattacaatgtgagaaattataaatggtataggatgcaagactctttagaaaacaattttacagatcattctggtttagcagctttgaccaactaatgtagtcttgaagttaaatgaggaccatcgtgtggatttttgtggtttccttcaagacttgtaccaagcattcctagtttggagcctaccggtaatgtgatctggcctgcctcatccatgatacatgtgtcaaacttcttatgtgctagtaaagggtgataaattcccaaacaagtgactccaacaacttgcacttgctccattctagctttgacggcatctactgattgtatatctgttgctgttcaaaaaaataaataatcaaacacacattcttcattttaaaagcacaagtagaataatgagaaattctaacttgacaagcagtggcctttgacatcaggatgtacagcttcatgccttccaattcgaagaaaatctacaccctatataaatggcattagagcatgttcatattttgatgatttgatttgttgcgctacaatgctcaagccaaacgttgctcattggaacaatgcgataggggaaaagagtttgttcatttgaatagtacagtgagacagggagttatgactgaatttatgaaaggaagtattgcgaacacaaacctcagccttcaacttcataagcaaattatctatagctgaattggtatatgaggttagcaaaatagattcccctctcatcaataatgacttcacggcatgcaccatcgtatatgttttgcctgttccaggcattcctaggataagcgcataatcttttgctgctagaatctgaaagcaacatagtgtacgctttacatagtgacattgaattttcagaagaaaaaaaataatgaactaaagaccaaagatttactttatgcagcgatctctgttggtcattgttcaaatttggcaatgattgtatatatgatagtgccggatcttgacttaggagtcctccactatcaaatctgggagcctatcaacatccaaataaggaaattacagacaacaaaaacagtatggagaaacatagcacgaataggctagtggacgaacagacctcgaggtcaacaatcaacttccttaggtgagagttttgtggattctcagcaaatagttggacaaggttgagtctggcaacagttcaaatacaaactttatttaggaagaaggaacttttctaaattactaattcagaaccttcaacaaaaaaaataaaacaagggccaacctcatggtagcaaatgaagaaacagactcatccttatctatacgccaaacttcacattggagatctccttgctctaacaaggaattacttcctggaagtctcagacgtcgtggcaatgaaacctacaaaaattccagttgaaatattaataatcaacctaataaattgaaatggatgcctaagcaggttcgcaaggtcaggtaataccgttatatgggcacggctgaggtcccttatgtatccatttgcaacagctattcgcccagattttgtgctaagcacctaatgaaaagtagaagaaaacatgacacacttcattatggagaaaaataaaccagcatgcatcactataatagctaagtatccatgaagcaaaggggtgtgagctactatatgtgtaataacgcataaaaaaatgacccctttgtggccataggcctacagcactaaagtaaacatcacaaaacaggaggataaaaacaaagtaatataacgctacaatactccaaagtgttagctggctgttgctgattgatcggttagcagtagctgcagaagttttcaactggtattatatttgccatttaacctccttatatgcactgagcatattctatgaacctatagttctacttccttaccaacattaagcacataacagttcaaacggaaagaaccctacactccaaacaaaatgagatggagccatacattacaaatttgcaatatggtgtgccaaatatatgcaataaaaatatcaatgttgctgggaacttgaaatagctaacatagtaatgttgctgaatattgaatacagaaagtgtacaaggtttaccacagaatcaccgcatttgaggctaaaatctacactttcaacatgttctcctggctgatcagctgtctcaggctgcaacttctggcgcagaaaagtatatatgtatcttttgctttttccagatgaatctattgaatgtccatttgtaacatcaaggacaaaataagatggggaagaatgcctgctcccagtatttgaatgatgtggctggaaaatttccttcttcttgacctgaattttgcatgagatgagatcaagagagtacaaatcaaatacacggcacgtgagaaaagctaaagatacctgagaaactctagcttcaagatcgatcaatctgtcccagtgtttaagaaaggtatgatgtgcaactgtcaagtgattcacgagattatcaaataaatcaccaagcccactagttgcagcattgcctccatgcgcctgttgcatcagaatataagtatggcttttcacatgtatatattatgtaattgaacaaatttgtaccaacaggactgtatcaaaaaacacatttatattaaaaagaatagagttattgaaccttgtggtatatggtgcatgaaaccaggtgtcgacatccattacatgtagatggactctgaaagaaagattttgtttgagttctaacaaatgaattacttatgtacaagtttttagttccacctgtatcatcgggggaaaactctgtgaaatcgatgccttcaggatctcagtggcaagctcattccgacgcattattaatccaattaaatcagacctcttgactttgatgcccttcagaaattaacaagaaatggataaggatgggtacagaatttatgttgagtgtcgttttagaagattaccaatgtttggtctgtgtgaagataatacagaagacccaagtcaatatccttgttcaagtatctgaagacatggaaaagcatggtaaggaatatatatatatggaaagcctgcagtggaagaaatagatagatcatacctctccgtcatcaatagcgtgtacaatatcacttgggcagtgtgttccacagctgtctggaaatatataaaccattgtgaagagcaatagagaagtaactggatctattctgaaggactaaattgttgttttttcagacatggttaggtaaataggagacactagagtgctacacagtatgtgaaacaccacaaaaataacacaatattcttttcagaaatggacataaagtaaagataacactaatagtcacaatcacatttcaaaaaaggtatcaaaatatatatttggatgccgctacatgtgacatgtattaattatcaaaactactgaaggatgttgaccttgtgaaagtagaatggaactgaggctccggattattgattaattattattttgtaatgaactatgattgggtttttttaaggtacgattagttgttgtaggacattattattgattggttgttgccacagaatggacatgactaggtggttgacaggtttctagtcaattgtaactaaagcttaaagttttggataaaatagagcagggaatctaattcaagtaagcaaccagtaattacattatggaaaacagacagaaaacaacagttctggcctgtgcaatataaacctcaatgaactcgtcaggttttgattaaaaaattgagagcatgactacttgtaagaattaatatggattatggaatcagcacaatctttcaagaagcctggttgttgcaatacttcactaatttattgcataaatagtttccagaaccccggtgacaaaaatatctcatgccagaaaaagatataatatatcttcaagtggatccactatccaggagcatatgcttacctgaccactagttcctttaccagttttgaactccagaggcattactctgtcgtatgaactaccattgcatgaaacccttgatctaatagaagcatcaataatccctttcaaaccatatcttggagcccaggccatctcctcaatatccattacctaaggtgaaattcatttcaataaagccattaagaatgaggtgtgcaagtcaacactcaagtactgaaggacatggggagagtgaaagttctgtgttggcctaattttgatggctgagaatcacaaggactacaggagtttaccatcatgaaacgaacttgctagatattacatataagttacataatatgaaaaggtcatattccaaagttttgcaagctcaagatgttgcctacctccacaactccaacagtcttttgtccttcaatttgaccaaaatttacattgttacattttgatacctggatgtgccgacgatgattagcgcagaacatgtaacagtatcttctttaaacaagtaaaggacaagacatgcaatatatccaccggtgaactttgcaggcaagttagtccaggattgataaaggaaagactagatcaaaactttctcttaaaaaattatactccgtaatagaaatggcatatattagcaattaaaaacaaaatggctcaatcgagtgattaatcattgcctagaacctctgaaaagaaatagaagagtgccatatgggtataacaacaggttccaattcaacaaaaataagtggagtattcatgaccatggtgcaactctatggacttcgaaaattcttgtggtcatttaaggagccccaacagtgaatataaaaaactgctgtgcaagtcatctactccaccttcataaagcacttgtaccaattcaatattttggggactgcttcaatcagcgttttaagcgtgttgctttcactggctgcatagaaaaatgtcaaaaccagtaagatatgcacatggctggggatataagatagtttgtgtaatgttataaatatcaataaagaagctgagctacagtacagtactgtaatcaaacatgacatataccaatatgacttgagtaaatgaggatgtatgagaacaaccacaatgtatgttgatatttcagaacaaacacaacagatttgcagaacttttggaatgacattccatgttccttgtgtaaacatataaaaataataggaaggatatagcacagaaaattggatcaaattagtcaaagcaacattcaaaaattaaatataaagtttcacaaaaaatttagtagcacatgataatttactgataactatagccttactgaatcggtgctctaagaatagagtaagaaaaacattattggtcagggcactcagtataacataataagtcatgaacagtccatgtcatagtgtcatacttttgtgtagtgtgttttttatggattaaaaatgttgtcacgaatcttacctccacatgcatataaactctcaatatttttcaaaagaacttctttggcttgctgctctaagaattgcgttgaaggaacatcttcaagtagccctgcctgaggcacaagaggaaagaaacaaagtgaggcacacacaactgttacatgaagataaagtgcatgatgtattaaccagagctgccaatttttcttgcaccaacgaacctggaatacttgatgcagcagagtaccaatcaaagcacttgttgaatattcattgctttttagtctgtcatcgagaacagaccttcttggacaatgaaaactagaagcaacctaaaataagctatatatcaaaatatgatgacaagataagatgaatgtatttttacaaacagttcttataaaataatatttgaggatatcatagcagcttgttcatattgatctgggatattgactacaaaggttataataaagagatggggggaggctaatactaacccgtgttccagatatgagtaattctggatgcactataacaagatttttgtcatgatcaataatacatattccatggtcagtgaattctccaatgacacttactgtgtcgcctgggctaataaggctatggaacctgtagtggtttgaaatatataggcaatagattgatgaaggttcatatgtatatagaaaataaaaatggaatcatgtcaatagttgcatataggaactcaccactcatcacacaaatggactgcatgctctttcccaccgtgctcattcagcaaacgtaaaacctgtcaaaacagttagcaactttgcaaaataacaaaaatttaattgcaaactagctcatccagataggtaaagaggatatataccttaacaggatagcgatcacatggtaagttatcgcctttgtgcttttctgacacctgaaaagtaattaaacacataaatctctattgtactagaagtctagagcagctccaacttcgatagaaaccaacccatggaggtaaagaaagcaaacctccaacaccaaaaagctatcgaagggcggggcatcaagggacttctgggagggtacattttgatcgctgtcagcaataggagaacaactaatgtttttcggatcaccatttatgagctgctctcctttattctcaccatcagcaggtaattcttcttccatgattgcatcttccacttgatctaaaagatcaagtagtgcctggtaaaaagaaatggcatagttttgtcgatcaattctttggcaacttagttcttacatgtaataatatcatgaaaccaatggcacccaggacatttagtgttatcttagttcacctttttgtgctcccctgcccccaactgctcaggtcctccatcagaaaccacacccccattaagctgctgcttcatgcacaaaaccattactccatcaacacgatttggaactacattagctagcattcacacaacaattcatcgtataactgtatgtacctcactgcacctataggacagtgatggaggagtccgaaatgggctttgggtgtcctccacaccgtcacagccacctggaccagttccacacatatccaaattgcgtgctgaagcagtacatcttgacatgcccagcagtgatgaatgccatttctttgtagactcgaccgaggaatgcttctagaatacaattacatatcgaatagcaaaccagaaagccacaaaaaacgattaatttcatcacacaagaaagtgttgtgtctccaccggctccaatgcacatacatacgtgcattgcacgccggtatatacctcgcaagaacataaagaaactccagtatatacctcattgtttaggccgggatgaaggcccataccagtctttgccctgaaagtgaccatgggcaggcgtcatcaccggcgagatcttcaagtcacaacctccccacccccatcgtcctggctctgcttaatcagctggaccgcaccaaacaagaaaccaccaaacctaagagtcgatccaaacgccaactaatgcattccaaatcggaccaagcgcaagaccaatacttaccatcccaggagaaaacctgacccgcttcggcgccagagtcttggtgacctccggcgacacctccgatggctcctcctcgatgagcggcggtggcggcggaggcggcggcggcgcgggaggctgcgaggggccgtcggccttctggcgcttggcgttctgggaggaggcctgggactggcgctcgaagaagtggagaatgccgaacttggccggctgcgacggctgcgaggccggcggcttcttcgaagctgccccccccgccgcccccgtccgcttccgtggagccatggctgtgttgaggactagggttttcttctttccggtcgctaggcggttcgatacggcggaggcggcggacggcggcggaatgggggatcgggttgggaagggaaggtggtgggaaggcgaggaggagaggagaggagccgagaaggggaaggggaatggccgaaagggaggggaattgggcggggttggaaattggagttcccgcgcggtagagatttcggcggggtagactgcgacgtgggcccgtgacggcccggtgaaaactaggcctgaaaggagaaagcattggtccagaagtgagatttggcccataaaatattgggccccccttacacggttctaaaagcccatgtacgacggcaaagtttctttcgttccctcatggaacttgtgcaaatctcatgaccattttttgcgttcctctgatcaagtggtgtacaagaaagtctcctgcgtacggcgcactcctcctgtgattcttcttcaactcatcaaccatcatccaggttctgattcgataatttgtcacctatttagattagagatctgatgatgattgactaccacgcgcatttgttcccatgtatcacctgatctaaaaattggtggtaaaaatcatcaaatttgccggcccgcccaagtacaaaaatggccaatcgttcaccggcgcacgaggattgacagccacgccaaaaagcgcggcgcgcgaggagtgacagcacgcggacccgacagccctgtcggggcgagagcctcccaactcgcgccacgacgagtcgtcgtcagtcagtcctcccccttcgacttcgaccaccagacgatggatcaacgctcgccaccttctccgagacaccgcgcgtccgtactcccatgtcgattccaggcgaaacaccaaagacgatcgtgtcgctcgtcgatcgccattgcccaagaacacacgcctcatcacctcatcgcctcgtcgtcgggtcctgcgcgagttttctctgccggtggttggggcgatcgatggaagagtaataaagaggatacatccaatcggtatggttcgtcttggtgaaagatggttcaggcaacccagcacgggaaaaaacgccgtaatttacttctcttctcgatcactccgtcacggccgccaccgcgaccactttttcccgtcgagaaaatgttgccaccttttgttggttcgccgtggtggctgacagggatccgggtgaagccgctgctgcacacgccgccgcgagcggaaaaggctccgggagaaccaaccccgagtggcacgtggggaggctgcctgccgcgcggtgaagcttcggtcacggactcgcggctcgttttcgcgctcgcgcgcctggtcaatgggttggcaagtggcaattgcgacgcacgcaggtttggatcttggctctggcctctggctgctgcgatcccagtccaagcgatgtctcgtgacggtcacgatggaggcgcacacacgcggccacgcgggcatctaaagtgctaaacccaccttatacaaagctgcattcgaacaatgttgaacaaattcaattcaaaatgtggcgctaaaattggaacgatgtgacggaaaaattgaaagtttgtgtgtagaaaagttttgatgtagactgtgtttagttgacgtcaaaattagaagtttagttaaaattgaaacgataagatggaaaaattgaaagtttatgtgagtaggaaagtttgatgcgatgaaaaaagttgaaagtttgaagaaaaaaattatgatctaaacacaatggtagtggaaaagttagaagtttgaagaaaaaattttgtaactaaactcggcctatttttcaatatttcttatcggaagtttttgtcctactagtgtgcaaccgtgcatctattcctagagtagggtagaggaacacacttccataaaaagccacgcaagcgagggaacagagagatgcgaaccgatcgaacaaacgaaaactacgaaaaggtgaaaagcggcgcctctatatacagaggagagaccgcgtcgtcctcctcttccttccttccttcctccctcccctctgctgctgtgcttgataatggagaaggcaaagagaagagggcaatgaagtgcagcaggcacccgtacgagggcggggttggcgtgtgcgcgccgtgcctccgcgaccgcctgctcgcgctcgccgccgcgcagaacgaggcctcctcattgccgccgccgccggagccggtgccggttttcccgaggtcggtgtcgccgtacgtgtgccgccggaagtccgacgcctccggggcgaggaggcgcacgccgagcctcctctttttccggacgccgcaggtggggccggcctacggcggcggcggcggcggcggaggcggcgcaggtggattcgaggaaggggacatagaattcgagatccggcgccgcagcagcaagttctccgtgctcgccgcgctcttcggagcccatcggcaacacgggtcggaggaaaagcgcagtagcaaggagcggaagcaccgttcttggctcgcggcgatcatggcaccctggggcccccggaagaaggatccggccgtcgcgtcgccgccgcggcactcttgccacgtgatcagcaaccgcgggctctcgccggcgatgaggtacgccgacgaaggcggcgaggaggggagctcgccggcggagtcgccatggcgaccttcgccgatgcggaaaaccccctgccggcgcagaccgggaggcgcgactggggccggcggcgtctcgggcttcgccgtctgcatcagcccgctcgttcgtcccagcccggcgcggcaccaccgcgggggaggccacccgccggacgccgccgccttctccggcgagctggggccgtcaccgctccaccgcctctcctccggctcctcgctcccccactgccggtcatggaagctcgccgacggcggccgcttccggtgatcctatcctttattaatttttttcccgcgctccgacattatttatcccttttgggaggcttttcttttttcctttttacctttacgtgtaaactggaaaagaagaattcatcctggccaaccacgagctggcaagctgtcccactgacatgtaggcaccgacgtttgtcaaaggttactgtttgtcagttgaacatgttgcaagccactgtaaaaaaaaaagcttcttgcattatctatgtacaggattactcctagcttttaaattattttcaagatattatttctttcttgtgtttgagattcccaagccaatagatttagttgtgtgtctggcatggagggaatgaagccatgtgagcggaattgaatgtgagcgttatgaattgaagatctgaactctgagaactaagtactcctacttactccctccgtcccaaaaaaaaaaaacaaaccttgggttttcatatccaattttgactgttcgtcttatatgaaatttttttataattcgtatttttattgttgttagatgataaaatatgattaatattttatgcgtgacttatctttttaatttttttcataatttttttaaataagacggacggtcaaatgttgggtacggaaaccagagtttgtctttttttggacgaagggagtacttcagtagtgctgaactgctaatgtcaacttggagtaactctgtactcatgcatccatgaagtcatgaaccctccacgatctgatgtctgatgagtgggcactgtggatggatcgtggctgatggttgtagaatcgtaatcaactttatgataaggtcataaggataatttatccattttaccatctagtcagagaccttgtccccttttttctctttttctgaaggcagaggttgacatgatcaagaaattcaagatctcttcctgttgtttcttcattgcttttgccggtacactgcgcaccaagcgattgtttccattttcgtccgggaaactataattgtggtatggctcttccagtcgagcactgtttcaaccacacgacgacagttgccggattcagtacacagtccgttggcaacatttactagttcgttgacgttatcgcgttgcatgtaatgtacaggatgaggtactcgaacaggtatgaagttttggtcaacaaatccagcaaatcttcagactggtcctccaacagacgtaggttggctctcccgttctcccagctgcaggttttcgtaacttctgaaactgcatatcctccactgccaccttgatctgaaattctgaatctacatcggtgacagttcttttgatctcgtttgatggctgttgccatcacctctcagtctcaggctctcaccggcgcgccactaaggtcaaccggcttcatcattctcatcgatgcatttaaaaagtcaaactcgatacattaacggctgcagatttggcgaataaacttgctgatgaaaagctcgcaatcatggggcatgcttagctagaaaccaccatcgacatgggcagttgagttgggaggtgattgcctcgacagagattggccggggtttgttgcgtgcgagctcgctttctcatcatctcggatggactcccatcatggcaggtgctctcgctctggtcgagaaaggtcgctacctttccggttaatcagaggttagctccgctagtgcggtggtggtggccgtggccgtcgtcgttgtcgtcctgccaaaagcttgcgatttcaccgaatcgcggtgagctgtgatgcgcgcgcgcgggcgtgtgatgggtggatgcacgaacctctgctcgccttgtgatcgatcgtgcgctctgcctgccggttgctgcatctcttgagaaaaaagaagcagcatgatatcactatggaaaaggcgtattttttgttcgattttcgcagtaatcccagagcttttctacactccgctgggtattactatatgtttattaaggacaggagtatatgaaaagtggattttgattttttttagataatggaataaataaatatcccggcctttactcaaaagagctacagccaattattatatagaagccaattatatgaaaagtggattttgatgaggaacataaagctttaatgctgactgtctgacggccgttggtttgctagtacacattgcttcgctgtatgaactccgaagccacatgccattgtcaaccgggtcaagtacgcgtattattggctttgggggagtgaacactaggttagtccagtacccgagttcttgttacagtattgatgaggccaacagaaaactcctactcgttgacggtatcgaatgaactaatgcccatccgagggagacgattgccagtgcagtactgatttgtttcggttagctgcaataactcttttcagtgaaagcttgacaagaaactgcataagttctgaatccttatattagattatgacaacaatttgcaagcagggacaagtgacaacagtggcttggttgctgcttcaattcagcacagcaagcaacaggatcaaccttcccaatcttgttctttttccgcgtcagaactcaaaagtctcagaataagcaacgaccagccgaagattttctaaaccacgccattttcagcacagcaagtggtattgggccaattaattaggcattctgaatccatctgcagtccatataagattatgcatgtgaccaaggagttgcgtgtcagcttcagttgaggcctttgtggatcaaaatcatcttgctctatagtctagaccaaacatttttcccttttcttcttggtaatttggaaccatgacattataattttgtaacgtttgagatatgtcatcggtatctcaatgacacgtagaacccacatgagtcaatggcatgtgggtcaggatggtatagctcaaatttttcaaaattataatggcatggttcaaattttcccttttcttttatgcctgtcacacacgtacaacagaggcctggctgagtggtaggtcgaattataccgttgaggtccttaatttctgactatacatttctcagttgaggccattaatttctgaccatacattcctgtcggattactttagttttgttgcatgaatttgacaaaacttcaacttacacgggaaaacttggagcgatcaataattggaaaattcctcgcgaaaaaagagagagaagagaaggtgtagcaatgatacgcttctttgctaggtcaaactgagcaaacaaatacttcatccgtcccgaaatataagaatctaaaaccgatgggacatagtattagaaaatatcctatccgattttaaattattatattttggtttatatcctatccagttttaagttattataatttaagacggagggagtataaagcaaaattgcaaacggagttgtcaatggcgtgacaagtggttggaccttctgtgaaacaacccagaatcagcccattacataattgggccgtggtgagacacacacaaacaggaccagtaaagtgtttgggccctagctgcacctttaccatggttggataaaggaaaaagtacaccgaaggtccctcaacttgtcaacgggatacaaaaccgtcctcgaaccgcaaaaccagatatataggatcccttaactatataaaactggtcacaataggtcccttggcggtttcgatcccggttttatcctacgtgtctaatgagtcagcgtgggacccacgtgcgccccacatgtcagcttgtccagtcagcctctatttctttcctctcttctctcccttccccttctctctctcgctcttctctctggtgactctgggtagcccggcgccgccggccgacaggtggggaggagatcgacggtgcgaggtgggagaggaggtccggcggccggcgacgtggcggcggagacgacgcgggagcaggggagcaaggcggcagcggcggcgagatgtccacggtgaggtactggaggcggagctccgtcggggcggggagcgggtccacggcggcggacggcaggcacgggattgcgtcgcggccccacgctggcgccagcaccggcgtcgcccgcctacgcgcgatctcctccaccgccgtcatgaactgcaacgcgccgagggccgagggccgatgcgccggcggcgacgccaccgatggctgtcgtcgggcggtccgggagaggcgacagaggaaggagagatcgaggatgacggcgccatttcggcgggcgtggcgcagcagtcggtgtgctaccacggcgacaagcagtggacagtgtcggtgtcgtgggggttcgcatggtgcatggcgcatgcatgcgataatggcgcagctgctcacacccgtaatagctcatccagtgataaggttgttaggattagtttcttatctccaaatttgttctatctccttatcacttgtaactgaacattgtaagccacggtagaggctgtttctaccactatttaacagagatgcggcccgaggcaaagggttcaacgcttcacattttatcacatggtatcagagccttttccacctcggtagattgcatctatcttccaccactcatgccgtcgtcgtcttcctcaggcgcggcagctgtaaacctcgctcagggccattccgttacagagaaactcggaaaggcaatcatgcactgtggaaagcgcaagttagcgctgcagtgcgcggagcccgtctccagggctacctcaccggcgctgtgaaagctctagacgccgagatttcagtcaccgtcgatgggaagactgtgacaaagccgaacccggcattcgaagattaggaagccaatgatcaacttgttcttggctatctcctgtcatctctttcgagggatgttctgattcaagtcgccatgtgcaagacggcggctgaagcttggtgagccatcgaggaactctactccagccgcacccgtgcaagatcggtgaataccaggctcgccctcaccaacacgaagaagggaacaatgaaggtcgctgaatacgttgccaagatgcgagctcttggtgatgagatggctgccgccggtcgtcctcttgatgaagaggatatggtgcagtacatcatctcagggttagatgaagacttcagcccgatcgtctctgctctctgcaccaagtccgatcccatcacggttggggagctgtactctcaactcctcaactttgaaactctccttgatctctaccgcaacaccggtcagggaggggctgctttcgtcgctaatcgcggcggcgggcgcggcaacaaaaacggcgcccacaacaacttcaacggcggcagcggcaggggagcgctgcgcggacgcggtggtggccaagcacgcggtggccaggggcgcggcacagggccctggatttttcatattttggtccttttaaaaaacttatttcgcaaatagacccctaaaaaaacttattctagaaatggtcctttttggggcgccagagtggctggcgccgtcatccaacgggacgacgccagcctctctggcgccgtcctcctgccaccatggcgcacgcgaaccgacgtggtaggaggagggcgccagctatgctggcgccgccccaaggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttactaaaaccctttgatcagcatgttaaacataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccaaaactctatcgaaacggacaaaatatgtcatctattaaaataggcgtaactttctcatacggacttgaaatcaggaaaataatatatgcacggacatctacagaaaaagttacatccaattctccctagctttgccgggttcggtgatattaaatcccccaaattccgcttgcaagattgtgttttcgaggagagaagtttttcggtggagctttggaaaattccacatgccacatatttcgtccgtttgagtttattttttacatggttggttcctgtgagttcctaagggtgaaaaaaatatcaaaaaataaaataaaaataaaaaagttgcacatctctctcctctgcactagttcggagagaagagaggagaggaaaaattctacatgtcacatattacgtctatttgagttcaatttttctatggttggttcttgtgtgtccctaagcgtgaaaaaatatcaaacaaataaaacaaaaataaaaaatttcggggggggggggg

SEQ ID NO: 75050 - DNA, 2479 bp, Oryza sativa
cttcctaggaggaattctggaggagtaccggagctgtcggtacactctgctccgggtccggagaacttcttctgtaaagtaagcattcgtgtttctttcttatgttatttaataactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtttgtagagattaacgatggaatgcaggaattcgggagctgtcggtacactctgctccgggtccggagaacttcttctgtaaagtaagcattcgtgtttctttcttatgttatttaattactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtgggtagatataaaccatggcctaggaggaattctggaggagtaccggagctgtcggtacactctgctccgggtccggagaacttcttctgtaaagtaagcattcgtgtttctttcttatgttatttaattactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtttgtagagattaaccatggaatgcaggaattc

SEQ ID NO: 75051 - DNA, 44720 bp, Oryza sativa
  unsure (1)..(44720): unsure at all n locations
gactcagaaccaaccctattattacaatcattcctctcccgacctcttccacttcctcttcctcgacctcctccaaaaccccaactgccttttctgaaatcttgggctatcagattatccgggtattgtatagcttcgggtgggtgaacaccatcaccatgctcctttgtgacatgcccaacaaaaccacaaacaccgcaaaaaatcggcattttctcatacataacgcggaacatccacttctttttatttagagtggtacttaccaccctcgtgagcggcttacgaacatccagcatcacgcgcactcgggccccctcactgcttccccgaaccgaggctgcatctaatttaacaatgctcctagctctacgcgcaagctgagttgcaatgctacccgtcctgatcttctccttcagatcatggatttggatccatgctgggtaggtatagagattaacagattcaatcttagaccagccatcatattctgcgaggagcaccggacatcctcgaaaggtccatggaccttcattcataactcgttcccaatcccccaaacaattgaattggatcgagaacagattgtcttttattgctctgaaatctacttctttcgcgtagttccatgctgagcgcatactcccaaagaaagccccatgactaaacgatcacttcgtatgaactgtggctagggctagccatcttgcatctgcttcaagctcctctagatcttcctccaattccacatcctcctcctcatctgcccttaggtcaagcccctccagcataacttcgatttcctccttttccttcccccgatccgccgcaggcaccttgctgcccgtcgcagcctgtttctccgacgttgaaccttcgctcgccatggctgttgtgttccccttccttatcctgtagtgctataagcaagcacgttgaattctactcgagatctgggaagaaaccgagtcgataacgtaaatcgccgagagactccttgtcgccgccgccaggaggatagaaaccctagttttcagggtatggagttaactattttcgtttagattaggtagctgataaaacaatcttgctaatctatagctgttacgtggggaaaacagttctcatttttcttcggcaagaatgatatcttccaattcaagtaagaaaaaggacgtgacaactactaatgttccactacgatttacgtccacagaagtattaggacttaaaataacgacagttttctttgatggtaaaatttgatcacgtaccttccttaggattaaaatggaggattacctccgccccaaaatataacaacttttagctctcagaatttgtcccaaaatataacaacttttccaccaacattctcttcccaaccaatcacaacccttcaccattcactttttccacctacctccattactcatccaatcacaaccctccgccactcacttcaacctacttttttaataatcgtgtccacctctaaaatttcttatattttggaacggagggagtaccttttttaccaatatttgagtgacatactaagcctcccatttataagccgttgttaagatttgaattttataatttgatttttttaaaaaaaagttgcttttagagatattttatcataatttactttgcagcattgacttatgacttagaacatagatataaaagtttttagtttcaagttatcttttggttcttactttatgccaaacgacaggagacttattccaacaatgcggctattcttgtcatgtttgatggttgttacccgttagcacaaaccccatgcaaccatattaaaataaccagtcacttattctcttattattgtgagaacatggttataagttagttatcataattgatataatcaaccttgttttgggaaaaaaattgcttaacaatgtcaagtagaaaaatttgccaaatattataacttctacgtgaaagagacaacatgtctctgagaaaaaaaatgtcaaaaaggacttgacccaagatttttcttgggaacagatcaaattttgcactgagctgacccaagattttacagactaagagggatttacttatttgtagccgagagattttgtacggtaggttctttgatccgagccgttagacacaaatcggacgacattgacatgctccttgtcaccatgttgttcgtatggtccgtgtcatatgtctttccagatgtcagctataaagttgtacgtgcaaaaggtgtaacccatttagtttcaaaaaaaaaaaggtgtaacccatcaggatctgccggacaccgccgagccaccgtgcgtttatacaggacgttaaaagcgcccccggggcccatcacatcgtgcacgagagtagtactgggagtacctggtggggcatgctcaaaggacgataaacaccacgggttcgcgggagggatgtggcccctcctccccaaacttatctgtccaaaacttgcatgcccgcggcccgcggctcggcaaatcgggcaattacgctggcaaatcaaccgggatccgcgatccagtcatccaaccaaccaacccaccccgccgctccctgtccgcgtccgtccagcaacagcgacagacgacgagacgaccacccaaccgcgcgcgctcgcgtgtagtacgggggtacgagggtgcacggtgcgcgcgggagcgaaaccgtgagttggttcacgggctcacgctgcgttggtcagcaggtcaggttagcagtagcacggttgcttcgtggggacggacggacggacggggacggggcgcgtcgccatgtgaccctgccgcgcgtatcatctcggtgttgagccatgcttctcaggagactttccgacagaagaccttgggctccgatcgggcaatgtgcgtgcaggccgaagcatgggagattctgaggcccatctgttatggggctatctaccgactgactgggccgtgtgggaaagttcggccggttgattgggctctacgtttacatctcggaataagttcatcagaggtccctcaacttaacagcaagattttttaacgtcccttaacaaaaaaaaaaccagaagtcttcacccctaaactatacaaaaccgtccaatttaggtcccatgacagtacagatgcctagtttcgctgacgtggcattcgagtcagcaaaattaatatatatatatatatagatcccacattaagtgaaatgagatagaaaatgtggggaccacttctcttcttctctcttttctctttttttcttctcttcagatcctctcccagggaggctgccaccgatggcaaatgggggcgaggcgagcctggccgagctccgccgccgtcgccgcactgacgcacacgcgctcgctcgctatcgcttcctctaccccctgcgtcgtcgcttcccctgtcccctttgcccccgctcccaacggcgaagaggcagtcctagggacattccttgaggaccagcagtgccgccgcctcgaccggatctgggagcaccccactaccacgacagcggaggtggctagaggaggagtggagtaggccggcagagtggtggcggcggctcgaccagccgaaagttgaggatgttgtggctggtgaggtcgagccggggcgaggggagggggaagtggagagggggttggaggagagaaggggaggcgctcaccctcaatctcgacggtgccgtcggcggtaagcacagagtccgcgcaggcagtgtagctcgccttggcctcgatgaaccacacccctccgccggtgctgtcgatctcaggcttcccgacgaccagattcgtgatgcggccggcgatagggtggtagtggacgaccgatgcggcctagtcctcgacggcttcggtggagacggaggggaatacctggatgaagtcgatggagatgcagacggtggtggcctttgtcgtcgttgtcgatggaggatagcgagagggagccgcccggggtgggccccgccgagggcaccagcgcgtccccccgacaaccggtgctaagtcgctgcctcctcctcgccatccctagtcggcgtcttgtcatcgccgccccaatctcgtcgttgcagcgggtcacacccccacgctacctcctcgccgtcatggttgcagtggtcgccgccaccaccacatagccggtgccacctcctctcctcccccctctctcgccggtgcggccggctgcctctctcgccggtcctcctcttccaccggcgtgttgccaacccccctcccgccggctgcctgggaagaagagagagatgttgatgggctgatacgtgggcttcacatatttttttatattttgtttactaggatgctatgttagcgaaaccagatatctatacttctatgagatataaattggacggttttgtatagtttagggtgaagatttctgtttttgcagttaagggacgtcaaaaaatctcgctcttaagttggaggacctccagtgaacttattcctgatttcacatttctctcttttggaagcagtaaaaaaaaggttgaccgggaaatcgccagctccttcgatctgaagacgacgagaaccacgacaacacgacgagaattcacattactctctgtttctacaagttgacccggtgttcgttggtcaataagaacaacacaaccacttcgggtgacatcggtatcgattggcttgggtttgacaggttaataagccacgtcagtttggattgacaaagtcacaaaactacagcgcaccagtgagctccccaaaccgaatacgttttctcactgttgtctcatccatcaagctagtgaaccacctccaacaaatctccaacaaatcccagatcctgatcgaaagcgtcccgctcaagccgtgcccacaagcaacgagcatatgcatatcacagctagccccagcacccaactccacagcagctgcagtgcagcaacagcacaaatgagggtaacgacgtagcaatgggagaaaccaaagccgaacagctggtgacggccgtgtacaaggtgcacgtccactgcaagcagtgcgcgaacaccatcgtgacacagttcacgcagttcccaggtgtgtgcctgcttcagtaccccgcaggccgctgcaaaaaaattttttttgccgtctgaatttggcgcctgcgcacgatttacattctgattaattgcgtagtaataacatgaacaggagtcagagaggtgaaattggatggaggaaaggtgacagtgaagggcatcggcttcgacgccgagaagctcaggaagaaggtcgagaagggatgccggaggagagttgagctggtgcctcctcccaaggacatagtcactgaggtcaagagcaagaaggaggtaattaatctatgtccttgattaagttatttttggagtttcacttgcctgaaaaattggattttggttttctggatatataatacaggaactgaagatcatcactgtaagggttcccttgcattgcgcagagtgcgcagccagggtcaaagaggttctacttgagcacaaaagtaattaatttctgtacctcggacagttttatctcaatccaacagaatgaaactgcagatactaatgtagtaaccatatgcatgcaaaatgaataaataattcaggcatttacgcggctaagattgaccttgggaagaacttgtgtgtcgtcgagggggtgattgaggagaagaaactctttgaatacatctaccatagaacgcgcaagtacggcttcatcgaaaaggttgagaagaaggagatcattgtggaagagaaggttgaggtgaagaagaaggaagctgagaagaagaaggaaggcgagaagaaggaggaggtcaaggtgaaggagaaggtcaaggaggtcgttgctccctacttcatcccctgcacgcaccctcacttcatcgattactcacaccctgaactccatggattcaaggacacggttttcttgcattgctcacactctaatcagttcctcagtaacgaaaacccggaagcctgctctgtgatgtagagtaatttcagatagatccaatatttatggaaaacgtgcgtcgaggtatagtatttaatactaacaaaacttcgcatacatccagaataaatttgcttcagttcagaaaagaaaggttgcgctgcatgtcctatatgtatctgtgggaattccgtatctgtgtatacaggcaagaatctgaagttctgaactaagttacagagaacagctctcatagtcatatatgaacagtatgtagcttgacattcccgggctgcatatcttgtttcaggaatcaggctagtttttcatgtgccttaatgctgagactacgagaaatgctatcaggcaaccaatgttactgaatataagcgatagttatcattttgtcaccataaaatcaaagtgtgtcattcgtgtgaagaacacaggacatttagttggaagcatatattagatcagcaaatacatgaacacacgaaattgaagatcgatctcttcacacgatctgacaatcaattaatcaatagatatacacacacttcatgttatttcttcagatcaagttaagatcttcaaatcatgaaaagctagttactactatcagtgtacgtacgtgagcgtagcgctgcaacttaacccagcttgcatgcatagtgatcttacaggatttcaatatattttggaagaaaacatttgtctccctctccaattcaggcacatgtgctaatactaaatgattcactcaattcaacattttgtaattacttaatatatatatgtaactaggaaacatttcgacatcaaagcatgatgtacctaggaatctatttgaggtataataatgaaaaagaggcaaacacaatataaagaaatacatgaacctgaactttgtcaaaacaagtactaagtggttagttctctataattttcatcctgttaaaaaagtatggttcatgcatgtaacatagagtagcaacaaacacatttttttagataacggaactacaatacaacaaacacatgccctttggatctaaaaaacttactgaaatggatactgtaggcaatcaaatatatacttaaatggatactgcagtatgcgcatgcgtgcggcatatagatactgaattgaatccattgacaactagtcagtgaagctaaaaatcatgctggtctctacgacctaacacacagactacttagttcggtttcatgtaacttgtagctgaacagggtaactgaaattagcaggctgcagtttttccttcttctatatatagttgctgaactttcttatttttcaggggcttatagtttgtaggttgaagcaaggaggtgattttttttttcatcctctgaagcccatgaaaattaatactaatacataacagcagatgatgtatttttaggccggggctccgttctgatgtattttcaggggctttacaggttttgatacaagaaagtatttaaagctcaattattgttacagatgaaaaaggttacaatttgcaagacctgaacattttgttgcaagaaattccaatgttttccaaagctgagcacattgaattaattgcgcgatcaagcggcgcggtgagttaagccataaacacagtattgataaaacatgaaagcagcgctgatgcaaagacagagcccatagaaatagaacacatgtcgtcaatagaaactttaggaatctcaattctttgaaggttcaagtcccaataacttaggaactagttctctgttcttccatttactcttacgagcatcttgcaatctatgcatataggacaagaaagaacatgaggggacacacactgtaagtagtggtaagatgataggcagacagttggtgaggattccccatgaacactagctagcctgttttgagaggatgcagttgctaattgcttttgatctttaaactaaggcaagtatgcacacgtgggagcaaggagttgtaactcgtgttgcattcccctagcttccacataaattttgaaccagaagaactgatgacatgcatataattatgtttccccagctgaactatctacaaatactataatatacatacatcactgattgttatatatcatcacacaaagacatctaacaccttcgtatcacacaaaaacaattagctaaaactccaaaagcacgcaccagcacatctatatgtgcatgataaagtaagaattgacagcttacgccacacgaacacataaaacctttttcttataattatcagtttgaggcgaatctctcatccacataccagtaacaaattgaacatcaacagcaaaacaaatagaacgcccatgcatcctcgaacaatttaaaggctacttaattattaaagccagattgacaattaagaaaggttacaccacaaattaaggttcaaaagaaacaataaaagaaaaaggggaaaaaaagaacaataacgaaaacacataatcagagatcgagcaaacactacgaaataattgtacatagagatagaaatagagcagtagatatagatcgatcggtggtaaccctgaatacgtggttcatgcgtgcgttcgctaaccttttgcaagctgcggccatgaacccttgcgatgtcctttcctttgcttcttgtgatctctcctctcatctcctctcctttcgccggagctacacccatgtatgcgcatgtcagaacggtggccgtgcgccggcccagccatggccgtcggcgccgggagggagctgtgagccgccgccaccgggcatgttgttgagcggcaggttgaagaacgggaggccggcggcagacgggtccggcgggaacgcgccacccatgccaccagcatcggcgccgccgccgggctgctgcatctgcaggccggcctgcggcggcggcgcctcctcctcctccagtgggaggcgctcgtaggcgacgttggcgaaggacgccgcgatgacgatgaccgggcccgcggcgtagagcgcgccgacgacgttgccgccgacgacctgtccctggcccccggcgaggaagatggtgaggctggtggcgccggggggagccggcggcgggaggaaggagcccgagagcgacaggatctcgaacctcccgtgcagcgacacgacggcgcccgcgggcgccgacggctgacgcagcgtcacgttggtgaccacgccgctgccgctcagcacgcacacgccgcgctgccgccggcgcgcgtacgtggagacgcactcgaacacgtcgcagccgctcccgacctccaggatgtgggcgcgcagcgtgttggcgctctcccgcgtgatgatcaccggcggcttcggcttgttcttggagccaggcgggcgcccccgcggccggcgcgccaccacgtcgccgggcccgccgaccgcgccgtcggtggcaggacctgacgacgaggacccgccgtcatggtccccgtacggcccgccgttgctgttgccgccgccgccgctgccgttggggtcgtcgtcggacggctcgtgctgcttggcgtagctgtgctgcagctggaggtcggggtggaggtggtggagctggtggacgtagcgcgtcgcggcggtgccgaggtcgagacctgccatgcttctccactagctcatgtactgatgtagcagcagcagagcgcctctctagctctagcaaaaaaaatttaaaatctaaaaaaaaagtggagaaaaaagagaggaaaaaaaccgaattggaacaggggtggtgttttgtttttagggttaaaaggcggtgttggaaaaggaagcaatgatttttaaagtgggggagttgtttatactcctccttgtttttaaaatttttggatgcacagagaagcaaacagagagagaaattaaaaaaagaagcacaagagagcttgcatggaggagagaacaccaagagagagctattgctgtttgatctgaattggagaagggagaggagaggagaagggagaaaggcaagctatgaagaagaagaagaagaagaagaagaagaagaagaagaagagagacatgcacaggggaaagaggagagaaaagggagggcttgagatgttcttccaaccagaggtaggaggtgcaacacataaaataaggggagaggtgccaagggagaacaaattctagtgtatgcttgcacagctaagcagaggagacctagatcacctcactgacatgtgggcccaacagaacacgcacacgagggagggcccacgcgtcagcctcacgggagctcaagcgtgctggtgacaagaggagacttcggagaggagacgaggagcgggatgaactatgatgcggaaatgtgatgcatgtcgatagtgatggctagcgtgtcatcgtgaccttttgctaattaaccatggttaagcggttaaacctgtggtttagggctactaatcaaggttagagggcgtccataatgcggcccctcgtgggggcccacaccagcgcatgccacgataggatcgtctgcggccatggttaggtctggctagctcttgagagatgcacaacgagaggtggattaattttgcactacttctacaataattggttctccgtagtctttgttaacaaattcaatggttaatttgctccaaacactgcggtcacaaagagttacatacgcccaacaggtagccagctgcctttggtatttgttactccgatttgaattttgataattatagttatagggcgtattttaattttaaaggtcttatcaaaatcttgccaaattaataattacacatggtgtataaaattctgccaatagattaattttgtaataaactgttttcatgacacaatataattagtagtgagggcttgcctttggtaaaatctatacataactttgtagcagtttcagttgacactttttacctaattaatttggtttacgaattatattgatcacgactataaatatattccaacattaatttagcttatctaggtagctatacccatatgtatatgctcatggagacaatacacgattcattcattaattcatctgtttgacatgtgtacatgtatacatgagagatgtgcaacaccctctaataattaacaaaaaaaaatgcccgcgaattgattgatgcatttctttaattggcctttgtcctttacaacatatttttagacaacaagatttataattgatcgtgcgtttatagtttactttcaatatattacaaatgtcaagtcaaatgaatgacccacatcatgctcgcgctcaaactgaattttatatgcaatatcttatgatcagttcttgtaagcgtaacctgcatgccgtactttcactacgtctgatcgatgaccacaaaactttggacactagactactttttaccatcttttcacgagagaccaattaacacatgagtaacctcgagcgcaactgtttccgaatattaatttacagctttttaaatgtgtttcgccttggaagaaacacgaccatgcatgcacatgaacacggtagatttcaattctgtacaccgagacgcatggaataatgcataactttttaaggaaccaaaataaaatatatctattttttgtaaaatcaaagtgtttttgattccttattttgtgatgaacaattggcatatgagattattggttttgatatttggaatttatttgtgaagtggttacggagatgattggaattttactggtggtctacaggaactgttgtgatgtggtccggtcagaccaggcatgtgctgccgatcagactggcggcaagcccgcggtctgaccggccgactctgtgtcggtttcggtttcgggttgtttgtttggatatctgtgattgtttcatatttatggcttctagatggatactatacgtatgtaatactgttgtttgctaataatgagtcaagttggagatagcttggtctcggaatatggtttttttgtttgcttcatgtgtaggtgacttgatgcctcaggagagtattgccggtgatagatcgggagtcgacttggggataaggcgatgtccttgacgatcagatatcatgcgggatacttaggctagagttcaatgcacgtggttggtgaagattccatatggcatacgatggaggtattgtgtgcgtatgggatgcggagtcgaatttggaaggagtccaaatttggtatgattggagtttgtaaagtttgtttcttgtgcgagaaggtttcctaggtggtttaggacttctaatatgagtttgattcgtggctttaggctgcctacctcatgtataaatagagagggagcatgaggctttccggtatcgcttttgagaacaactgagttgatagtttagttaggatttcgagtttagtcgagatttttgtaagaagtgttgttgttgcactttgtaaacacagagagaagtaataaagttggcatctactttgagagttcttcgatttgtgtttcatcgggttcagcggtctaaccggcgacacaccggcgatcagaccggtgtcatatctgcggtcagaccggcggtggctacaagaggaatctgctgatcttggtggttcgactggacattctacttcggaccgacgacttccaggcggtcagatcggcgcaacacctttggtcagaccgcgatccgtcgaatttaagggtaacttttaattccgcaaaaagtttgggtttttgggtataccaaccattcaccctcccctctggttggcttagttcttgtgtttcgatcctacattattttaacgcgtaaaagaattgcacatcaatatatatatatatatatatatatatatatatatatataggacactcatatggggcaccatggtgcccgggcaccatggtttcaaatgcacaaaatcactcaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattaaaaaagtttcatgctcatttgaattgggtatatactcaatttcaacaatggtgcccgggcaccatggagcaccaaacaaatttaatatatatatatatatatccagacaataacaaatcaaagagaaataagatatcccaaaaaaaacatatgccatatgtttttctctgaaggtgtacgtattagcaggtttcgttgttatgtaatttattatagtagaacataaccgtctataaatcatatgtcgttaacttttaagagaataaggacagacgtcgtggatccatgcctggtattattattattattattattattattattattattattattattattattattattattattattattattattattattattattattattattattattattattagagatgtgcttctacacttctttaaaaaaaagttgcacgaaaatcgaagcacatcaatggctgtgattaaaagtgggttaacagtttaatcctcattagtgaggggtattttcgtccatagaaatttcagcccacaacgatatcgttctctcctcgtcaggcagcgccactgcccgctggtttcctctgcaacgtaagcgccacccgcttcacctccctgccctgctagaccaccctaactagatcccatcgatggatcgatggatttgcggtgatttgagttggtagttcgctcgcaacacgatgagcgggagctccagtgaataatatgctgctccacaatgaagatcgtcgccgccatgctcaacatgatcagcctcgagcacgaggactatatatagcaacgtcgacgtcctcatcaagggccaccacctcgcgccgtcgccactgccacattgagcacgccgccgtgccggcagtagtcaggccaccccagcgacagctgcagcagcttcttcggtgccatgatctacacctcatttaaggccaagtcgcaattcgattgaaccaaagtttaaacagaagaaataacacaaaataagcttgtgcccttcgtgctttggcttgtttgatatttgtttgtctgcaatctgcaacggcaagttcgatgtgacttgtgatggtggtgagctgtaaatgaacggggtagacaatggtatgcagatacttgttttatgactactggctgtgagatggacaaaatggagcgtcgtgctgcaccgcgcgtcgagaggaagaagagggcggagcggcggcgctgtttgcaagaggaagccgggcaacgaggggaggaagagggaggggaggtggcgaggcaagggaagcgcgggcggtgcttgcgaggctgaggagcggcgctacccaaggagagagcatcccggactagcggtcgtagtcgtggaggaatcggcgtcgccattggtaatttggtatcgctgcagagttggaccggggctcaaaattccatggacaaaaatacccctcgctaatgaggattagagtgttaatctctcttttaatctcatccacttatgtgctttgattttcgtgcaacctttttttttaaagtatagaagcacatctcttattattattattattattattattattattattattattattattattattattattattattattattattattattattattattattattattgttgacatcacaaatctatgagcaaatataacctctgttcttaagaacgtgtggatatgatggagtatatatatacatgcacacaattatatatattcaatttaatataataaacacataattgtatcttgatactatatactatatggcaactggatcaaaagattaactatatgacgaaaagtaggtctcaagataacaaaacattacattagtgtaatgacaatacatataattaacaagctagctagtcttagttaaattaactgaaagtacaactacttaccacttttatatgcatcaaatccagctatatatatcctcaaacactcactcgtgccttctcctagtggtgcatgtatgcatgttcctcaatttttgtgtcaataaactccgaatgcaaaaccaattttttattgtgtgcaataagaatattccagcacgtacataagcttctctacaaatagatgttcttataagcagcctccttatatttctttgttgaaaatctctacacttacatgtagacacatcacacaaatgcacacactacaaagacagtccgagggctactagcaataaacaccccccccccccccccttaaaaaaaatcccaaaaaagtgagcatctgttgactgaaaatgtttagattctcgtagattggaaccaatgttgtagaaatgtttgtggtgtacatataatttgaatcatgtgaatgcttatatttgaaaatgaatgcggtcaatttaatttgctcttttcaattacatggagacatatacgcgcgcaccacactcatacaccagtgaatgtgttccataagacatgctcaaagagatgcatcgaaaggtcaacagtacataaattcctagcctcgctaaaatcatattgaaagtgcattagcgcgtgagtgcattagcctcactcaaattctattgaaagcaacattttcaacacaaaacaagcataattttaaaacatattcaatattttatttaacgaaactaaatcggtgttgtagatgttgctaaatttttctataaatttggtcaaatacaaaaaattttgactaggaaaaaagtcaaagcgacttgtaatatgaaacggagagagtatatagaataatgattcaaatgtaaaagtaaagtgatgtggctttatgagagaaaaaaatgagggagatagtttggatcatatattaatcatctaaggactaaaatcaattgatgtgatatggcttgatgagagaaaagagaaataatattaaccgagtatgaattatatggatatatgcgatattattaaaaaatgatgaaaagatatattgaaatattatgtgaattatgtaggatggtgatttagcatgcttgcattttaaaagctctaaaacttagtaaattataaaattgtagataacatagcatgtttgtatgatgtttaaatgtaataattgttagtggatgatgatgtaacatcttcgcatgttatgttttagaatttagtgggttataactagtaagatatgatttcctaacagttagaactacatttagtgaaagatatgtttatactccgtcctaaaattagtgtgcagttttattttaaaacggagggagtaattccttagcagaaatctcatgcacggcacattaacttgcagacccacatgccagaaggaaaacaatgagaagtaaatagtgataatttttggctaatgtatggtgaagcgctggctggtagtatttcagtacttgtatgctactagcaatacgtacctctcgatcccaaacttaaaaacggcaagttgtgcctggctaatcagttctcgacaagtatccccatccagggagccgatcgatcgagccgactgtgcagccgcgagccgacgctacggctcgcccccccacgtgcccggtcacgtgcggtcaagtgcgcggctgcccctaggcggtaactcggcgtggctgtcggccatggccgagcaacaccggagagagagaaaagagagagaagatgagagagacgagctcgctttcctcggaaaccacgctctgcctcgctacctccaaccccagcccatgcgtcccactgcacgtgggccccaccaccacagccccaaagcatggcgcaagaaccctaaccctaaggactccccaaaagttgttgcagtgagacaagagagaaggaaagacgaatactgcaggatatgctttgtagtatcagttcgttctgaatgaacagctgcaactattgtgctcgttttaattaatttcttctatatctgtttagttaattaattaccttctgcgctagctagaaagtttcagtgacaagataaagttaaactgctttccagaaaatagttaatttacttgcgcacacgagcaaacatatactagtactagtagctaacacacacgtcgatcaatctgaagtctgaagatagttaaggcagttaataatgctgccatggatcgatcataaattatgctgtccatggttgtacgtcgatctgttagtttatgaaaataacatatactcctagagctatgctacttgcattattatggtatcgtagattatttttgtctgggccgggggttagtggatataagctatctcttcgatcggaaagtagctagcaatatatattttggaggtggagagatctgtaaacagtgcctcgtacttctgctaactctctggtgataataaaaatatgatgatcgatttggtgtgtttttgtttattatcgacaagttaagacgttcgaggtcgatcggaaagacgtatatagattcatcgaaagggattcggataagtttaatttgtaagtacaattcacggtacgtgtcagcttaattctgccttccctcttctcactactttcaggtatcttattaattagtaggtcgcaactaccacttttctaagcctgtcataaaataatacagggtgttaatcatagcttggtccggtgagggattaaaaagatttaggtttcatgctgttcctggcaggtctcttactttgaaggtgcgtgcgcttgtaaattaataaatttgccatcttgttaatcattaatttaaccatgtcccatgtcccgccaaaatacaccaatctcgctcaactttggataccttatactattagttgagggtagttagtaacaataatgcagtctagttagttgctcctcatgtattttgaagcagaagtttatcgatttgtttaaatattactttctccgtttcaaaatgtttgacacagttaactttttagtacgtgtttgaccattagtcttattcaaaaaatttaagtaattatttattcttttcatattatttgattcattgttaaatatacttttatgtacacatatagttttacatatttcacaaattttttaataagacgaatggtcaaacatgtgctaaaaagtcaacggtgtcaaacattttgaaatggagggagtaatatatgtagctctgcgtgtacttcgcatatacattgccaaccattggtttgtccggccaagtgggtgcatcatgccatcatatgatacccctaccctatttagttcttggttaaagttcgcataatagatatatatgctgaagttctatgatttaacattgcgctgttttgttgacctgtatattgatgctaagtcttgtgatctgatagtttccctcaacgaatttttcagtcatctcgatcgatctgtctcaaaaacatttttatatttttttttgtgtgtgttatgtagattcagacgtttatttttcgataaagaaattaagctttattgatattagacaagtacgtcaatatgatataattactctaagtcttccttctagcctctgcatatatatagttaggatgcacacaacctataattactattgaaaaataagaaaagaagaagaagacgacgaccatggcttaaaatttctgttgcccgatagatctatataagcatgatagatatatcgatcaatctaaaacaacaatataattagaaaaacatcaacttagtaagaatatcgtacctaaccgacaaaatcctaactaggccaatacaactctaaacaacaatgcaattaaagatataacgaacatatcagataggcaacaccttgcatcgacctagatagaatatcggacttgaacgagaaagttttagccacgctgatacaagtgaagttgacggaatttacttcctcgccggagatcgaaaccgatgcacccaacttgaaactaaggacttgccaaaataaaaggtagcgatacgtcaaaagtaattgtattgatatatgaagatagtttacaaagactttatgtgtacatatttatataatcgggttgatacaagttttgatcggacacaagactcttaacaagaaatttaaggaaaataactaattatgccgatttaaaatatatatacttaaaaatatgaaactgcatggtcttcacgattcctctagataaacttgtatctaccaatcggcttatttctttaaccgaatccactacgcttttaccctgagcaaattctgaagtttctgtttgtcaaacttaattcttgatcccaacttggtctctgaagtgatgatgtgtctattatcttccgtacgtgttcttgcacacccccccccccctcaattgatcccttaaatttcatatcaaataaaaaaatatcgaccagtatttatttattttctgcatgaaatttccagtttatccaattccaacctagctacatcgttgattaataggatgggtgcacatgccggccagagcgcagcgtactgccggcggtgagccggagatctccggcttgccggccggcgacgagctagctgatcgatcaattatcgttatcttcgccatacgcatctagtagtacgtagctagctagctagccatggcttcatgcatcctttgaccggtcggtccgtcggcgccgtagccgggccgatcacgatggagaggtcgaggccctagatcttgggcagctgcgtgcgcgcgaccggtggtggttccaaggacggtgacccgtaccagccgcaatattctaaccctcggtggcaactttagctttaagaaagccaaggctaggcgggattaagttaatcgctaatcgaatacattattgtgcgtgtcatggtccctaatcccgacaagcacgttgcctttgggccaatggttggataagctcgagaccggcgctagctaatggctaatggagtgattaaacctagcctaatccccctcgtcgagtccgaaagtgagctaaagctatagcaaagcgaaggcgatcgatcgattgaggagctagctaagctagctaggagaggatcggaggaagaagaagagatcagggccaggcaatttgttcgtccgtaacagcagctgctagctaggtcatattattcgatcggtttcgctgccaatattatgtgcgcgtcgatctaaatatggtgatcattcgatcgatcgatcgatcagctagctggttggttggcctgtcgctgttcttggccacacaaaaaaaactgaaagcaacagcgggaaagtccaacttccgggatggcatgtagcccatggtcgttcgtgatttgggatatgtcaccgagaaatgctgtcggctagcagaatcgtagtaaccccgttatttgttttgttgcaaccctttgtcctcccgtctggtcctttcagtcctggctagggttgcacagtgttattcgcggctaatgggcatcatatgcacttttggcttactgtgcatgtacagttaagtcctcacatgcatgaatgcatagggtcatcgagatcagcttcaatttgttcatcagactttcagagagatgaattagtgctttccacctgatattttcctcgattccaacttggcgataagatacaagctagataaaagggatgagatgttccaacaaaaatccgaggaccaacacagtgaatttgaataatttagaataaagatcgagcaactgagcttgcatgagcgcccgtcccggagcataggatactactatatttgtttcatgtttcagtctatatgtatatatatgttccacacgcatgcatattaattatctattaattgtaggtcttcatcaaagtgcacctgagtgtttgatatacatgcattattattattgaatctctagggaaaaaaactggcgtgtcgatctgctgatggaaatgttttagtcaacctaatctaacatatatagatgcggtaagtatcatgggagcatgcacaattatataaatttggctgaaatatatgcgtgtgttgtcttgggctctcagccttcttaattttatgacgctcgatcgtcctttgcctggtgattatatattactcggtcagtatataaatgcatgtaaatcccggaagggttggaagattctgctgttcaatcactcaatgatgagacactagctactacttaatgcaagaaagttagaagttaattaacgcatgcttagataaatgtacactaactcacatgttggtactaaaagtaacttctaattctagtttattctcctgcaggttctttctacttgctttggttgcttttacaagtaattagttgccctaggaaagaagataaaaaaagaaactagcccaaacaattcgagcacggcctcatatattttatgtccattcctcgaattagcagctagagccatgtgttaatttataaactaacatcacgcaatatatatagctccaattcaagtcaaatattagattacttctgcaaagtttacaatgggataatgttaacatatgtgtgatggttacctcacaggagtaaactacatataattacagccatatgttttgctttgagggtcagtattataagtgtaatgagtacacgagcaccttggatttctttattgtgtatgcacaaaagtctaaataaattttcttcctagctatggaaacacggaaagttcgttatatttagtcacttgcaatggatagtactactgttgattacgtaattaaaatatcgatcgagaacacaaaaagttcattttgtaggttactactaatataagaatcgtaagtacttgatcgcaggacaacatcaacatcatttgttgcatcaaatcttttatagtcactgtactggccatttttttattaccacgccatggataaactgtgggcgagagcaacttggtttctaataagcgcgtacaaagcatgaattcatgatgaggacatcacttcgtcggatacgctcataacttcacacactccaatgataattccaaatccaagtccagttcggcctccggagacagcactgacttcaaacggacctagcgccttcatgccaactccgatttgggtgatcttggacttcgtggaaagattatctcgctacctttcaaacgcatctggtctcatgtccaaattcatctcgagtcaacgggaatcgccaaaacaagacagtgctgttgctgaaaccgaacttgggccttgggccttgtaatagactaggcccatctcggaagtgtcaccctccacctccacgaattagcactgaaccctagctttattttcctctataaatagctttatacatcctcaaaaacatttgggttttgtttagttgaattttgctaggtgccattcaccttgtctctagtcctcgctcgattagtcggcgactatagattcagagcccccaatagttggtgtgttgatttgccgggtcgattagatctaccacttcaatcgcaactattcctttgtgcttaattccctattcgcaatatttagattgcatcttatcttgttcttgcagtgttctctcgtttgcattgcagggatcatcaaccgcgcgtcacggttggtacgacatcgtttgtggtgtagcgattgcacggcgtcctggacttgttctggttggtagccacgtcgcaaacgtcgcactcgatcaaagcgagagttatccccctcaccagaagatcgggccacgagagagagcgtcatcacttcaagtcttcaacatctgaatgattttctatatatcatgcatgtgcacgagtaaaagctagcatttctgagtaattggtagccaaaaatatggcttggtgcatttctaccatgtactgataatattagctagtaatagtactagaagaatacaaaagctcatatcatgatttttgtaaaattattatgtaacttccgaaaataactagaaattcttttgacataaaattaaatacctagaattaatggcatatagatttattggaagaaactagaggtgtgatggtaaagtcgtagatgcatcattacccattagaattcaaatctatatacccagaataatcacatgtaggtgttaagatgtgattttaagaggttaggctgtgttcggtagtgtgagttcccaactcccacatttttcgttttttgtgcgcacgctcctcacgaactgttgaacgttatttttttgaagaaaaaatttctatacgaaagttgctttaaaaaatcatattaatctatttttcaaagaaatttagctaatacttaattaatcttgagctaatgagtcgttccatttcacctgcgctagggattagctatcatctcaagctgccgaacacagcctcagtgagactaacatacttatcgctagccttcgttggagctaattttcattgctatatatgaaaggtctttgtttatatagacatctttgttagttttgaataaggatcctgcatgcgcaggacatatatctatgtatattatgattcaaggacattcacatggatgccattttacatgaacacacacttcccatgcatgcatgcatgtaaacacacgatcgaatgtactccatatgtttcaggttataagacgttttgactttagttaaagtcaaactgtttcaaatttagctaagtttatagacaaatatagtaatatttataatactaaattagtttcatcaaatcaataattgaatatattttcacaataaatttgtcttggttgaaaatgttactatttttttataaacttgatcaaacttaaagaagtttgactttgactaaagtcaaaacatcttataacctgaaacagatggagtattaaatattcaatgtgaaaccgtggaacacaagttgagatgaatcacgcatgctacaaattaaatgttcatgaagtaaattggagatgaaactaagaagacgacgacaaaacgtctcaccaatcaaacctgcataagcatcctaaagtgacgagagatcttgagagagagagagagagagagagcagtatagtttattatggcgcgcggcaacgaaaagaaaaataaagattaattcggcatagactttgtttgctgggaggcgcctcacctaatcatgtcgccaagttgaagctagccagagacaccccctctctcacacccactattttcacgagccaatgagcgattagcttgctcaccctaatattttagggctcaacggcatcttgccagagtggaaacctttaacctaatggccatataaagataagcactacacctattaaggccaatattttatgctaagtagcatatgggcccctgataaaagtgacgacatcagacggcaaatggggcgcaaatgtgaggggacggaagcttgcaataaaggggtgttgacctaaaggaaaatgcgtgtgcataggagtatttttcaaggacgagagaaaaaatattaaccgaccaacaaagagtttgcttgtgcatatacacagcgccctgtgattgataatgattgatttgtcaccctttcaaccccttaatttagtgccttaattaaatggttattttgtcatgtcaaatctagctagctatatcctgctagatttatcctcgctatagtttatacatggccgcaaatgtggtgtttcgtgcatagtttatttactgattcattgaaaagtatggctttggtgtgtgtggatgcatgggtgcttgattctgtccatagacaataaggtcaattagtatatgtaaactctttcggagaataataattagtctagctatgctagcaatcatttgacattctatctagctctccatcgtctcaacgctctcaagtacacgcgcatatctttatttacttatttatttatttgcagtgttcgcttacttgattaattaattatgctgaaacatacgctgttaattaccaccgatttgactcttggcgggtgcagaactgcggatagctagctcgatctcggccggatctgaaggccacatgggggtcggtatatgcacgttttaatcggtcatagattagcctcagttaatcaaatcatcaaacggagctagcattagcaagcgttggtcgatgcgcgacatgaaattaaccctgcggccgtcagttgagcaaatgagctatgagcatgatgcatatacagtgctgggggtacggtgtgatgggtggtacacgtgatgcagctctaagctagctagctacccaccatgtatggcgttctcgtactcactccgtcccgtaaaaaaacgaatctaagactggacgtaacatattctagtacaacgaatctagacacagagttatattaagatttgtagtattaggatgtgtcatatccaacaccaggttagttttttattggatggatagagtatgtacatgcgttcacgtgagcgcgtcccatccggccgatcgagccggccggagcgagctagctagctaagcgcgcatggcggcgtacgtaagtacgtccatggctgccggctgcgtgcccgcgcgcccggccgctgctctcgagatattcgagagagattgagactgtgtgtagtgcagcgcgcgcggcggcgtacgtactccgcagtacgcgcgcgcgcacgcagatgcatccaccacggaagctagcaatatccaaaagagcacatccacgcgcgaggctagcgccatggagagcgagctaggagcgctgtcgcacgtgcggcaggcagcgggcgcgcccgccgaggcggccgcatgtgctcccacgcctgcgcgaccctctcgccgcattaattgcttcgcacacgcctccgatcgatcgatcgatcgcatgagcgccatatgcgtgtgtgcagcggatcgagagagtggggagagagatgcagctaactgaattccttcgggtactggcggcgattggcgaagaatttcacctctcgtacggcgtcgtgaatccctgccgatcgatcgaaaagcggtcgagcggccgccgctagtggcggagccggcacaatggccgtcaagccggtagtgtttttcggtgatagattaatttttgttagtattgacggatatggacagtgaagacggtaacgatagagtcggggcggtcgcccgacctgtccgggaggtggcaccgcggcgccgcgcacgcatgctgcacaaggccgggagaaacgcctctatggcgtttgtgttgatctgtgttgcggacttgcgggcgtgaaacggcgtagtgtggggcttgggctttgacccgccctgtatattctagcgttatatggatgggatggaattgaggcccatccgattagaagggctagaatgaggcccatcacaatgaggtcttaggccgcgttgcttttgctgtgatcggctcatgttttttcgggactaagttcactcgaggtccttcaacttgatgtcgagtttgttccatcctaaaccgcaaaactggatataacgtgtccctcattttattaaactggtgcaaatatagtctaagatagtactccctccgtttctaaatatttgacgccgttgacttttttagcacttgtttgaccgtttgtcttattaaaaaaattaaataataattattttttttcctatcatttgatttattgttaaatatacttttatgtatacatatagttttatatatttcacaaaagtttttgaataagacaaacagttaaacatgtactaaaagaacaatggtgtcaaatatttagaaacggaggaagtattaaatatgtttttggatgacatgtcacaaaaaaagaaaaaatatgaaaaataaaaaatcacatggaccagagttctggtgctacatgcccagctcagccgaggcgactacgtcctcgcccaccatcgggatcatccaccagatcttgaacctgaacagggacaaccacttccaccccctgcgcacccaacaagagaacgaacccatcacaaaatcagcaccaccggcggcggcgcacatcgcagtctctcctatgggattgcctggtgagacacatatgtttctttaccttttagttttgtgtttggtaccacggcagcgtcatgctagttaaaaccgcttatttgtatcgattttacaagttgagagatgtgttatatacttatatctggtattgcggttgaggacgcaatttgaactcaacatcaagtcgagggatcttaagtgaacttgttccatttttttcctggagttacatggatgggctggaatggaggcctattgtatgcgacggattagatttcggcccaccgagacgaggacttttttgacacggaccaaaataaggccttactggcctttttctggcgaaaaagcaataaccggcctctgctctctggcccagtttggcgagcccaacaagttctacgtgaagaaacatttgctgggacaatttttattttatttttttctacttgtgttttggattttgtttgttttttttcgtgtacggtgttctgacctgagaaagaccatgcggcgtgttggacactactaaggagctgtttggttgggccgtttttggcccgtatcagatcccaccgtgaatagattgcattacacatgtttgtttcagatggatcgtaatcggatagcccgcaaacgaattccggcccaatacaaagctgattacactcataggcgggcggaaaacgataccgatacggagcgtaacctaactctcctcacgcgcctcgtccagatcgagcgccgccgcagcttctcctccacatcgcgcgcgtcgccatcgccgccccctctccctgtgcgcgtcgccggcgcctcctcctcaccctgtgcgcatcgccggcgcagccccctcgccccgcgcgtgtccccgcgccttcccatcgtcccgcgtgtcgccggcgccgtcccctcaccccccgcgcatcgccgacgccgccgtcttgcgctcctccaccaccgccgtcttccgatgtggatcttgaccggaagaactccgggaacaagggcgaggctgtgaagcagggggctggtgccatcaaccacatcggacttccgtcgttgctgtcatctatcaatcacctcgccggtgagaaccctccccctactgaaaccacctctctttataaattgtgaatgctgatgagtgatgatcctgtgataatcttttcattaacaaatcatgaagtagcttatactagtgaatctcatgtattaatcctgcctcatacatgttttcttcataagttcacatggttatgtagaatatattttcccagattgcaggaaagttgaatattagtgaatattttttttgagtgtagggaagtttgaccaactcatttttactatctagattttgagaattttgatttcttttactgccaggtgatatatcattttccacaatgtaagattggaaaaaaagttttgtgtaaaacaacagatacatgtaaatatccctgaatggatgcttgatattgtgttctagcaaatcacttaggtttagcaataaaaaaaatatgtactgtgtttattttagtggtagcttgatgtattatgcgtgctagcaggatatattctggacatggttaatgcttttgttttatatatttgtagagtgctatggctcgccttcccttaagtaccaaaacgcggagaagaaatttagggcttagaaatatgatgattgctgtcatacttatgtattatcatgttgttgtactgtttttaatttcatataagagaaaatattggaaaatagagaggaggatcagaactagagaacttaggagtgaaagactattccagcttattcgtgagagtgatattgcttgtataagcgagctccgaatggacaggaggacatttcacattctatgtgacatgcttagagacgtcggaggtattgaggatacaagaaatatgccgttggaggaatcagtagcttcattcttatatatactatctcaccatttaaagaatagaacaataggaaagtttttttaccgaagtggagagactgtgagtaggcatttcaatttatgcctacttgctgttctgaggcttcatcaacttctacttaagaagccagaacctatacctgaggacaccaccgacgatagatggaaatatttcaaggtaacccattctaaaaaataaatcacatttcctttaaaaaaaatcacatctcagcactattaattgtaccatattttattgatgtggtgttctggattgtagaattgcctaggtgcattggatggtacacacataaaagtaactgtcccaactaggataaaaggaagatatatgtcaagaaaaggagacattgttacaaatgtattaggtgtttgtgcacccgatatgcagttcatttacttactacctggttgggagggttctgcacatgatggtcgtgatgcaattcacaggccggacgggcttcgtgtccctcaaggcgagtctttttccaatcaatttattttgaagtttgacactccacagcctgaattgtactgatatttcttttttaaaattttaaaggttgctattaccttgtggatgctggttatacaaaagcagatggttttttagccccttaccgaggccaaagatatcatttaggccgtttcacagcacgtaacccaccacatagtgcagaggagtactttaacatgaggcatgcaagtgctagaaatattgtagagaggtcttttggaagactaaagggtcgttgggcgattttgaggtccccatcatattttcctatcaaaactcagtgtcgaattataatggcatgtgctttattgcacaacttaattttgcaaaagatgtctagtgatccatttgaggatgaggacgaggatgaggatgaggacgagataccattggatatacttgagggagaactcgccgaacctgagtttatctcagctatttcgacatctgatgattggacaaattttcgcaacactcttgctcaggggatgtataatagctatagggctcattgaggtttgtgttttaaatggaatttctaattgtttgcaaatcaaaaataaaaaaaatgttggtacaattatggatgcttactgatgttagttttctgttgaatttctaatattgcagttatggagcatcttggaagctcaagcattgtgcgtgggagaggcaagaacaagaggatttggacgtactttgaggatgaggagctgatcaaggcattgttcgagattgctttggatccaagctggaaatcagaagggggtttcaaaaatggatactgccaagttctagagaacgtgcttgctaagaagttgccaagttctggccttactgctgttccgcacatagagtcgagagtaagacactttaggaccaagtttggcgcaattgaagtgatgctaaccaaaagtggcttttcttgggatgacaatagaaagatgatacaatgtgagaaacaacaatacgatgatcattgcagggtaagtcatcaaactaactatggagtagaaaatttatttattgattcatgagtgcattgaattgaaatatgtgaaactactgtaagatattttatgaaattttgttccaaataagcggctatgtaaaattcctctgaaatgtttgcaaagacaacattatggttttctagtagtatgctttctcatacatatgttctcttgtgtttttcatgcaattgtagctgcataggtctctcttttgcttgctaaaccatgaccttaattttgtgtcattctttgtattttacagaaaaacaatgaggcaaagggtctatatggtgtagcattccctcactatgatacactagctgcaatttatggtaaagacattgctactggagaaggtgcagagggtcttggtgaggctgttgctaatatggagaaagaaattgttcaagatattcaagatgaagaagatgaggaggatgaagagagagtgtctagagaaacgcctcggcggagcatcgattcagctgcagctcgacggagcatcgattcagctgcagctcgacggagcatcgattcagccacacctcgacggagcattgattcaactgcttcaagctctaagaagaggaagaaagacagcaacaaactgaaaaataccttgtcaagtgacccttttatggatgtctttgccaatgttcaaggtgatctgagggatgttacaaagcatgtgggagcaatggtggcatctatgcaacgtgaagctgagatccaagagaaggcaatggctgaggaggacccactacaaaaaattcagaacgaagctattcttgagtgtcaaaagattggattgactggtactgaagttgtcaatgctgcagctgcttttgtaaaagtgccggctcaaatgagtatgcttctcgctcttccagagtctctcaggagggagtacgtactgaaaatacttgctggtaattcacttgatcaatcttgtagtgttgcaaatgcaacaggaaacatatcactttattttgtgatcattaattgtaagcatattgctctttaccacttagcatttcatatatgcattcatattatttgccttgcactagtataatgcatcaatggacccagctgtccatctcaatgccatagtaatattatattcacttctaactggagtatgtgcttggtctcttgcttacttgcttacacctaactgggagtttttgtactcctaaagttaaaaaatgctaccttttttctgaatatcatatatggcttgtctgtgcaagaatattcttaatttggtatgatgctgagcactatatattttctttcacctaatgtttctttcactaatttctgaattttttttttgttatcagatgaggcaaagaaaaattgatgtactgatgtgctggctgtcaagcatgatctacaagatgttcattatctgtttttgaattattagaattccatataagcataggccttggggattggagactacctatgtcctaaggatgtttagtttcagtacttcagctttatttgcttgaaccatgacaatctatatattctgtgatcaaagtactgtcctgtttttcagacagaagtattgcccctagcttattgtttactaatctgcaaaatgtctttttgtcttgagttctcactgtcaaaatttgtatccaaacatgaggtgacagtgtttggaatattatgaactatctgccaaaactctgctcgttgcatgtataggaattaactctcgagttatctttcaaacatttgcatgtcaaaatttattgagcttctttatgtagcttttgatgtcagctgctgttgatatagtactggagtgtgtctggtgcgaatgtttcatagcttatgtcatatgcttaattgcgtacttgtataagcatacttgtataatcagttatttgatcaatggttgtctggaagcaagcagttctttgattagtgtaatcggagcaaatgatcttcccaaaggcttctgtttcaaatttcgaattgtgtcctattgatcagcctcccgttccttggctgccatccgcaatccgcaaccaaacgcagtaatgtaaataaatgacgttaccgcctgcaaccaaactaatcatgtaatcggataaattggtatccgttacggctggaggcaataccattagcgtttacgttaccacatccgaaccaaacaccacctaaagagtaaacaaaaatgttctctagaattatccttttaagaggcaaatattggcatgagtacaatattgtcagcgttattggctgacctgatcgctaattcgctgtgtggtcagccgcctggtctactgatctggtgctgcggcatctcgcagcgttcacactgcacaggtggagttctgcatcttccctccgatcgcatgtgccagcaattccatgagagtccatgcggcccaaaacatcctcaagtggttcatagcgtaatcatgcgacacgtagcaggcgtttctaattttaccatttccaaaatttttaaatcacatgtgctaatttttcaccaggttgtaccctgtcggatggtttggaaattctataaatactttatacatctgtattactagaaacacatcaccctatatatttaacacgtatttaaactcgtcatagagcttatactgtactctgaacggtcgacatgcatgccatcaccactgcgatcctttcgctttgcctatccttctcgcccactaccaccgctatgggtgtcaggcctatgacaacgtcatcaacaagtgttacatggatctcctcggcatatagatcacgtgtggtgtaattaaagacacatgaaaagagctaaagtcggacaaaatgataccaatcggaaatgctttaagaaatgaaaggaaaagatacggtaactagcaaatgtgatagatgtatcggcatggattgactgagtattcaactcttcaacggattctactatcatacatatgtctgtacgacaaacaacggatacctcgaccaaacaggatgacaatcgtgataaatgcatcggtgtggatcaagtgagtattcgaggccgtgtttagtttccctctattcccaactttccatcacatcatatcacatcaaaattttttctacacatataaacttttaacttttttttcaaactcctaacttttttcaaactttcaacttttttcaggaactaaacacacccgactctccaacatattctactgtcgtacatgcgcatgaacgatgaataacgaaacatatacgtacagcttttgtcggactcaaaaaattcgtactctcttcgtcaaattaaactaatctagtataagattggaacattatattaaaatatatttattttatatcagcttattttggaatggttgtattaattcaattcggataacatgacggaggactgttatcgtcgttggttgcatcaacaaggctcaacctaaaagcacaattatctgttgcagaaaatcctccaccttcgcatcctgtcctgttgagacctgaggtacccttgcagtggtgcatccccctttctttcccacttgaccaccttgtttgattaatcgcttaaaagctgcaggtgtactaatgaaagtagtactagtatacttaaccaattgaccatactcttcctagaatggcgaagagcaaatttaatagtaaagctcactgcttactataaatttagagttaacttatataataagttagttgtaaggttaactttattttttctataaggttaactttattttttccattctctctctttctcactccataaatttaatgcatattttttggaggttgtgtggagctaactcttgcatgagagccaatactacccacttttccttatctctcttccacataaagtatatagtttgcttatagcccattattatccttgctcttatgagggggggcgattagttaacgttaagcacgcttttacgagcgagaagacaggctgtcacgcttttaacagcaaacacatcacacattaatcaattcgcctccagcaccaagccaaccgaggctcttgggagttgggagttgggactccctgtgcctctcctctccaccgcaacgaccacaaatcaccatctgctttctagtttcttcctgaagttctgcgtcataaaggcaaaaatccaagattgattttggatgaaaaagactgcagtgcttagcaagtgttctgttcttggagtcgcaagctgcggctagctagcaagcaagcagctttttttttttcgcagatcttggtgaagagcctgttcttccatggctttcgctttgtgaggtaacatgtgttttttacattctggaatatgagtaggagtatatacttgaaacaataaggtaccatggcatgcttgtaaaatttctataccatagcaccgtcagatttttatggtaaaaaagaacagatttttatggtatttgttcagttctctttagtgagatccttgtgtttaatttgcagagaaaagggtattgttagtcagtaagtaaaagggtggatcttgttcgaagattcaagagtcatgttggattctggttcttatgatgatgttgactatggggatttgttctccatccccaatccacctgcgcctcacttgctcaatttccccctccagttcttcccttccaacggattcatcagttctgctgatgattcccatagatcaccagctggtatgtttggctcgaccccaagccccacatcaaccacaaccgagttggaaaattcagaggatctgtctgaatccgccgacgatgcggtcctagcatacatcaatcagtttcttcttgaagatgaggaagatgaatcttgtcctggcaccatcacatcggtggaggactctgccctcctcgccgtcgagaagccattcgttgacatcctcactgctagccaagaggcctgtcaagagaattcttggatagattcttgttgtgatttcacggggaatggaggattgcttgatacgttcacaaccacacatgccgcttgccagccagcgccttgtgaatttgagaaggagaagggggagtgtgctgttcataaaggccggaagaacccgcatgatgattgcctattgttcgaggaagagagcaggaggagcaagcagttggcagtgtctgaggaggagactgtcagagagatgtttgacaaggtgcttctgtgtaatggcgaatgcgagctccgggcaccactgccagctgaagcacggaactgcggggtgtacgtgaaaggatctggaaataagagaggccgaaagaaaggaaaatctggagcatctgcagaggatgatgcggttgatctcactaccctactcattcattgtgcccaggccgctgcaatcgatgatcaccggaactccaatgagttgctgaaacaaattaggcagcgttcttctgcatatggagatgccggtcagaggttagcacattgttttgctaatgcgttggaggctcggctagctggcactggcagcaacatttaccgttcacttgctgccaagcgaacttctgtttatgacatattgaatgcattcaagctgtatgttacagcatgcccgttcaagaaaatatcgaacttcttctcgatcgaagccatcttgaacgcatccaagggtatgacaaggttgcacattgttgactatggtatacagtatggattccagtggccaatcttcttccagcggatctcgaagagacctggtggccctccaagtgttcgaatcaccggtgttgacttaccacagccgggattccgccctgcacaactcattgaggcgacgggccgtcggttgcatgactatgcccgtatgttcaatgttccatttgaataccatgctattgctgccaagtgggacactatccgtgtcgaagatcttaagatagacaaagacaaggatgaacttcttgttgttaactgccttttccggatgagaaacatgatggacgaaatggtgacagatgacagcccaagaatgcaggttctgaagacaataagaaagatgaatccaaatttgttcatccatggcgttgtcaatggcacctacaatgcgcccttcttcgtgacacgattcaaggaggctttgttctactactcttcactttttgatatgcttgaaacaactgcttcacgggtcgacgaaaacaggctgctgatagaaagagatctcttcggccgggaagctcttaatgtggttgcttgtgagggcactgagagagtagaaagaccagagacgtacaagcaatggcaggtgaggaacatcagggcaggcttcaagcagctaccactgaaccaagagacggtgaagaaggcaagatacaaggtgaagaaatcctaccacagggatttcctagttgacgaagataacaaatggatgctgcaaggttggaaggggcgtatcatctttgctctttcagcatgggaaccaaactagcaaactgtaaatatgactaactcagctgatttcttctgtggaggtaccactccattagttatgtctgattcctatttcaatgaattttgacctatttctgggcaatagaagatattggattttgactgggctagagtatactttggatgagtatctgacagaaaaggatatacttctctctaagcgtgtgtgacctgtggggctcaaaactgtactttgaaaacacaattacacatcatgcatgtactgttcacatggtccagcctgggcaaagggttaaagcctacatggtgaattggtgatataaataacgaaatggtttatctgcaacttgatatgtagtagtacagcgtggatgtaaccaacttgcaactagttcaatgaaccaaaagaacagcacaatttatccacccaaaaacaaaagcccaacttgctcataatgtgctaatgtattgttcagtgcaatgcttctgaattcaagtggcgcctcaacatatttttcttctgtacaacatgagcacggagcgggcccagactgttttttcttctgacaattaatgtttgcattgagaaacataagcgtctcacactctcactgatcccaaatcgtcaaatttgatgagaggccctagagatccaaagaaagagcagtatattgatccattgcacgctgcctttccggtgttcatccacaagtccacaaccccccgcaccatcgctgcgttactggagcacgaatcatgcagcggagcggacaggagaaagctagctagccgcgcgcattgccggaaaacgcgcaacttgattttactttgggtggcagattagctgggagcatgtgtgtgtggagtaataggaatgcatgcacacttcaattcataggatttttttcatgaggtttgtgtggatgaaaattttcccttgttttctctccacaattagaaaggaaaatttattttggttttcttatatctaaattcctatgaaccgtatgatattcataagaattaatccctagaaatccaaatcctttaaaattcctccaaaacgattaggccctgattgttatctttgtatccaacttctgggccgaactatatctaggccctgcctcaggtggaggcctttctgcataaaaacgcttggatttgcaatacattcactaggctttgaatagctgatttccaacccagacaccaaagtactaatacactggtaaaaactttactataactatattttttatgccactgacctttgccatatcaataatgtattataaatattttatttcctactgattttttaacatgctaatttctgactctagagagcaaatgttaatgtttctttgttttccactcttttttacattatctggggatttgattagtgtggaaatgtggactagggtactggccgtatactgcttagccgtccgaaacattgggatatctgtgcccaataatctttaatcagtgatatcttctctagttagcaggctagcagttgtaactctcaattccatcgatactactttcatacctgggattgtcacaaagatatttcaagctgtcatttgtgacgtacatgcttgcattgattattattttttagtacgcaacgacaaatttgcttctgtttttacacctctctctttttttaaaccttagccagcttagctggttttatatttcataagataagcactgtacaaaatttacacctctctcaacaatatatttcaatgaaaacatcaacactgttacaaccataactgtcagtctgtcacattaccatctagaactaactctagatgaaaagcacaagctcttgcatgtttagttaagaacgatgcttgcaggacgtacggactctccctagtgattaggacacaagaaatgcccttagtagtgtagtctcccagacaacccagcggcatagtttcgcagcatatgccggctaaaactatacagaaattagaatgcatttgaactttagatatacagacacgacgacaccaatggttggacttttcatccaggctcgacagagatgttttgactcatgacaacgttagctatatgcaaggacgacgtacttacatatcgtatacacatgcataattaattgcgtatactctctgttgtcatgtgtgtgttggaaaaacggggaacagattctgaaaaatggctgtaacctcattggaatgaccatttggccaatcatatcttccgttctagaagcagaaaagaatgaaaggttgcaagcttggacatggaggcgaaggaaccgaggacaagagtccataggacaagatgcagacagctagcttggataatatatagagttgaggagcttaacgatttttacctgtttggttgtttgtattttacttgagattcactcagtttgtctcactgtcaaagagttcatgacagctcaaagtcctacttttatattagcatcacacattttactaacagacttgtagcttacttcagtttcctgtctgaaatttaagtactactagtactagccatataggagggaagagaaatggttgtcactgaatttggttagtgcataagaattctgtctttttgtttactctaaaattgaatccaacataaggtgcatttgagcatttggatagatgaatatactacaagtaaattcaatgcgacatatatttgtagcctctcaggtttgatacactgtaatagttggttttgcaattatgtgtcaatcctgctaaaacgaacttgcatagatggattcagagaatcagagatgccgctgcgtcctctatggtaccagtgtaatctgttagctactccttggaagtacttcacccagattccagatcgacttcattgatcccaaacttcaagttcaaggatgcatcacagaagccaatgcaacacaactgtgtcatatgctttttccttggcagatttttgctgattccatcagcagaatcaactcagctcccagcattcaccaggtgatagtgatgcaatccatgccagtttgcagcatacagctattctgtgtttcacacttgcaaacatgagcaaaagcacacaactcggtgagactaccaatgctagccccctcctcattttgtctcgccgaacccggctcaagcgtagcacaagatttgtataaatactcggcgaagaaattgcacgcagttctcgtcagtgttcgcgccaaaacttggttaaaaaaaggcacacgggagctgaccgacagaccggaaaatggcgccaacaagtagcactgaggaggtgaagcacctgacgcttcaccacttgttgaagcggcagcaccggctcaagcccgccgccgtggtgtggagatggccgacgtcggtggtgcccggcggcggcgccgggcggccgccggtgcccgacgagcagctggcggcggacgacgtggacggcctgggcgggacgtggccgccgcggtcctacacgtgcgcgttctgccgccgcgagttccggtccgcgcaggcgctgggcgggcacatgaacgtgcaccgccgcgaccgcgccaagatgcgcggccacgggctccacggcgccgccgggcagcagctcggcgcggcggaggcgcctgccgccgccgccgccgcgaggacggagtacgccgtggcgctgtaccccatcctgaactccggcgcgggcggcgcggcggtgcgcataccgcacggagacgtgctgctctccgcgcccgtcgcgctggcggccgcgcgccgtggccatgatcaccggtgcatcgatgtaggtgacgacgagaacgacaagaagattgacctggagctgcgccttgggtggccgtgatcgatataccatggacatggagacatttttttacagtcgccatgatgtgtgaatttctttccccaccattttgatcatttttcaaataactcgagtgaaactcatggtttgctactgcatactccctccgtctcataatataaggaattttgatattttgcttacattttttgaccactcatcttattcaaaaaaaaatttatgtaaatataaaaaacgaaaagttgtgcttaaagtactttggataataaagtaagtcaaaaaaataaataataattccaaatctatttattattaaaatagctttgaaaggaggcaccacgttgattgtggaggctagaaattcccacattaatcagagaaaaagaaaaaaagaaaaaaaaagtccaagtagaaatacaatctaaaaatagctaaaattcagaattaaacataagcaatattgaaagaaattttcatataagaacccaatacgagattaataaaaaatcgaaataaaaataaaataaaatccaaaattagaaaagaaaaggatagtccaagtagaaatacaattttaaaatagctaaaattcggaattaaaaataagaaatattaaaataagagtccatataaaaacccaatacaagattaattaaaattgggaataaaaataaaaataaaatctgaaattagcaaaaaaagagagttcaactaggaatacaatttaaaattagctgaaattcggaattaaaaataagcaatattgaaagaataatctatataagaacccaatacgagattaattaaaattcagaataaaaaaataaaataatatccaaaattaaaaaattaaaagagagttcaagtaggagtacaatttcgaaacaactgaaattgaaaataaaaaataaaaaaattaaaagaacacaatacgatattaattaaaatttaaaaaaaaatctgaaattagaaaaagaaaaataagatttcaattaggaatacaatttataaatatctaaaatttgtgataaaaataaagactattgaaagaaaataccatataaaacacatgacgagataaattaagtaacaggcctataaaggagtaaagtggtgacatataaaaactgttaataaaacacctaatagaatcctaatgacgattaaaatgagggacgacaggcaggccgtgaagcaaacgagcgaggcggttgccgggacttctagaaagtaaaaagaataaaccccattgataatcatattcgatttttaaatatctctatgacaataaaaaggagaagcagcaggcggggtgtataggagtatagttgcagagccgctgacggttgacgggacttctagaaaataaaaaaagaattccaacgatagttatgtacgatttttagaatcacaatgacaataaagagtaggcggcggacaggccgtagaggagcatagtggcatcatttgacgagacaataaactctaaaaactagaatgtccaatttttaaaggttcggaacttctaaaaagtaaaaaaaacaatgataattatgttcgattttaaaatctcaatgacaataaagaagagaggcagcgggcgagccgtagagaagtacaatggtaaagccgctgatggtttggcgggatttctagaaagtaaaaatgaacccaaacgataattatgttcgatttttaaaatctcaatggcaataaagagaagagacagtggaggggccatagaggagtataatggtaatgtttgacgggacatctagaaattataaaaacgaaacccaacgtgacaataaactctaaaaattataaggtccaatttttaaagattctaaggagaatgaaaagaaatagtggtagatcgagcaagcaaataaaaatggagatgacataaggggtagcaactggtgtgacttaaaaaaatatataattagaaacaaggggatgataaggtttggtctttcaaagtcttaagacaatgaaatagctatttaataaattttaagtaaaatcataaaaaaatatgattttgtttcggtgctaactgcgtaattgtacgggccacccagctagttttttttaataagacgaatggtcaaacagtgtaagttcaatgtcaaaatcccttatattaggacggagggagtgcattagtaacggtgagacaaaatgaaatttatttccattattaacaaagaacagtgagaaaaaaatggtgaggcaagaagagcgaagaagaaagggacaaatatgtaggcctaagcatcgcgagtgatgtgcttctccccatgatttccgacagtttcgaggcggcgccaaggcccaaggattcctatctgaggattgccggtgaaatatcagtagcatacatgatacatataccatacattttactcctatcatataataagaaaaaaaaaaggaataagttcacttgaacttcaaccgcaaaaccggataggatgcctatccgaactattaaaaccggtgtaatttcattccctcgacggttttggaggatggtttcgctgacgtgatgcatacgtggcggtattgacctggtctttcttccacgtgacgttgacgtggcacttatatgacattaaaattttaaaaatatgtagctccagaagagagcgcagcagaagtacagcgccaagcagtgacatgaagcagcactgccacgacgagcatgtgcgcgtggtcgtgcggccgcggtgcgccgtccttgcagtacaccttgtggatctcctcgcggtcgtcgccggtgtcggggcgccaccggcggagcagcacgaggtggtggaagatcttggcgtgctggtgcaggcacatgatggtgaagagcgtgttgaggttctggaccatctggtcgatcacctccgtccacttcttccgctgctcgtcgtcgggatggtggagtcgagcatgccggtcatgagcatgaacagcagcagcagcccggcggcgacgaacaccaaccaaatgatcatggcaaagttcttgggcttcctgcaccagctcactggaggcgccgacgacggctcctccatggttgacatgcttttgcgtacatggtgcgatgcagatggcggtgacggcggcgttgaacggcgtcgggctagcactgcaaatcccggcgatatgctccttcaacgccgactgcgaatcctggcaactacgcggcggcggtgctggcagcgtcgacgaccaccaccgccaagccggtgcggcaagagctacaggagttcgcaagggaggcgaagggactcacgggctcattccccaggtcggcgctctccttcacggcgatgtggctagagctcgttcgctgccgtcctactcctcgcactccctagtggcctagtgacccacccaccgccgccaagcacggcgccgcgctgctcatggcgtcgtggaacccatcgtcgacgaacggtggtcggcgtcctcgccgagcgcctgnncggcnncnancnnnntncnnnnnnnggggggggggggggggcgccgccgtcgaggcggagcggtgcaacgcggcgtccctcgcaagggcgctgtatcgccgtccccatggtgctgtccggtactgagagaagggaggaagaggggaggaagaagaagagagaggatgatatgttgggcccacatgtcagtgggccccaccttttttatgtgtgtgaatgacaaacggatcccacatatacgtttttaattcaaatgacatctaagcgtcatgtcaacccacag

SEQ ID NO: 75052 - DNA, 3968 bp, Oryza sativa
ttggattctgtttatgtgttttttctagaattggtatgttgcactcgtgttctgtaaagtgtgctaaagtggtatgtatgtgccttatgttctgtgcattgcgggctttaattgtgtgatagtttgtttctcggacagataactagtaaacagctttaaaaagatggaaacataggttgtttgtaactataaaagacagtacattatcagcagcattaggtaataatgtgtctctagtactaaatcacgcgtaccagcatgtacagatatatgctcaattggttgttataagtaccttcaaaacaaaagatgatcgaaatgccaaattgatcatagtagcaaacaaaagagattagggtcagaggagatagcaaacatggagattaatgcttcttcaggttctaattgcttttctgttgcactattgcttaactcctcctgtggatcttcctcatcctcaccaacctcttcttcttaacccaatagcatgtttagtttgattttacactaatgcaagctctgccaatttgtttttataatcagcgatatatcttcgataaagtgctaagaaaagaacaagtaaactattgcatggtcttgtgaagctgtctttcgggtccaacttaactatattggtaggtctgactatctgtctttacctgctatcgatgtaaaactgccctatgtggcagctctggtcctccctttacattaccagtaggtaatttgtctagtgcctgtaccctttcttttgatagaggagtcagtgtaagccaatgcttaggtcttcacctccagccaatcagaatctgaagtcagcggggtattccaatatagctacttctaaggaggttccctagcactcagaaaccctgggggccaggcagtgaaacgttccgcagactgctcacccggccacacctcggagccgatgaaggctggcaatacaagcatcatctgtccaacagcctacttctcatccgtaaacatcacagttcgttagtgcaagcgggaatgagaacaccactatcttagaagaaattagtagaacttagttcagaatgtacaaatgtatgctagatactctcactacgattccagattagaaccggaatagttaaccaatggaataggtgtaggcggtttgatcgtttccttttctccgatcataaataacctgatctctttctttgtctttcatcaaataagtacaagaattgcatagatgaggattcggtattgatcgctaaaatgcgagaaaaagacccacgtttctctgttcgtccgctgtcagatcaaacgggtagggatcggcccagcctagaacaactcgcttctcataaaaacgaatccctttgtgcctggaagaaatgcaaaggggaatgctgggtcagtgtaaagaaaagcatggggcgggtctgctgttttgttatcttatagaaagtgaactgcgaatcgaaccaacttgtccggaatatgctctatcggccccgtctctcggtcaggtaagaaaaaaccaaggaattgatcatccaggcgcgcctattcggcttgcttgataggctggcgcataacccccatttcttgacccagattcacaaccgaacctatttctcatcttcatcccgacctatctatatgtgaaactctgcccaaatcctcgtagtactaagtcgtggcttacaagctagcccctactccttgtttgggcaagatctatatggtttaccaaaatggcatagacaccagatcctttttatcaagcgtgcaggaccagtgaagaaaaaagatttgcaaaaacacacatgaaacatattgaactcctaagaaacacctgacctcaggtgcttttttctcttgccttctggatggttctgaagtagtgaacagcttccgaccattatgaccttttattgaatttttgattttctataggagctcactactgctgcatttcaaatgtgcccgcctattgccttaatttacagacctctgcgattcacatatagccccactaatgtaagacagctcaagcgagtctagcttaagatataaaatcacactagccaataaaaaaagtagccaaacaaagccaggtagttttcatctaggtgaacaagtagaaagagcttacttggtagtggggaactcttgctgcattatctgagtgtatatgcctgttaaaaactagcatcgtaggaactttaagaaaaaggatattgttttagcagctcttatttctattttactgctcaactagctcttaaacattaaaagggcacttacccagaaaggtaagttttcttactaacccactttaaaggccagatcatatgcggtgatatactacggcagaaagaaaacgaagacaacaaagctttcccagtgataaaacggaggactttacacacttttgcttattaccaaagaaaagaagcttgttgaaagcgctcgcttcgtgaaaacaaagcagaaggaagcggggaatgtcccgtccaccaatagtatacagaatttggatacgtcactaactatagtgaaaaggatcttcggagtttttacgatgttccaatcaatgggtaagaagatccacccacaatatgttcatctcttgcttcaaagactagttcttccgaaggagagaaaggaagagtagttgtaagataacaccgagaatagttacaagccatatgtgactgcaaaaagtacgatttacctagcaaccatttattttgtgaattcattagcaacaagctgtttgtgtatcactttgaactgggaatgaattttgtgctttttcactgaagtactcttgcttttgaactcagcaaatccctccttttcccgcaacaaagatctttagtaatccgggctaacttttgtccataaatcccgcgtaagaagtaaaatgacaagggctgacaattcttagaatataaagagagacaagtttgttaaaaaccatattatcatatatagttttcatgcctgggcattctggcgcatgttttacaataagtaagtgcggcgcccaatagagctaaccttacacagtacctatacaggttgagcccccaaaaaaagcactcttgtgtgcctactcctcgacttagccgccgtcatagagagctttctaatcgttgaaaagccctggaactcaaataaaaaaacactcatttaagccttttttacgggcaagagaacttttatctgctcgtcttttcccaggatttctttctgaacttgtacgggtatgacccgcgttcctttcatattaaaaacactagcttgtttagttccacttcttttcacaggagaacttgccggtacctctagactcgcttcattgtcattctactcgcggcactgggtatcagttatcggagtgatcggggtgatggtgatagttgttacgatccgtaactggtgatgaacagcaaaggtttttggttagttgaccctgttaaccgtaaagaaaaggagaaagataagtggactgggcaataaatgactatgtccatattgtaataacccgagtaagtatctgagtaagaccaataaggaaagtacacggagatgtattaaagtgaaatccgctttattgggacaactcggatggattggattggatatagtagcaggctgaatccttggagcatataaggataggctaataaagtggaactgggattttttgatagaatctacccaatgaggaattttcaggaatggagaatgttgtggtaagaccgatgatattctgatagaacccatggttggacgtagattgcactatacttccccaccacaggacgtaaagacggaacgctgaaatcaggagatgaagtagctgttggtcttgcctaaattcagtattctaagttggcgaagcctcatacatatcgataggaggttgagggatccggaaagtctccgttacgttctatcttgctttgggttttgctgac

SEQ ID NO: 75053 - DNA, 2585 bp, Oryza sativa
aaaggacacctatcacgcggtcatgccttgaacgcagtaaagaaattaataagcttcgaataatagctacgctagtctccaatagcgtcttaagcgttggttttctttgcgggcatcgtaatggattggtggttcgttgcctctattttaaatagggtacggcatactcgcctgaatcttctctctcggttactcagtggagtgatctctctcttaaattcccataaggataaggaaaagtagacggttcgaaacccgtgcttaaatcctactgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaagaatggcataatagggttgcatttgcaaaagcagcatttagcaaacttttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataacagcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataataatgagtcattagttatcccgaatgtgtactaatgtttctaagcagggctaagcaattatatctaatatctagttgaaacaatataaataaagctcaactagtcaaattgtaataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcactaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggttttggtggaccgggcgcacgggcggcggttcacgcgaacggacggccgagatcgaaccaatccaaaacggacggccgagatcgatcgggtccacggcggctcacggcggacaaccccgatgacgtcggcaatgacgtcaccgacagcggcggcgactcgacggagcggacggctcggacggcgcacgctcgccggcgaacggcggcgcgaggacgcaaacggagggcaccagcacgtagaggacaacgcggcgaacacaccggtgaccaaaacggcggcggaagaacaacggacgacgacggcggcgaggaggaaacggcggaaaccttcgggttgtcgacggcgacgaagctccgacgatctccggtgacggcgaaggggcggacgaggacggcgacgtgacggcgaccacgatgacgtccttcccgagcgacggcgcgtctggaacggcggcggagcacggctggagcggcggcggcgacggcgaagctagggcacacggcgctagagcgaaaccggcgacgagaggcgaaggcgagggtgcctaaaaaaacaggag

SEQ ID NO: 75054 - DNA, 11890 bp, Oryza sativa
ttcgatctcaagactatcaccagccaagcctcagcattgccggcgtcaaatctagtcgcaggagcaggggacatgatgaacggtccgttcgctcgcctcccgagcgatatagggagcgccaagtcgaacgaccacagtccccacatcgaagatgccccatcgatcttcgcgacaccatcaaccagcgccgcgcacaagaggccatcattcaccggatcgctacgacgacgacgtggacggagttgctgccttcacaagcgatctgtgtcgagtggattggccagccagctttaagccgactggaatcgagaaatatgacggcaccaccaaccctgagtcttggcttaccgtctatagtctcgcaatctgcgcagcaggaggagacagcaaagccatggcgaactatctacctgtggccctagcggattctgcccggtcatggcttcatgggctaccccgcggcacgatcggatcatgggcagagctacgcgaccacttcatcgccaacttccaaggtacttttgaacggcccggtacacacttcgatctctacaacatcgttcagaagtctggagaatctcttcgagattacattcgacgcttctctgagcaacgtaacaagatctccgacatcaccgacgatgttatcatcgccgcctttactaaaggcattcgccacgaggacctagtcggcaagttcggacgcaaacctcccaagacggtcaaacatatgtttgaaaaagccaatgagtatgccaaagccgaagatgctatcacagcgtccaagcagtcgggcaccacttggaagccaaagaaggacacgccgactgcaggagggagcggaagtaacaaccacaaggatcgcaagcgtaagcccgaagaacttgtggccacaacctctccatcttcccgacaacgtccccgcgtcaacaccttcgacaagataatgaactcccaatgtccgcatcaccccaactccaaccacgtggccaaggattgcttcgtctacaaacaatttgcggagcaatacgtgaagaacgcacgtaagccctcagacggagatcaaggcacatcaaagaagaaagatgatgaagacgatgccccgactggttttcaagatcatcgcaaagaacttaatcacatcttcggcggacccctggcttatgaatataagagaaagcagaagctaacagaacgggagatcaatgcagttcagcctaacacgccccaatacctccggtggtcagagatagcaattaaattcgaccgctcagatcatcccgaccgagtggtccacccggggcggtatcctctggtactagacccagtggttcgcaacgtcaagctccgacgaactctcatcgatggtggcagcgcactcaacatccttttcgctaagaccctggacgatatgcagattcctcgcacagaattaaagccgagtaatgcacccttccacggtgttatcccaggattgtcagctacaccacttggccatatcactcttccagttaccttcggcactcgggagaattttcgcacagaaaatgtttgtttcgaagttgctgatttcgagacagcatatcatgctatactcggacgactggctctagccaaattcgtggccgtcccacactacacctacatgatgatcaagatgcctggtcctcgaggggtcatatcactacggaacgacatcaagcaagccgtcacatgtgacaaagaaagttgcgagatggcccaaactcacgagactactctcgcccgcgaagagatccgactggctgcgaccacggcaagcgagggagaagtgcctgcaaccaagctgacgaagaccgaagaaagtgatgccaagacgaaaaagattcccttagatccctccgatcctgataagactgctgtaataggcgctgagttagattgtaaataggaaagcgcgctcatcacctttcttcagaataataaagatatttttgcgtggaaaccatccgatatgcctggtatccccagagaggtgattgagcactctttacatgttaaggaagacgccaaacccatcaagcaacgactccaccgttttgcacaggacaggaaggatgcgatcaaggaggaattaaccaagctgttagcagcaggcttcattaaggaagtccttcatcccgactggctggctaacccagtcctggttcggaaaaagacggggcaatggcgcatgtgtgtcgattataccgacctctacaaatcttgtcccaaagacccttttgggttacctcgcattgaccaggtggttgactcaacggccggctacgagttactcagcttcttggactgttactcgggatatcatcaaatccgactaaaagaatccgactgcttgaagacctcgtttattacgccctttggggcctactgctacatcaccatgccctttggattgaagaatgcaggagcgacctatcaacgcatgattcaaagatgtttttcaactcagatcggtcgtaatgttgaagcttatgttgatgatatagtcgtcaagaccaagcagaaggatgatctgattgcggatttagaagaaacctttacaagcatacgtgctttcaagatgaaactaaacccggaaaagtgcatcttcggagtaccatcagggaagttgctcggatttatggtatctcaaagaggcatacaggccaacccagagaaaatcaacgccatcctcaacatgaaaccgccaagctcccaaaaagacgtccaaaagctgactggttgcatggcggcgctcagccggttcgtctcacgactcggcgaatgggggatgcccttcttcaagctgctgaagaagactaacaatttccagtggggacccgaagcacaaaaagcctttgaagacttcaagaaacttcttaccactccaccagttttggcctcaccacatccaccagagccgctactgttatatgtgtcggcgacctcccaggttgtgagtacggtcctggttgtcgagcgtgaagaggaaggccatattcaaaaagtccaacgaccaatttattttgtcagcgaggttttagccgactccaagacaaggtatcctcaggttcaaaagttattatatggtgtcttaattaccatcaggaaattatctcactactttcaaagtcactcggtcacggtggtcacatcgtttccactcggggatatacttcataatcgcgaagcaaacagacggattgcgaagtgggccttagaattgatgtctttggacatatcgttcaaaccacgaacttcgatcaagtcacaagctttagctgatttccttgccgagtggaccgagtgccaagaagacatgccagaggaaaagatggaatattggactatgcattttgatgggtcgaagaggcttacaggcactggagctggggttgttttaatctccccgactggagaaagattgagctacgtattgtggatacatttttctgcgtcccataatgtggcggaatacgaggcgctactccatggactaaggattgcaatatctctaagtattcgccgactaatcgtccgtggatactctcagttggttgtcaatcaagtcatgaaagagtggtcatgtctagatgataatatgaccgcttatcgacaagaggtacgcaagttggaaaataaattcgatggactcgagctcacccatgtcctccgacataacaatgaggcagccgacagactggccaattttggttcaaaacgggaagcagctccttcagatgtgtttgtcgaacacctttacgaaccgaccgtgcccagaaaagagacagtcgaagccatggatattcaaggcgtaagcatgatcgaagccgactggagagaaccgtttataaaatttttgagcaaacaagaactacctcaagacgaaaatgaagccgagcggatttccaggcgcagtagactttacattattcatgagactgagctgtacaagaaaagtccgtcaggaatactgcagcgctgtgtgtctttggaagaagggagacagttgttgaaggatatacattctggtatttgtggtaaccatgccgctgcacggaccattatcggcaaagcttaccggcaaggttttttctagcctacagcggtgtccgacgctgacaagattgtgcgaacatgcgaaggttgtcaattttttgccagacaaattcatttgccagcccaagagttgcaaaccatcccgttgttctggccatttgcggtctgggggcttgacatggtcggcccgtttaaaagggtagtcggtggttacacgcatctctttgtggctatcgacaaattctccaagtggattgaggctaaaccggtcatcacgatcacaacagataaagttagagattttttcatcaacattgtgcatcggtttggggtacctaatcggatcatcactgacaatggcactcaattcactggcggagcatttaaagacttttgtgaagacttcggcattaaaattttttacgcctccgtggcgcaccctatgaataacggacaagtcgagcgcgctaacggcatgatattgcaagggatcaaagcacgagtttttgaccgactacgtccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaacgaggagggctatgaagagggccgagtagatgacatcaaccgactagaagaagcccgagaagcagctttaattcagtcgactcgatatttgcaagggttacgccgttatcataatcggaatgttcgatcgcgagcctttttagtcggtgacctggttctgaggaaaattcaaacaacacaggatcggcataaattatctcccttatgggaaggacagttcataattgctgaagtcactcggccaggttcttatcgactcaagcgcgaagacggtactctcatcaacaattcttggaatattgaacaccttcgtcgattttatgcttaggcatttcgcttgtatctttcctatttgactgctaacttcaagtttctccttgaagttttcagtcagggggctattatgatagtaatggagtgtgatttttatcaattcaatttgcttacttgatttatcattgccctgtttggtctttcgacttagccaatgaggactgaaggtttttaatagcttttgcgggttttaggctcaataaggcttgacaaaggcttttaagaaatcagaagctaagtatggaacaccaagcatagcataaattcatcagtattgtacaaattgagcctccaccgtcattgatcatcaaaatcattgttatatcaatcagtatcagttttttcatcatcagacttattagacccagtcggccgaaggtcgacatattggaatctctcaactacatcagcagcaatcttgtcagccgctttctgcgcatcattgatgaggtcaagagcagcttctttgctcgtcccgtctgcaaagccatcaatggcatcaatgtcaactcttggataaagggatttggtcatcgccaatgccagacttgctcccatacttccagcttctttgatgttcttgaagtaagtatctggagcgactctcagcttgtcgaagatttcggcagcatcaagtgtactcgaaccggcgttattgaagaacatggcctggataagtggagtagcggcattagcgactttatccctggctccttcaagcttgttgatcttgtcaactaagacatcaaattgtgcttgagacttgatcttgcggtctgcgtcaacagattcacattaatgaatcagcatgtagaagataatggcttttgaagtattgattattggtaccttcaacctcctttaaagccgaatccctctgtcttgccagctctgccttgtcattttccagagtttggatatgcttctctagttgagatatcttggcagcttgcactacattaacttcggttaatcaaggttacaaagataacagcacaaattagttgggcagagtttgcgcgaaccttttgatgagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcggttttcgcctcgttcctaagatgaatcctctgcggagcagtttaatcagcgctcgagctagacagtaaacaagatggctgaggtcaggcatcaaagaaacttacatttacaatgcgagtcgcttggttgagtccctttttcagcaggcatacctcttcgtcttctttttgccggtttattacaattccttgaggttgcaagttgtcatcccaccacttgaccagaataggagggcacgaatcttcggttgcttatatacggggaatttcttcttcatcatcgatcattggtcctaatgcatccaatgacaaaggttagacaatcgatcagagttatttgggtcaacatggtttcggacaaagtgtttacctgtaatgatttcaggacgaggacgagtggattcggatacttttaaaggggatccagatctccggtcattgctggcgtcttgtccgcgagggttgtttgcttgggtttcgacttctggaatctcttggcttggccctgcgtccgactggtttccagtcgggggatcttgattaactccggcttcggcttcggccaactggattccagtcgggggttggtcactggattctacattatcggttgccggttgattgtcactcggatgatcctcagcagttggctcagtttctttggaagaacttgtgtccacgttagttgggtcagagtctttcccagacggatctatatcagatggcttcctgcaaatttgattatcagtattattgccgcaatgggtgcgcatcaatgcaagagaggtcgttatatgagttgcacctagaagacttcctgatctttggcacagggcgactggatgttttcttccttggagtagcctgttttggtagtttcttggttgtctctcggtctccaggcctcctggcggtatcatcggcttcgtcgtcacttagaaccagcttcttctttcgagaatctgactggccgattggatcagaagcacttggttgagtttcagaccgaattcttggtcctccgctcccttgcccagtttgatggcggggcgatcggcgttgagcgattgggggatccgacttcatcaaagcaaattcctgggtgtaatatccttcattgttaactgattcaacaagaaagcaagatcatattttgagaaaggttgaagtgtatgaatacgtaccagtggaggaggattgaatgcattgaacggtatgactggcagcaagtgagagtagctaacaacgatggcgtttgagaagatcttatacatcctttccttcatgaccttgaagtcaagagaatctggatcttcacggtttggatcatgcttgccgtcaaattcgaaggctgtgcgagatctttctttgattagagctaaccgacacttgataaagtgccgggtgatctgttttccttgaaggccctgatctttcagcttaatcatcctctcgatcagttctactgcttgtgcagcttcgtctcccattggcagtgaattccaagtatcccgataaactggaggaagacaggagtactcgggaagaacaggctcggggttttgaacataaaaccaatttgcgtgccagcctttatttgaggtcttgaagggcatggagaagtatttttggcttagtgttcccctgagttggaaaccagcacccccaacgacgcatggtttactcttgtttggttggggcttgaggaagaagatgcggcggaacaaggcgaaatgaggcctaatgcccagaaaagcttcgcaggcatgaataaagttggcaatatgcactatggagtttggattcagatgatgcaagctaatcccgtagaagttcagaattccccggaaaaatcttaaggttggaagagaaaatccgccgtagaagaaatgagcaaataccacgatttcgtgtgtatcgggtgttggaaatgcctcaccaaatgccggttgccacccgatgatctcttttgctggaagaacgccgtgcgccaccatctccttcagattgtcttccgtcacatcggagggcgcccactgactcttgaagctttctctttcttccgccatgaatgtgaactggatggtctgatttagttcgagatacggctggaaagggatggggaatttgagcggtggatacggggagaaatttcgtgaagattttgaggagggattggagcggattgatgaaccctagtttggccggcgcagttttgcactgtagcaggaaatggggaaaatggcgagagtctcggcggggaagacgaagagacgagtttcacttcggtattattagggtatcgggagtactaatgggcctgggcctgtacagtacttcagcccaatactataatcagcgtggcctgttgtgatccctagggacttaggcactttttgctttggcgatttgtgttcacaatggtgtggcccaatgctgttaaaatcctttttaacacgattcaataattcttgggaattattatgatgcacataaaaaggtgcccgacagaaaggtgttataccgtttttgtaagctttgttaggctgcaaaagctgtttgggttgatttgagatgactggtttattaatagtcattcttttagcatgttatatgcttattttggttatggtaagggtcacagcctaggctattggactcattaattaccatgattttctatcctgtttggtgggtcattttatgagattcttactcggattcctatcaaacatgtttatttttggacctttgagtgtttatcactcggcccttcttgtattttttgtccttgatatattcaagttgagaagcagtcggctgggtatcttactaagtaccattcgtgcttcgctataaaaccactcggttcttgactatatgtttagtttttcaactaatcacatactcgggggctacacctaattaggtgcatctactcgatgcaccatgttttattttcgcccttcacagtttttaatttttagcactcggcaagctggagcaagttgaattgaagcactcggactactgtttttttgtttcgagaaggctattttgtcaactgcgaaggtctcgggggctactgtggagattatggataccccatatctacatgacggttgtaatttagtcggatatacggtactaaatatagatggaatatctctatgaagattcgggttaggttctaaacttgtatgtcaaggaaatacccgggatcttagtcggttacgattgtattttatctataatcccatattctattaggatatggactgtattttgtaaagcggactcctttccctatataagagggtccgtgtgcctcttggggggcgattccttttccattttatacaatcaataacacactcggcggaatcatccccggataggagtagggtattacttcttgaataagaaggcctgaacctgtataaaatttcttatctccaaacccatccactttcctagcttgatagccacccccttttattattgtcgaaatcttgcttcgacaaaagtaattaaggccatcgcagaaatatattagtctagcccatgctacattaattgatcacgttggttttacccaacagcacggtatagataaatcataaatggtctatataattatatagattatatgtatgcttgttatctcgttatatttgttcagctaaaagatttctagaaccgccaatcgtaatattatagcatcactggcagaattgaaataattcacccccaaaattttgtttttggcttcttaatctgaaaataggaagtgaaaaaaataatctcttcaagaaaaaactttaatttaatttgaaaaactaaaagtgagctattctgttaaactaccaaaaaaggctcgcttcccctcgtatcagacaatttcagggtagggaactccaaaaatcatgcaaaagaataaagtatctggtgaagtagttttttttaaactaaaatccctcaaattggttttagaaataaaataggagtactgttggtgatattcttagataatatcccatcctaaaactccgaagctacatttatggacagatatactagctattaatattctcgtagccacctagagatgctaacctcctgaaacaatcctacgacatgatctggtattagcgacatatcactgcatcagtgctacatacagttccagcaaggaaatcccagaaccatttcttcacgatgcacttgcagaatccaacgaatcagcattcttacatctcgcagtacctcccaatcccatgcaaagatagttaccaacaattagggccaacaaatgaactgactaaaggaaagagttctgaacttaattgtgattgatcttctcgtctgctagctggtaatgatatgtctgccaatcacccgaatcagaaatcgatgcatctgattcaattggctaggctcagatatatctccaaaacttattcaggactcgagttgaatgcacagctaagcagtagcttaacacttgcagcatgcagtgatgggaaaataagaaaaataaaatgagacttgtaataataagggataggtgatcgggcaagaagagcagaaggtgtgtatctgtgggtagtgaatgttcagagcagagaagacagcaggtcaatgtcccacccccccccccccccgccccaaccaaaaaaaaggttttttttttcagaactttatatcaaggacaaactgcatgaagtattgaggatacggatccgtatcatatacaccatccggtcataaatacttaatatttagaacaaaatttgacttgaaattttacagctagcactcaagagttactaagaggtacccgtagctcctagtaccaaacacaacgagaggtaaaatgtggtacctccagaccgtaaaatctctcacttacaaactttgactatcaattttgtattagaatatctaataagtttttataccatgataatactttttcaaggcaaaactaagcatatatactatttttttcctttttaaaatgagcattagaaaaactaatgatagttaaagtttcaaaagttctgactctatatatcatgaccattgtataagaccaaaatgacaaatctgagctaattatttattcattcatttattttttgcaaaacgtaagcacaaaagaaagctaattaaacactgcgttggtcactacctgatcaatctcatatcaacatacatttctgagaggattttactgtgcttgagaggtacccaggtacctcctaaatgaattaatatgcacctttgatttcgaaaggataatctagaaacaacaaataatattaataatggtagcttagtaattccttaaacctcaattccccatctgttggctagcagcatcctatactaatatgatcactaacccaatccatctgtgtctaacccggaaaaatatatggtgcaaagtacatatgtagtggaaacctgaaaactaccgttggatcgaaaaatagacgtctgatatttgtctatgtcatcacgagtaaaaattttgctatgagtaaaattttaaccgtgacattgacgaatctcggacatctatttttgatccaacggtaatttt

SEQ ID NO: 75055 - DNA, 9678 bp, Oryza sativa
ttaatttctgctggtttgtttgcggcaatgaggctgacgacgcgttaatcattttgggtgacgttaccagctgacgtatgtgatcttcatcttgtgttccaagtttcaaaagcttcgctcgatcttgagcttttgatatatcgtggctctcaattagctcttgctgactggcagctctaaatcaacgagcacaagcttgttggctatagctcttatcctcttggcctcttggcgagcaaaatatatctaatcttagccgtttagtgataaaatcctttcaaaagtagtagatgtaaatcctcaatcaagaaaaagtaacgaaaattaacccaaaatcaaggcaaatcgatcgatttgtaggcaacgcaaaaacagatactccgctctaagtagtaggagaatcttctagtatagggcgtggagctagcatggaacaattcgaagaaattaatcaagaaaccggaaactaaccaattatgtaattaacaacaaaatccatcacaagaagagcaaaaaaaaaagctgcagaagcagcaaaagtaattcatataattggttgaggaattattagagaatactactcacatattgttgagtacccagctgcgcacggcgtgcctcgcctgatatgatccagcaaacgatccgccgccgccgccatcggaagcgagaacgacgacagagcaagaggtcgagctagcgtgcaaatggccgcagtgttgctggcacgcggcaatagtcgaggcggcggagtcaacctactaggtaggtagtgtggtctcaactctctctagggcagacgatagctgtggttgcagagctggtggtcgtggtgggcgagatagatgactaatttgcagctagccgcgcgtgtgggccgccgcgcgaccaccccgcgttttccatttcggcccaggtgacgccggaccgtgcgcctccactttccgtcttgggttttcttatttcagcccagctcgcgcgatcagttcagcccatctgtctaaattttgtatacatatggatataaactttgaatttataagtatacaaactttgcatatgtctttacattttttatacatcaaaagtatgcgtatacataaaatacactcacacacacatatacacgtatgatatgtgcatctgcttcctccgcacgccaccaccttaatttgctccctgtacagtgtcaccaccgctactcccttcgcacaagcaccgccccttctacctccgcgccgtcgctccctttatctctcgacatgtcagttgctttatctctcgacatgtcagttgctgcttctccctcaacgtgcctccatccttgctccctccgtatgtgtcgtcgctttcgctgctccctctgcgtgccgccacccctgctacctccgcacacactgcctccgcgccgctctctccgctcaccgccaccccttctcgctccgtgcgccaacggcaccgctccctcctcctgacctattcattgctacttctcccttcgcacacatcgttgtcgctcctactctctccacgtgtgccgccgcccccttctccctccacatgcaggtgacgtcgctccctcgttccccgcccgtccgctacaccagcctcccaatatgaaaggggatgagaagaaagttggagataggattgttgtgtactcatgggcattttggtacttttggctaataaatacatgctttttttttgtttttttatatacaaaaccttaacgtgtaatggaaacacggtcaaatgataacttcaattttaaaaaataggatcaaatgcaaacatgaaaatgtgaggttagattggtagaataaggtcaaataagcaattatcctaatttattattcttcttagagaaaggtacctgaactaatttaatggttcacttagcccactaaagttttttttttgccttatcttacccctaaactgttaaaaatgtttcactttgctccttaataacatgtacattttcttacccgtcatacaagttgcattttaagctaaaatgtaccagcggtattttaagctaaaatttgttaggagccatagatggcaccattaacgaagttcaaaagtattttcaaattttttttcatcgatgtttgcttgaacttaattttgatgtttgaatcactttcaacctaagtaaacagtgagaattctttttttacaaaaaatgttgaaacctaaattgtgaacgcatctatgttctaccaaatttccagagcaaaattgacttagatagagagagtaaaaaatactgctaggggggttcgaggtgtaaaatgagaaaaaaaagtttaggtggttaagtgctatgatgaaatggttacttttttttcttactctttattacgagccacctatcttgtcgtcatctagtccaccactgttctcacaaattaaggattattaaagcctattagaaacatatattgtttgtatggactttgggattaattagttagtaaacaaatgttaaaaaataatgtaaggttatactctctccgtcccaaaatataataagtggctattaaggagagaggtaaaagaataatgcatggttgcctctccttgggatgaatggagtatagccgtataggcctggacaaattggggctataacaaagggataatatggttaatttagtggtaaaagtcacattttataatactgggttgctttatttgggataaggtttaaactattttatgatgcaaggagcagtatttttccaatgccctagctaagctagggcctattctttttagatgacgcagcatattctgataatataagataacttacttataacaatgaattaaatattacattatagagttaacaaatagcttcaaaaagttaccaagcaaggctaatgaataattatttttctggagcattgtactttgaagcatggcaccaataatgatgtattgataatcagccccagttaattagctcattccaacagggcagtcattcagagccacaggcaaatcttcccaaaatataagaccatgaaacgtcaggacaacaacaatgaaggaatagaagtaaaaggaaaaaaaaaaggatcgatatttgaaccttggagccctagactttaattagtaatccatataagagctaagtgtataggttgacaaggaattaaaatacttaaaaagaaacatacaaaatatgtgaaaaaacaaatttccaaaaactatgtcgaattcaagctgggagtgctaaaattgacaaaaatggttcctaaacttcctatcgtccgttcgacaagaagcccaaatcccaaacgctttaactaggcgggtctcaccgaatctttatctactcaccaaacaccatcaacacatatatttctccaccacacactccaatcttatcccatctctcccttatctctctccactacaacactacctcatcacgagcagcgacagggctcttgtcctcgacggctatctccttagcttactcaagggcagcttggtcagcctcggcttcctcaacgacaacgtggcataacatcagcggtcacttgttcccaacagctacgcgatgagcttgaacttggcttccacaatgatccatgctttcatcaagtgtggcgccgcataattgcagcatactagtgtcgagttcggcgacagtcagtcactggagaggagaaataagtactttagactgtttttttttatgtttcagccaatatgtttttgatgttcctttgtattggatcaaaatcttgcagtgaggttttttgtattgtttcatattctgtccttgaagagtgagattcgtggatgtttcaaacgctacactaaaatgttttaccatatgattcaattatgtttcaccaaaatacacaatgattatagcactttgcctttgcttaagcattggagtatttatgtactccctaccattgcatgtggctgcaaggtcagtaatcacagtaacctactctactagaaaatgcatttttcccgacgtggaggtcttattttcacagtcggacatgactcttggagccaaatgaccgtctaaaaaaaatataaatcggcatgacgttcgctgtccgcctgcgaaaatctattttcgcacgcgcctctattttcacaggcacaccttatgtggtctgcctgcagaaatagtacctaccaaaaaaatctagtcatcctcatccgtatcctctcctccaccatccttatcctctcctctccaccactcgtttcccttccccttctctctctctctctctcccccacacttagaagaatcgcccggctccctcctctcccacgtccacgcgccgccgcctccctcctcgacgacgacgacgaccgcgacgccgccgacggctccatccactctagatccgcgtgctgccggctccctcctctcccacgtccgcgccgctggctccctccaggacgacatttgcgcgccgccgcatccctcctcaccgccggtggcctccctcctcgacgacgatgacgacgactgcgacgacgccgacggctccctcctctcccacgtccgcgccgccggcgccctccatgacgacgtccgcgcgctgccgcatccctcctcgccgccggcggcctccctcctcgacgacgacgacgaccgcgacgccgccgacagctccctccgctctagatccgcgcgccgccgacagctccctccgctctagatccgcgcgccgccagctctctcctctcccacgtccgcgtcgccggctccctccacgacgacgtccgcacgccgccgcatccctccgccgctggccacgacgagcgacgacgacggctccagatccgcgcgccgccggcttccctcctcgccgcctccgccggccacttcctctcctcccctccgtccgctgccgtcggcgcccgtggtgaggccggcggcggcgccccatggttttttttattttcctgagatgattttcacagccgggctgtggcccgcctgcgaaaatggtctattttcacagtcgagatggtagcggcggtcctctcctccgcctgcgaaaatggttttggaccgcctggaaaaatcttttttctagtagtgctaatctactgctgcatggacggtggagcccgggcaactgcccgtggtggccaggtcctggctccgccaacataacacaagctttttttttttcttttttcgcgatcgatcacacatgaaaattgaaaaggcagaattatgcatttttcatattagttttgttaacgtaaatctatgcaatttgatccctgttgccagctatttctgaaaggattccatggttataatcatgaaaatgatcctgcactggtccatactttttttctttggtctcaatcctgcacaatagtttctttacagagttttcctcctgacaaaagaaaatgatatataaaactggcacaatttattgacatttgcatcataattggttagtgccctaatggcaagtgttctactcaagggactgtcctgagtattaacttaagaaactctgaagttgccatcgattgcaactgttcatagtgaccacattcttaagttaatacatcatgagtttgttatatttctttccacttctctatatgtataaaaaaaatagtgttctctgaccatgcttttttgcgattatctgacaatatataaacaatgtaatgttttctgaagacatttgtatctctgtatccctctcccccatcctttttgttctgtggggtggatggatgggcctatcaaaaggttgttccattatcatttgaatgcacctataataagaactaacaattggcaaacaacagttttccttcagaactagggactgttgtttcaatccaaaaatagtcatagttttactgccatgtctcttatagcttttgctgctgtgcgactagcccatcatgatgatctgacttacaatgcttgtgtctcttgctcttgatctccttctatcagtcactctaggtgcagctaatttctgttcgtctcctgacatttctagggatgcaagatatcgaagatcgatggaaattgctgccgcctacaaggtgcaagaaatcatcacatccggcatttaagtgtgtgaaagactggttctgatttttttttttgctttgttgtgtttcttctctgtgccatagctagaagctagactgaaaacaactatggtatttttaggcttttttatcttagtgaattcatgtaaaaatatttagttatggttctatccagtttttgatggttgttcttgaagggtactagttactatttttagcaggagtgccataggagctaatttagctaaacttgttgcatcggttaataacaccatcgaatatttcatttgccaaccttttgtagacctgaattttgaaaaccaattagaaagtagacacgggctataatgagcgcctcttggcgcgctaattttttaagtatatcagtgcattcacatagtactcgatttttttaaataaatgttttgattcgtgcatgaatcactgttttgcagccataccacaagctgacttaaaaattgcaaattgctgaaaggtacaatcgtataagaaacaaaatgattttcacatcacttcgcaaactacattttttccctacaaccaccggaactcaatatagttcctacgcagcttcatcattcataacagaacaactagcaagttcaattcaatttaaagagatcgaatggtgattcacactctaaagcaaacttagactaaaaattaatagtatctttaaagattaaccttaagggtaaaaaaatctgcaatccctgcaaacaataatgcttgcttcaatatggtatacttagtcatatacatggacattctccaataaaacattttgttttttttgacgcaaataataaaacattttgtaatctacagctcataactcaaaccatattgaccatctcatgaaaagtcacattacacatcacaaattaattccagccacaacttttagttcatgtgctcacctattggatttgcatgaaaggggcagggctgagtagcaaattgacgcacagtaacagcagatgcagatccagtagagtgaagggagcaggattttagtgggaatcaactttcgtaactgtggcatttggggagttcatataattctaaactaacatggtaggttgtctgtagctcatatacaaataatctgcacccaaaccagtgccaaaatatacgaacaaatgcagaaattcgcttaggcaatactgcaaacaccttaagtgcgcaaaaaactgaagtaaatttaaacgatgtaaatggagaggaatgaacctgcagatgtcacagtgttcagtgcagatgtcgatggtggcaccgcgatgggcagaaggcgggcgggccgcagggcgctcgacggcggcgagtctctcccacgagctaggtcaccgggcggcgctacggcgcatcgatgggcaatgccgcagcgggcgacggtcggccgtcgacaaaatgcctccaaatgctgtacatcctgtagtgtctgaggatggtaggtgggtttggccaccaaccaggcaaaaccacacaattcccccatccttggccttgcgcttgcgcattagggtgagccaaaaagaaattaaaaaaaaaaacaactgaggtttctttccctcaacacataaatacccgacaatgccctagccgctcgacgttcataccgcagcatagagcacacgcttggtgtcgcggcggcggattgatggcagggaagacggatatcatccgcgatatcatcggcggctgggtggtggacgagacgtgcgtatatatttttgtctactactacattccctgattacagaattttctgtgttggagttagttttcttcttcttcttcttcttcttcttcttcttcttccaggtttggttttgctcttgtgattgatgggatttccgaggtacatcggtttccggtttccgagtaatcgctctactattttaggtcgactacgatcttggggataattacattgcttccttttttcttgatgatagagggtctatgtgaatgctgctatactatgaatatgattaacgtggacaacggctgatggatttgattcgatgcgagcggccgttgacatgtgggccccactccaacaatgactaaggttgctcattttggcccaggtcatcgtgaggcccattaagcccatctgcccacgttgtgatgcccagatgccctagttgcaaccgccgccgccgccatctctgcggcggtgtccggattcttcttcttcttcttcttccctcgtcatccgggaacgcggcgaggaggcggcctggctacaggacgtcttcttcttccctctcgtcttccccctcttctccaaccttctcttcacgggccaaaaaaaatctttggtaattggtacggtccgccatgcgggcggtgccttgtcgagctcggaagacggcatgagtgctgtaatattggttggattcagttatgaaattaagtagtactgaataatgagattcgggttggatcaaatttattcgaacgggatcggttttgttcttttgtttttggaaagaaccgaatagtttctttttaactatttcctcattttaaagaacggtattatgcgattcaaatcaaatctacgcaagtcaaaatttcaacaaccagttgcgtcaacatgctttttgtctggttaaaagaactgaaagtacgtactatgctttttctctgctttgatgtgtgatcttagtccttttgttcctttcttgttattctctgaatttctcctgtccgtattctaaattggaaaattgcattgatcatgagcagtttgcgttgtgtgtcacaaaatcatgaggattcaattaattacttgttcatgagggtggtgtatatgccattgtgatttagctttctgaggattcaattaatctctcatttaggggataagaggatagattctgaaaatatataagatggcacctggatgtcattgtgatttagcttttaattaatctctcatttaggggataagtggatagattctggaaatatataagatgacaccttgatgtcattgtgaagctttaacattttttttaaggtatttagcttttacttcgatctgaatttctaaacccaccatttttttcgtttgtgttcaaccagagatgcggcattggctggacttcgtgtggcagagcgtgcctattggaaggaatttgtggacagagtattgaaagataccagcagcattgatataactgcgtcaaatatagctgttcccacaaggctacctgtcgagctgcaagtcctgatcaaggttatgatccaccagattcttaacactcagcctggagcaatccctccactagcatttcattggtgttgcaatcagcttcttcagcatttggtgaattcagtaagaacccaaggacagccaactgttgaaccaaatgtacatggacatcaacgttgcaggggtgcaggttggtcatcggggattcccgaacgattggccgatcgaaatgtttcagaagatggaggtattggaggagttgattcgaggaggaacattagagagatgaatggtaaaattaaagagacaaatgcaagtcgtgagtcaccccgaat

SEQ ID NO: 75056 - DNA, 17936 bp, Oryza sativa
ctgcacccacgttgcatccgcccctgcatccacgaatctcactcttcaaagacatagaatatgaaaaaaaaaactcactgcaagattctgatccaataccaaggaacatcgaaaacatattggctgaagcataaaaaaaaagtctgaactacttatttctcctctccagtaacagaccgacgccagaatcgatactagtttggtacaaccatgcggcgccacacttgatgaaagcaaggatcatcgtggatgccaagttcaagctcgtcgtgttgccgttgtaaacaagtggccgctgatgttgtgacacgttgtcattgaggaagccgaggctgaccgagctgcccttgagtaagctaaggagattatcatcgaggacaagagccccgtcgctgctcgtgatgaggtagtgttgtagtggagagagataagggagagagagagaggatacgattggagtgtggtgtggagaaatagatgggttgatggtgtttggtgagtagataaagatgaaggagaaggattcggtgggacccacctagttgaagcatttgggatttgggcttctcgttaaacggacgataggaaccatttttgtcaattttagcactatcaacttgaattcgacatagtttttggaaatttgttttttcacatattttttatgtttctttttaagtattttaattccttctcaacctatacacttagctcttatatggattactaataaagtctagggctccaaggttcaaatatcgatcctttttttccttttacttctattccttcattgttgttgtcctgacgtttcatggtcttatattttgggaagatttgcctgtggctctgaatgactgccctgttggaatgagctaaccggggcaaattatcaatacatcattattggtcccatgcttcaaagtacaatactccggaaaaataattattcattagccttgcttggtaactttttgaagctgtttgttaactctataatgtaatatttaattcattgttataagtaaattatcttatattatcagaatatgctgcgtcatctaaaaataataggccctagcttagctagggcattggaaaaacactgctccttgcatcataaaatagttcaaactttatcccaaataaagcaacccagtattataaaatgtgacttttaccactaaatcaaccatattaattatcccaagaagaggcaaccatgcattattcttttacctctctccctaatagccacttattatattttgggacagagggagtataaaataaccttacattattattatttttgaacatttgtttactaactaattaatcccaaagtccatacaaacaatatatgtttctaataggctttaataatccttaatttgtgagaacagtggtggactagatgacgataagataggtggctcgtaataaagagtaagaaaaaaagtaactatttcatcatagcacttaaccacctaaacttttttttttctcattttacacctcgaaccccctagcagtattttttattctctctatctaagtcaattttgctctggaaatttggtagaacatagatgcgttcacaatttaggtttcaacatttttttttaaaaaagaattatcactgtttacttaggttgaaagcacataaaacagattcaaacatcaaaattaagttcaagcaaaaatcggttgaaaaaaatttgaaaatacttttgaacttcgttaatggtgccatctatggcttctaacaaatttcagcttaaaatactgcttgtaaattttagcttaaaatacaacttgtatgacgggtaagaaaatgtatatgttattaagcactaaagtgaaacatttttaacggtttaggggtaaactaccaatctaacttcactttttcaagtttgcatttgatcctatttttcaaaattgacgttgttgtttggccgtgtttccattacacattaaggttttgtcttaaaaaaaagcatgcatttattagccaaaagtaccaaaatgcccatgagtacacaacaatcctatctctaactttcttctcatcccctttcatatcaggaggctggcgtagtggacgggcggggaacgagggagcgacgtcacctgcatgtggagggagaagagggcggcggcacacgtggagggagtaggggcgacgacgatgtgtgtgaagggagaagcagcaatgaactggtcaggagaaggagggagcgacgtcaccggcgcgcggagatagaaggggcggcgctcgtgcgaagggagcagcggtggtgacactgcgcacagagggagcaaattaaggtggtggcgtgcggaggaagcagatgcacatatcatacgtgtatatgtgtgtgtgagtgtattttatatatacgcatacttttgatgtataaaaaatgtaaacacgtatgcaaagtttgtatatttagagattcaaaaagtttatataagtatgtatataaaatttagacagatgggctgaactgatctcgcgggctgggctgaaaaaagaaaacccaagacggaaagtggacgcgcgcggtctggcgtcacctgggccgaaatggaaaacgcggggtggtggtcgcgcggctagctgcaaattagctatctcgcccaccacgaccagctctgcaatgtaaccacagctatcgtctgccctagagagagttgagaccacgctgcctagtaggttgactccgccgcctcgaccagcaacgctgccgccatttgcacacgctagctcgacctcttgctctgttgtcgtcgttctcgcttccgatggcggctgcaggcggcggatcgttgctggatcagtcgaggcacgccatgcgcagctgggtactcaagaatatgtgagtagtatttctctaataatccctcatccaattatgtgaattacttttgctgcttctgcagctttttttcccgctgttcttgtgatgaattttgttgttgcataattattggtttctttccagtttcttgattaattccttcgaattgttccatgctagctccacgccctatactagaagattctcctactacttagagcggagtatctgtttttgcgttgcctacaaatcgatcgatttgccttgattttgggttaattttcgttactttttcttgattgaggatttacatctactacttttgaaaggatttttatcactaaacggctaagattagatatattttgctcgccaggagggtagttaagagctatagccaacaagcttgtgctcgttgatttagagctgccagcaagagctaattgatcaaaagctcaagatcgagcgaggcttttgaaacttggaacgcaagatgtagatcacatacctcagctggtaacgtcacccaaaatgattaacgcgtcagcctcattgctgcaaacaaattaaaccagcagaaattaatcaagcttgtgctcgtggacggccggatcgcagtgaagcaggaacgcttcgatcggacggtgcatgttgcggcatagctagcaagctcgcgcgatcggtgggatgagaagaacgcgtagtaggttaccaaacactacggctttctagttttatacatataataatgattctctctcggctgcatcgtcttagtactagctattttcttctttcctctccttcctatgcataataaaaaaaaaactgttatgcctatgaatattactggcatgtgatcagtaggtgggggcttttcataaaagtttagcaaggacagagatttattataattaatgctatactactatgtgtgttaacataatcgtaaaatttgtgatgctatgtgtactgtagaacgcgcgctaaaagaatatgaaagctgaattagatatgtggtttgacttggaaaaagaaccagaatcggtgtttggcttggctcttggaaaaagccatgtcaaacattcatgcagctaaattgaactgctcttgactgaactgttaaagttgcatgatttatgttgcggtacaagggtgcgagagaggtttgattctcattgattgtaatgttcaatttatataaggggatacggtcggtaccgcaggggcgcaaacagtggctgagctaggaaattttcaaaccagggcaaactacttagctaaattgaactgctcttgattgattattaatgtttagctaggaaaaagctcggagtatctagtatttgctaaaatatttctaactttaatcctttcaaaataataaaaattcaatggtgtatttgatggcgagcctgggcggctgcccgtgcaagcctggtggtggccccgcttctgggtgcaaagtgcaatccatcgtgccagttgtcaagaagtgccgaaggagagaaggggcgtggccgcctcatttccttctctaccggttgtggtaatggggggcatggccaaccgcaatgcctattccatcggatggatgagatcatacatatatatttctcaacaatttcgttgtcaactactttaaattaaacaaaaataatgctttcctccgggtgtctaatgtggacacagaaatcaaattgctgtcacccatccatgcctttcccgttcagtatttcataagcaagtaaaattttcaacatggactcacgtgccttctttccgtttcatcttttggtgaatttctgtttttcagacttcggatttatcggcggatcagtacacatagccgcagtttaagatagatggtgatggtgaagttgtatgtgtatgactttacccattagagttcaaatctaatgtccatgaatactatgcaaatgcaggtcgacttttagcatggttatagtaagatcagaaatataccgctgatttccgtttatgtcttttaagcgtgtgttagaggcacattcgtctaagtgtgtagtgatgtagtttgcatgtgcattgttgtgtaataataaaataaaataaaattgaaatgagcagtttagaataagaggtagtttattgaaaaatcatatacttttaatcgcagaaaaacatatttttttagaagtgtcaaataaatactccatccgtcctaaaataactcaacctaggatagaaacctaggataggatgtccgtatccacgtacatccggacattcccatcccatccccttctcctctcatcttgtttctcaagctacaattaatggtggatcctagcgggcgcgctctctctctctgggtcatgaatcttctgatagaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgctaatagaacgctctgttttccgtgtgtgggttatgggttcccaacacccaccactgaacacaacctaaatgttccctactacataaaagcacgtacagaccggcactataggtgccgtggaagtgctaaaactggcacctatagatctttttcacctctgcaagctgaaaacacaaaaaaaaccgataccaatatatagttgctagataattaaagaaccgacacttataatatattataggtgcgtataaaaactgagcagagctaagctgttggtccttatcctcttgaggcagataaggggaggaggactcggtctctccccggtctcctctctctcccggtctctctctcgctctcctctctctgtctctctctctatctatcgatctctctctttgtcgcttaaagtcaacaaatagttgcatcaaaagctttaattttgtctgctttgatgtatgatctcagtcctttacttccttctggattgcttcagtacttcctttgaaattggaaaattgcattgagcgtgtgtggtgatacattctgtgtgtaacaaaatcacgtgtttatgaggaatcatttaattacttgttcatcaggcaggtatagacatagtaggaacaggttctggaaacatatacatgacactaggtaggatctcattgtggcatcaattttttttgtcgacatttatctgaatttctgaaccctattctttttgttcaatcagagagaaattggcaggacattatggtgcagagttcaactctttgcgggcatttgaggacagggtattcaatgagaccagcagcattgatgattatatttctaaaatatcaacgaagatggctattttggagcgaccgcagtcttcttcaggtatgcagcatcaagggcagatgggaaatcaaacgaggctgcctactacagttatgcaagaacagccacagccacagcagcagccgcatttgatgtcaaataatcatcaccaaacacatggaggatggcagagcaatgttgcaagggtacagatgatcactggtgttggagaagtgaattggagggaggaaatgtttcagaagatcagcgttttaaagaactctttcttttccgagcttacggattttgaccgtttacttcacaattgcaaaaaacagaagaacagttgcagtcactacctaaaaagcaagctgaccaatacaagcggataacaaagctcaaggatgcggttaggagtgctctggatttattgcagctccagaagagcagcatcgatgaaggcatgaaggtgaaattctgcaagtacgaaagctccatacatagcctactcagattctacagggaaacaaaagctaaaattaatgagatgaatgcaaatcgtcataacaatcagcaagagcaacctgcaggcctgccgaggcaaagaattactgacagaactccatcgtcagctcgtcggcaaaaccgcaatgacaacgtgataggccaatcagaggataaattgcgatgcagggttgaatcagttgtagccaagaagaagcccatcgaccgcctaatcaacgctctgcggcacagtgtagaggatgaccgtacggacgtcaagaggcagaaaacacggcatgttaacagtgccctggcgaacgagatcgacgccatgaacgccaagctgatcgataccgtggttagaatcgccggtgagaaagatggtgggacagagattgaattcagctacactgcagtgtctcttgcactagacatgaagcagctatttgcagcatatgggacgtctcctgtcaagccggtgaaactattcgtccctgctgattaccctcgaagttctccggtggtctcgaacaacaacgatgatggagatgaacagcggcgaggaatgttcggcgagatctcgggcatggtcagtgcggcttttcactgcgcgctgcgtgagctcccgccgtccatgtcagtcaagcagatggcctcggagtggaattcctgcgtgcagatgatcatgaagaaatttgcgatacggcacggtggaggaacgttcagctccaggcatggccagtggatggattgcaccgttgaatgatttagtaccgtgaggtaccgatacctcgagatactttttgttgtaccgaagcaaatctcttaattattacatgaggatgaagtgatacggagaaccgtatttgatctgttgttattgctgctggagggtacatgcataatccgctctgtgtatcatttgttttgattaagctggtattgcttttgatatttctctgtctggattttgtaattggaacaagcaaaatcgcttgtaggacatgtatttctgaaaatggtaactatctatctttgaagagcccaacaaagcatttagagttttattggcaaacaataggttgagctcgcaggcttatgcaatggtggccaaacagttcaattcctaccatatatttccttctgaaacttttaccggaactgaactgttttagctgaaagcaacaacatgggacgtctgcaatgcagacaatcaactaatcaactaattaagcgaattttgcatgtgttcaaaataccggaaagattttgtgaggagtatgaacagatggtgagaaatttttggtagggacatgataaaggagaacggaaggtacactcgattggttgggaaaagttaatgagtcccaaactattccgaggacttggttttcgggacattagatgctttaaccaagccttactagcaacgcaggcatggagactgttcgataatccagataatttatgtgcttgggtgctaaaggtgaagtactatccaaatggatcactaattgacacggccttcccttcaagttcatcgccgacttggaagggcatcgagtatggactagagttgttgaagaaagacttgatatggatagttggagatgggcaccaaattaaaatctagaggagtcaatgggttgcacatagggaaaacccagtgattctgtagaagaaggcctggaatcgtctcacgtatgtacatgagctcatgttgccggaaaccaaaacgtggaatcagcctttaatcagacatgtgtcacgcccagaaattcactagtaatttccgaactaatttgtgcattaaatcctcgtccaggaatcagccaaggtacacaaactgacaatttaatatacagattcatcaaattaactaaaacgataaatacttacttaagaggcacttagttctcaccatgaagaaaactgcagcggaaaataaaatctagcgaagctccggctccactcccacaggcagctcaactggggtatgagccaaacgtcttctccttctgaatcctttttcttcaactgaggtttgatggttattgcaaggtgagcatatgacatactcagcaagccacacaacaaatatgcaagtgcacaaggataccaaagaatggtataatatagggcttatttgcaaaagcagcatttagcaaacttttgagaattgtaaaacagtagagcaattaatcatcaatattaatcaacactgtacaacacacccatgctgcacaggcccaaccatcctgaacaaccatacccggctgtacagatctatctccaaaccaggaatgtaccattccaaaccaggagctaatcaaattattatcagttatagcatcttttattatggtgagaagtgtgagactaatcacgaaagacattgttagacccgcccataactgcgggcacggctattcgaatagttttactctggccagaggtgtaccactgtacccacaagacacagccccacgacatgtcaccatgcgcctcaataccaccacggtacctcggaaaggagctgtgacagtacccctcgcacaacacaatccaccacagtgcaccgttcctggatcataatcacccccttataaacaaggtatggactccccagcgacccccgtgggcttatctccgccacttctcagtctagtgctccgcaatgaaccatgctatataaaaggtaaagccgttgcccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatataaggtccatgctagtcaaattataacccataggaaaataaagtcatctttggccataattaaatgggaaaggctcaccacccaatgacattcgaaaacaatgcataagttgaaataaatcaatagctttaaacaggttcaacatgctcaaagggttgtttgggggatctgtgtgacttgccttacaaacaagcgtcttcaattcgtcttcaggaacttctccaacgaacgaacgatcctccgaaacaacgggaagtctaaacctaaaacgcaaaacaaggaaaaacactaataaaaaccaaatgaacagtacaattaaagttcataagggtagagtttgaatttagatgaattatgagacttgaacgacctcattccgagttcgtatgaattagatatgaattttacaagatttaattccaattaaacctattaaagaaaagactattccaaattgattaaacaatttacaaatgatttatagctgagacagaagattaaaacatcctccggaaaaagattagatcatatttagtagatgacatatattaaaaaggaataatatgtcattgaaaagagatgacaaatttatattaattttggatggtcaagatggcgctgatgccagcgatgacatggctgccatgcaggatcgacgaccgcaagcacgggaacggcagttaccagcgaaccacggtacaaagatgcaaacgaagggcaccgggagagagaggagatcaaggcgacccttaccaccacttacgcgacacagacggcgagggagatggcaggcgacgaggcggcgaccttgggttgacgatggcgacggctttccggcgacgagaggcagcaaccgaagggcggacggtcttcacctcggtcctgcgatcccgagggtggtgacggtgagtgaaggcggcgatggacggcgacgaacggcgcggctgaagatggaacagatcggcttcacggtgacgacgggcttcccggggtcttcgacgatggggaagtggaggccggtcttcttctcctcgcaaactcaacggcggcagcggcgaccgaaggcgacgaccacagcgacggcgcggggctgctggagcggcggccggaggtggagagagaaggcgagcgcggggagagcgattccggcgagattcggcgcaagggaacgggtggccggggtagctctcacccttgcgaagccgagggaggcgacggcgcaggtcggggtcgaccgaggaggcggcgcgacgcggctggagggtcaccggcgtcggcggcggctagggcaaggcggcggcggcgctacaagcgacggctcggcttgggacttgaggcaaacggaagaggaggccgaggggatgctatttatagccggaagagggagagatcggctcgggaacggatggaatcggcgacggattaggtagggttcgccggaaaaaggaaggatttgatccgcgaaattggaaagaatttccatataaacttttggggatttcttgggggaaatgaagaggagattgagaggattccattcccacaactaatttggaaataggagcaacggagaggacgaatttgatggggaggcggcgctgtacacgggcacggcagggaggatatcggccggctggaggttaggggcgacactgtagcagagggggacaaaacagacttatttccgggcttcatttcctcggcccgattgaaggaggaaggcaaatagaacttcgtcagagagaggaagagaagatgcaggctcgggttgggccggcggaagagagaggaaggaagggaatgggccggattcggcccgagacaaagaagtggattttgattgactttttaatttaaataattgctgaaatgatgtttcatttattaaaaatacttataatgctcaaataattccgggaaaaatccagaaaatatttggacactaaaaatatttaataaagttttatctatatcaatttaatgttcaaaattttcatatattttattcaaacacttactttaattattaaataaattctaaaaattcctttttttacaacaatttataatatagcgattttcagggtgtgacatagtccaggaaaatgatgcatccgaaattctgaagatcaaaatacctggaagggagatgtcggactttccagcatggcatcttgagaagacaggaattttcactgtcaggagcgcctataggttagcatggaatcaatcagggaaggctcgtgtggaatcttcatctagcacggcgacaaatggtgaaaggaagctttggaagaatatatggcaaacaaatgctcaaccaaaagtgagaatttttgcatggaagctagccaggacagattgcccacttggggaaataagggcctgtttaattcgcgaaaagaaaatttttgggtgtcacatcagacgtttgaccggatatcggaaggggttttcggacacgaataaaaaaactaatttcataactcgcgtggaaatcacaagacgaatcttttgagcctaattaattcgtcattagcacatgtgggttgctatagcacttatggcaaatcatgggctaattagactcaaaagattcgtctcgcgatttcccccctaactgtgcaattagttttttaaaaaatctatatttaatgcttcatgcatgtatccaaagattcgatgtgatgtttttgggaaaaactttttgggaaccaggattcttgtggttccggggaatccagctacaggagaaccaggaacggggagctctcccctgccctaagagaaagagaaagatagaacagagtggcatatgcccgatctgcgggatggctgaagagaacgggtttcatgtacggtggagtgcactctagctagaggtttacgggaggcaatgagaacacattggctattgccggttgaaacgagttttgcatatacagggccggactggctgttagtgctgctggatagttcgcagtgttcagaaaaggcacatgttatgtatttactctggagagtttggcacctgcgaaacaacatgatccatggcaaaggaagtgcatcaattgctgatttggtcagtttcttggttagctatgaaggccaactgttgccaatccgacaacaagaagatgaccacaaaggaaagggccctatatacatggaaccgaaccagatatctctctctacaagtatcagcaaactgactgacaaatggtgtccaccgccggagcgcttcgctaaactgaatgttgacgcaggttatagggaagaaaccggggatgctagtgtcgggtttatatttagagattgcaggggtttggtgctattggcggcccaaagaaccctgcatcaatgtggctcagctgtctaggcattggcgctagcatatatcttgagggactcagagcggcgactgacttgattcacatgcccattgtgttggagatggacaatgcataaattgttagggatttaataagaaaggaacagctgaaatcggcctgggcgacgacaattgaagatattaaaggagtgatgcaaagtgcaagtgcacaagataaagagagaagcaaatagggtagcacatgttttagcacaaatggctgtcttgagggactcagagcggcgactgacttgattcacatgcccattgtgttggagatggacaatgcagaaattgttagagatttaataagagaggaacagctgaaatcggcctgggcgacgacgattgaagagattaaaggagtgatgcaaagtgcaagacttgattcatatgcccattgtgttggagatggacaatgcagaaattgttagagatttagtaagacaggaacagctgaaatcggcctgggcgacgatgattgaagagattaaatgagtgatgcaaagtgcaagtacacaagataaagagagaagcaaatagggtagcacatgttttagcacaaatgacaatgagttgtaggtcctacgcggagtggaggttgtgtgctcccgcaagaattctagacttattaaatcaggagtgtaatcccttatttaagcattaataaagctctctttaccctcatttttttttgcatgtgctagaatcgatcgcagaatgaatacgaaaatgcgtgtgccatattccgttctactccagttgggttgaggccatggcttgcgtacatggtggatttgtgggcttctcgttctgggccagaggaaacgagggacccaacataagaatataacaggctgtgggctcgtgggctcaattttaatacttcccagctagcattcgacaccgtttttggatttttagttttccaaatttatttctgtttgttttaatactttgtcaagcaatcaagttataataataaaatataatgatttttttttaaaaaaacagtcaagataggtttgtacttacacttagctcttatatggtttattaactaattgagtgaaatatagtttgggccatttttatggttgaagattcactttggacctccttttaaggtaacattttcactttgcaccattttaaggccctgtttagagtctaacttttttttccaaacttctaacttttccgtcacatcgaactttcctaaacacacaaacttccaacttttccgtcacatcatttcaatttcttcaaactttcaattttggcgtggaactaaacacatcctaactctattttcttttagccacatacaacttcgtctctggtaaagaagtagattgaacacaagtgtgagagattgccagcatgtggatgtaagtgcgcttgaggctgttgatgtgcttgagaaaagagttgttgtggttcaaactgtaataaaggtagatttatctagtccgaagtaaaaatattagataaagatagttcaacgtaaaacattggcaataaaagttagtccgatccaaaccacagttttaggcatttgatttcaagcttcaaattgtgctcgaatttttttatagttttttatggattttttttgagaaagagagcgtaagctccccatttcattaacaaaatgcaaattaccacatgttcagtacagagttcagaaaactaaaaagaaagaaaaacttgaaatatataatatataacatttcattaactaaagttcagagttttttatggaatatataatatattatgagtccctaatatggatttgacaccaacctctttaaatttagttttaattttcttcattcattgtcacgacgttccaaggtcttatttaatctggaagaagtggaaaatttggctcgtcgatcgtagctcaaaataaccatggttagcattcgaatacgactacaaaataaacatgacatacttttcaaaaaaaataaattgtgaagcccatacactagaacaggatcgcttatctgtgacgggctgaaagcatcatcactatcgggtaaggcccccgtcaatgggcaaaggtcactgatgtgaggaaaaatctcaatcgggcaaaagcccgtcacggatggatgttatctcaatcgggccgaaaacaaagcccgtcacagatgagtatgaccagtcaaaccagcgtagtaagaagcctgtcacggatgactaatctcaatcgggcacaccactaagcccgtgacggatgagtagtcatctccatcgggcatttagccagagcccgtcactgataggtttgacgccacgtgttgagtcaaactagtcccggttcggacgacttatctctatcgggtgtattctaaaagcccgtcacggatgactaatctctaacgggctggactctatagcccgtcacggatgagttatctctttcgggcattagctaaatgcccgtcagggatgagtttagaaccaaaaaaaaaataaaatttgtctttttggctagcctcagacctttgctagccatgcccgctgcaaaaatgacagaagcatatatatatacatagtcccattcccagcaaccccattcccagcatcaattcacatattccatcacagccatttcatatagacccattaccagcatcacatcagccaattcacattcatattccatcacagcacagtcaattcacaaaatcaagcacatatacattcacatccacaacccattcacatatatgtcattcacatccatttttctctccaaaccgccgacatgcatcaaaacctgcaaaaataagttataaattggaacaattttatatgtaactagaaatgcaagtatatacagagacgagctacctaggactttactctaaagaatataattgtattacaaagaatatttacaaaaatcaaatgtttgtcgcatatgcattgcaaatgttctgccattctgagacgagctacctaggacttcactctaaacatccctttcggtgacaagatatcatctagtatgaattgtgctatctcctctctaatgatttcgaagttgatttctggaatccttgaaataaattcctgcatgttcggcgccaagttagtctacatacttgtaaatttgtcgtcctatgtgtatataaacaattgaattacacaccttagggtcgagcaatgtcaccttgtctgcgaagctcctcatgttatggcagacatggaacccacactggttgctaacttgttgacatattgggaagtctttcttgtgaccgagtttgggatgcccatccttatgcctcccgcctcttgccacgtattggtcccatgcctcgttcaaggaagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactgttgattgtaggcgcacataatgaagtccttgtcttgacgggcaaataagcagtccttgatataggtcaccatgtttgctcgatcatttttcagcgttgtcacgttgacgacagctggatcgagtaaggcaatatggggtgctttacgatggacatgcttccaggttaacctacaagcaagacatgagtcagggtaagcgtaatttatggacagtcgctaccatatcgcgtaccaagaaatacttacaaggagtagcacttaaggaggttggtgtcgatcgctcgcaccctatagaggtcccatagatctttgaagtctacggcgatgaaggcagtaggcccgaggaacggctgaccatcgtgctggcccaacatggaggtctctctattcttcctccttgcattggacttctccctgtagtacctgtgcaactccttgcatgcagggcccatcttgaataaggcatcgtctccgaccaatggcatgcccaatgtgaattctgctggaggctttggaggagctactggtgccttgccaagatcaagcttctttggggctaatggcacctttatttttcctctccccgttccagcagcttttctgcgtgtgtcaagcttgggtggagaagatttcgccctcttgctccttttcgcagaaggggggaggtgcggcctgctgtcaacctccataccgtcgtcccaaaaatcagtatcatactgtaattggagatcttcatctctttgttcaacggcaggagggagagatacaacagtttgatggggatgcgtcggcggcggacgagaacttggcgctggccttggagttatattgatctcaatgttgtgcttgggccattgaataaaggtcccacgtgcagccccaagggtcagaatctcgtcattaggtgggtgtgggatagtgtagccaacccaatcgggcttcactaagtccacctgaactttggcattgccggcttgctgctgcgccccatgcactcgggtctccggggtaggcttgaaagcttgaccctctgcggcaggaattgcaaatcctggtgtcaccctaacgactagggtacacgatgtgggttcctgcgatagattcattagtgtccttagtatatgttgcaa

SEQ ID NO: 75057 - DNA, 721 bp, Oryza sativa
cgtgcgaacaagactcaacggctatcggcggggtggggcagcgaccatcgagcttccggaggagggagagaagggcctagagaagaagagaagtgtgtctgacagtgggcccaaccgtttttcctttttatccttgtccctgatatgtaagtcccacaagctgactcagctagagtgctagacaacgtggacaaagatgacacgtgggacaaaaccacttccgaaaccaccagggtagtagatttgcaacaattttgagagttatatatatatatatatatatatatatatatatatatattatatatatatatatggggttttgcggttgagtgttgcaaatcaaaggacatgagttgagggaggcaaacagacttattcacttttaaaagcaaccgggacggcccagtagcctatggacggccgcggcccaagtgacgcctcctaaaccctaatcctatggacggccaagatgtcccgagcccctcaagctcgcgccatccgacgagctggaagcattcacgtcgtcccgactcttcctctataaaatcaccacctcgcctcgcgtcaccacctctcgccgccgccaccgcctccccctccaccccccgcctcgccgtctcccgttcggaacaccaagctccagcgccccccctccggcgaaatggtacgttctcgccgccgctgccgccgcgtcttttgtgtgccagtgctatcgcag

SEQ ID NO: 75058 - DNA, 108257 bp, Oryza sativa
gccatggccgaagtggaaaagaaaagagagagataagggagagagagggaagaggaagaagggtcggaggtagaaaggatgacatgtgggctccacatgtcagtgggtcccatatttttttgtttgaatgacaagcgggtcccacatatattttttaattctaacgccacatgagtgccacctggaacaaataccaggtcaataccgccacgtcaggaaaaccatcctctaaaaccaccgagggtttcaatagttcggggagtcgtcttatctgtttttcagttaagggatacgaattaaattcggtgtactttaaatggagtcaaagtggactttttcctcccagcttcgctcctgtgaaatcaatgtttgtaactagatgccacctagaaaaatgagtataattgttaggaaaaatagataattgcagttcacatgttgtgttaggcttgttcgtgtcccaaacccaattgggacgtgatggacgtatttggcttgagctggagaacaagttccaagtgccagccaaacccaatttggccgggttcaattaatccccatgagaaaggcagggcagacgattggctaggacgattttttacttgtgatataagtttgctaattcgtgtgtaattttagcgtttccatataaaggctgtgtttagttggatccaaagtttagattttagttgaaattggagataatgtaactaaaaagttgtgcgtatgacaggttgatgtgatgaaaaagaactgaagtttggatccaaactttggatctaaacacagccaaagttctttttagctctgaacaacaatttaagctattccgtagtcacttcgctaaaacaggaatgaacaactatttaagctatttcttagtcactccgctaaaacaggaacgaaacaaaaaggtttttgaagcacggttgtactaattgcatagtatcccaacatggtccggtgaacagagaagatatgaaaccaagactcagaaaaccacagcacggttgtacagtgctaattcgagttcctcgtcaaaatctgactgaaaaatgaaactacaggagctataatttaggtcatccgctgggcagcctccttggcgagcagcttttccctggccttggtcttcgcctgcgacttggatcccatgacgccgcctccccacttcttcctaacctcatcgaatttgtcgttgaagttcgcctagagcaagatggtttgcagcgttagcgaatgaggtgctaaagggtggcagcagcactggatagtatgatatgatgattaaatgcacgagggatctcgtggtttctcaccttgatagcctccaggatcttgctgaactcaagcttgtcctcgttcttgacagtggtcaagcagaggacagatgcagttttcttgtgaacaatctacaagtgattatttgtgaagaatgagactctttatactagcacctataccttcaacaagtacaaacaaggttcaggaggaaatatactgatccaagacgggcttttcctttcacaatgcagtaagggacctccatcttcctgcacagggctggaagccacacaaccagctcaatcggatcgacatcatgagcaatgacgaccagttgggccttgctctgcaagaaaaccattcacttatctcaacaattttgtttgattgtttgttcccataaagatacgccttgattggtaactaacaaagatatgcataggtcacttaggttctgtacctgctcaatgaggtatgtgacatggttaagaccatacttcacaacaattggtttctttgcctcaacggttttaccttcagcctcagcctgggccctcttcaaaagcctctccttcttagcagccttgtcctcagggcggtacttgaggagcatcttaaacagattagttgctgcaaacaactatgcacataagatatttttgacaccatgaattgtaaaatataacaaatgccgcgtacagagcaattcaagttgaactgcatgtaagtcctgttactttgttttgaagtggtactatgaacacaataatactaagaacacaccagccacattagcaaccgacatcctactaacaatggtgtcaacgtatgctacgtacagtggacagatgaccaaactatactaatactaaagaagactttagtagtaatacctcagcatttcctgttcttatttttcattcacggacaaatttcctagacactagcaaacaacaaacactagtgatgaaaagcttcgttcaactgaaagaaatctaccctgctaaccagaaatgtactactaagctagtagtaagccataatcaagaacattacattacttgggcactatatacaaaccaccacaattcaaggttcgcaatgaacatatatacaggtggattttcctaaccatctcagtgaaccaagtagcgttccaggtgcaatgccaaacccgacaaatctgactgatgggacgatgaacgaatcaaggcgaattacataccgaggttcttgtcgagggtgcgagtgaactggttgagcgccgggggcaccttgaggcgctgcttgaggatgcggcgctggcgctggatgcgcaccaccttgggccacttgacgaaccggtgaaggtccttcttgggcggcagcgcgccgccgattccgaactgcttcggcctcttctcgaacagcgggttcgtcaccttctcctgcacccatcaacatcccaaatcaaaccacgccccccccccccccgcaacaacaaagatttcaagcgcgacaacggagcaagagatagatgattgcgggtaccgtcttcttcttcgccggcaccggcgccctgccgcctcgcttcggggcctgcgagatttacgatccagacgcatcagcgcatatacatgattcatatgtaaagttgcaacctccaagcgaggtctcgagataagctagcagccgctgcgagaatccaagacagcgttcacaagatccaaggaaaccacacgaaggacaccacagaaaaaagtatcaccaaaagatccggtttcttcgcagaaaggaaaccgctggagcagctgcgatagcactggcacacaaaagacgcggcggcagcggcggcgagaacgtaccatttcgccggagggggggcgctggagcttggtgttccgaacgggagacggcgaggcggggggtggagggggaggcggtggcggcggcgagaggtggtgacgcgaggcgaggtggtgattttatagaggaagagtcgggacgacgtgaatgcttccagctcgtcggatggcgcgagcttgaggggctcgggacatcttggccgtccataggattagggtttaggaggcgtcacttgggccgcggccgtccataggctactgggccgtcccggttgcttttaaaagtgaataagtctgtttgcctccctcaactcatgtcctttgatttgcaacactcaaccgcaaaaccccatatatatatatatatatatatatatataactctcaaaattgttgcaaatctactaccctggtggtttcggaagtggttttgtcccacgtgtcatctttgtccacgttgtctagcactctagctgagtcagcttgtgggacttacatatcagggacaaggataaaaaggaaaaacggttgggcccactgtcagacacacttctcttcttctctaggcccttctctccctcctccggaagctcgatggtcgctgccccaccccgccgatagccgttgagtcttgttcgcacgcacgaaaacaacaaaaatctagcgtaaataaaaggggatgggagtaggtagtagtgacagttgaggaaatcaagaaaagagaggataatgcaacgggagatgggggcaatcggagcgggtcattttccccgcccaccgaagaggcagtccctcagacagcggggagtggagacccctccccgagagtggagattcgaccagggggttagtcggcgagcggtgcgaggtatctgcgatcgtgatggattcgcggggcccgaccaccccgcgaggaggaggaggtaggaggttatacaggttcaggctacccggaggtgtaataccctactcctgtgttggtgttcgttgtcttctctagatcggctaagaactgaaagttcaagtgccattgatttggttttgatgattaataacaaatccaattatgtgagactaatgtttttataagcatttctttgcctagtctcatgtggatatgaaagtggagtgttggtggacctaaatcacaagaatgaaatacatggagatcaagctatatgtatcactctttctcttcatgtacatattgatatgttcgtatataatatttccacgtgattggcatatgcatgtgagactaatgttttgtttgagtattatctcttatttagtctatttacattgagacgtggagatgatgaatgtatgtttttattttattgtctatatttgataaatgccttctattcttgtataggataagctctcaatgtttaatatcttgttatgcatactcttgcttcacacaaatattttatatgcatacatttagggggagcaaatcctatactttagttatgcatgtaatcgattcaaattattcaccttcatttaattgagatctttacacttgaacatatatttgagtatatgacacttgtggtgttgattaatactcatcatttattcatatccttttatacatgcgatcggttggtcaacatgtgtaggttgacaaccggatcattgggactaataattttattgagttgaatgaaagaaataggtcccaaggattacaaaggtgttgatgctcaagtgatatcattacatctaacaataccaagaatgacaaagtgaagatattgaagatgtgtgatacaaagtggctattatggcaagacggtgaagggcaagcgatgctcggtcgcgatggaccatgcggcggtgaagggcaagcaaggggcttggcgccgaagaaccaaatccggtggtgaagggcgagtgacggctttgtcatgatggaccgtgcgagaccatttaaagctacaagtaaccgcatcaatcatttgaagaatatatggtgaaacggtatcggcattggcgtccctcaagacaatgaaagaaagataaaaaaaaaggcattcctaatggtatagttctcttcttatttacatttgagtttaggaatgccgtactattaagagggatgcaacgtcgaggtgtttgtgtatgtctcggtgctcaaagtgacctatcatagtgctaccttgagagaaacccaagctttaacctatcctttgagtggttttagaccttgtttttggttgagttgggtagtcctctgagtgagctttccatagagtccaagttcatcaaaaaggactcccgagcgaaaagttatagtcgttttactctgtgcttttcggaaagtccgaaaaattaccggaaactccgataattttttggacaactccgaaaatttttggacattccgaaaatggctgcgaatctgagatttgcttctataagttttcggacttgtccgaaaatgcttttcggaaactccgaaaattacagtcttggcctccaacggctagtttttgaggggctcgggtatataaactcctccacccctcctttgagtggctgctgctcttggggagtattagacacatccaaagccaaatagccatccctatttccctacctttgtggtgcctctttgtgagggggatttgagaaggggagagagttggattgagagagtgaggagttgagagctagtgagcttcactccatcctttgtggtgcctctttgtgagagggatttgagaaggggaaagagttggattgagtgattgagaagttgagagctagtgagtttcactccatactttgagcactcgagttcatagcaagcaattcttcgattgtgtttattacttttggggactaaggtctcctagacggctaggcgtcgccggtgagcacccaaggctgtggtgtgccacggaaagtttgtgaaggcttcgatttcgcctccgcaagggaagaaatcaaaagtaaaaccgaggagtgcatttgtgcaacctcgtgaggaaagggttgaaataggcccggcccttgtggctcctcaacggagacgtaggatccgtggatccaaacttcaggaaacaaatcacgcgtctcctctctttgtttgcccatttgtgcattctctcatattgtgcttgagcttgtttttacccgatctacttgcatgcttaattgatttagttggtgaccttatatcttatttagataccttatttgtcaccttttgattcatatacattttgtttatttgagctacaagttcatagatagtgttttattcctttatccgccgaactttttgattgagaccggaacttccaatctcatatcggaagttcctatttgaaccaaaagttctcatcattctaatatgctacgaagttgtgttaatttttaggaacgcctattcaccccccctctaggcgacattaaggtcctttcaagtacaaaggagaccttttcaggctacaaagcgatagtactcacctaagagaatccaacccttcattcgtatctagtccccttccttttatagtccaaggaggggcttaaattattacaaatctactcttagtgttgtctcatcagccgtcttgtcactgccagctggttccctaacgcagtcctcaagaaacccttcaagtcttacgattcatattaccccgggctcccaggctctgtctgagatagttgggcattcgccaatgtgctcaccacgtggtgcgtggtgggcccaacgaggcccgatctgcctgaaatagcgccacgcttgcttctttgcccgtttggttaaatcaagtggcacggggcatgtgcgacgcgtgtcccaggcgccaccgtccaaagtgactcagcgttggcgtcttgtccacttcctttcaactcagactccccccataaagctatttcacttatgatgaggcgtgctacctccaagctggatgtggagcatgcccaacttcctggaagtttatgaggtaacgccctcccgtgcttaaagaaggttgattattcttggatgagcttcttgaaggtatcgttgatggaagaatatctcaagattatccgtcttatatattttgacgcccctctaagcagaggaacgcgaactatacaaggactaaggtgagtccgaggcctaggactagaccggacctgaggcagaccttagcttatcctcttaatatataggtcttgcatgtttctatgcctttcttgccgaggaccgtagaaccttcaagggctagggtgagcccggggcccaggacagagccgggcccgaggctgaccttaaggcagaggaggggcatttttgtgacccaagccaggccccaagttacttctatacacagagttttgagacatatacataggatccctcctcagccagagagaatcccatatatgaaatcttaggtgggcccagggcctttcggaaggggttcctagctacgtcaccctagggttacctttttatttttaaatacattctgagcatgctatttatttgataatgatcctttttccggataaatgaggaccccgattcccatttcaccgacaaacggcagcaaattggatgacgctcacgctcatcgccatccttccccgaaccgaggcaagctgtccctcatgctcccgaacatgaagaggagttctccatagaatgacgccactagaggctgctgactcatagtgggagcggcaccgccaaacacgaagtcgccgttggtgccaacaccaacaccgctcggcccaatctccccgatcccatcctatcctatgtcgtctataccgctgtcgccgcagccaaacggattccatgacgccgtagtgagtgacgccggtggctgctggcgggagcgggaggagtaggcgggcgccacgtggcgcagcttggctagatgcgggaaggaggaggcagtggtgcagccatgtgatcagaggaggcaagggtgagccctaggttggggtttcccatggcgcctaggggggtgctgctgctgaggggtgctgctagggttttggcacgtggggtggaggttggcgctgctaccattggcgtcatccctaggcatggcaacggccggggggaggggattgcaggggaggagaggagtgtgttttagttggtccgatttagggagagaagcggaggaggaagggttgcatagggaacgcgtcgacgatggtggccactgatagtgggcctcacaatttttcattttattcttgtcactgacatgtgggtcccacaagctgactcagctagtctacaagtcaaagatgccacgtgggacaaaattgcctccgaaaccgttcggggagttgattttcatcggttttgggaattagggggttataccctgttttgcggttgagggatgtgtgattcttctaccagggacatgagttgagaaggggggcaaaatagacttattcctttaaaattctgcttggaaggagagggaggagacagtgcaggagtagatgtccaccttcgccgggggagaatggccacctcccaatcgatgggcgtggggtggagatcctcgccgccgtggaggccatggcgagggttggggaaggagttgatggcgacgtcgcggccagtgaggaggttgttgccggccttcctggccccacctcctccgcgcctgtggcctctacaacactgtgttacccatcactggcgccgacgccctcatcctctcccgcctcactccgctgacctccacctcacctgctggccggcctacctagaaaagagtgagagagaggaggaagggagagaagaggggaaagagagggtgatgacatggccaccctgacatgtggggcccacgttgactcagttgccacgtcggaaataaccagggttaaaactgcctaaagacccaaagtaacctagttttgttagttgatagatgacatatatctcgtggttttgtaatccgatgacaagatgagggacctgatatgtacttttttccccctaaacactcccaatgtggaagtaaacggccccattgttattcggggaataagcgaaacgacatatttacaaatgaaaaataatttgtgaatataatttttatatacatgttcttagcaatctaaaaacaaatgttaaaaaataaacttcgatgaaaaaaaccctaaaatcaacaataaactttaagattataaatttaaattgtggctgataagtataagtataaaaaaaaagacgaggccgaaaaatcacttgggcctgttctgttagtccagcccactaggcaactccaacggcggccgcatcaaacatggcgtcggccggaatcgcagcgccaagcccccagtctcctgtccccaatcggcgacgcagaacagaacgcgagcagtcgagcagcccgaccaccttgaccacatcagctgccagcagagcaggagctctctcctcttttttgacttcaaacttgcgctcgctcggcgacaagctcaccaccaccccatccttttcttttaccttcttttttttttcttttccttttttgctctccatggcttccacctcctcatcagccatcacctctccctttgcaattctctaccaaagcgagcatcactactactagtgctccttccactctctcctcctccttacactgtccctccatggaggaggcccctgcaagaagcgcctaaggatccctccattcgggttcaccccaccacaatggcggcggccaacgccggcgccatggtgcgcttcgtggcggcgttcttggcggcggtgctggtgatgatggtgccatgcgcgccgcgggcggcggcggcggcggtcggggtgaactggggcaccgtgtcggcgcaccgcatgccggcgcccgtcgtggtggagctcatgcgcgccaaccgcatcggcagggtcaagctcttcgacgccgaccaggccgccctccgcgcgctcatgggcagcggcctgcaggtcatggtcgggatcaccaacgagatgctccagggcatcgccgcctcccccgccgccgccgacgcctgggtcgcgcggaacgtgtcgcgctacgtcggccccggcggcgccgacatacggtgagtccccgccgcgctccctcctgtaatttgggaaaaaaatggattccttttttccttgagtctctcgctgcaatggaagaatctctgcgttcttgcatacctacatcttgctgtattgtgtttgttggattcttgctggcactgtgtttgtgttaatgcctacttgcctagtcaatgagatattgctagtctactgactcggaacagtgttaagtgcctctgcttgttttctttttcggaaggtcactgttcgttctcttctcttatgttgattgatctggggttattatattaatttaaggtgtatctttctcttgatgactggaagtttgtttatagattgtcaggggatgcagtctagtgtaatgctccttatactgattcaagttgaatttagttagtgcaagtgcaatgcagacccgattgccttttatggacaattgcgccagtacatatttgtgtcggacttggaccacacaattgcactgttatttatgatgaacttgacttaatggaccctgtgattctgttgtagtcgcctttgtgtctgtggtttcagtttaatggttgaactgaaattttgctttgtgcaatacacgtccttgtcattatgtagattatgaagttacctgcgttttcaatttattttcaggcacataaaacaagacacgattttcttacaaaacttaaatgcacgtcaagatgtttttgttctgctctgagagttggcattaataaaaacataaataacacttggtaccttctgttctgtatcttttagtcactatgaagcttctacttgtcagagtagaacacaaggcatgcaaagatggtaattttctatgatacacatcctgaaaatataccatgtgtatggtgatttctagatatcatttggcaaacaaaagctctgtcaaaattctgaacgatcattgaaaatacagtattgacatgccaaaagcccaaagcaatgtatagccaccagccttatttttgttaagcaagtgctactatgtttgaagttatttctgttactttttagaacatttcaatatacaggattcctcaaggattaaaatgtgataattatccttgcaaagcatagtaaaatgtgtttcaagagacagtgtctttttccatctgctagatttcattcattgatgcacgtgttagatgccagaatatatctgcacatcatgagtccaatttagcgtttaattttctactgctttgggatgtcaaatttagcttttccatgcaatccaccggatgtcaatagttgtatattccactattcctctatctgatggagtatacactggaatagaactcaacatttgttggtgctaacacttatccattttttgttcatatcctaggaaataggggtatctaaagtagcctttgagcttgaatggccctgcactttatttgtttgtggtcatctatattgtatttttaagtcatactgtattagtgttaacatgctacccacacaaaaaggtgctggcattcagaacaggaaaatggataaagaaagattgtgggtagcagacattctttccatgtcaaaagaaggaaaatgagagaaaataagttgtatgacatagcttttcctgccgaccttagccatgatagcaatctagcaaaagctttacacccatactctgtctaattcagtcacatagatgtgctagtgtacaaaagcttttggtgcaaacatcactgcaaagctggtgagaggaagcaaataatttccaaataccaaatattaaagcaaggaaaggaaataaacatatttatctgacatataaacaggaaagtggttcttactactctcttactctctatatctggtaactggcaagggcttaccgttgcatcacttgttgtcacttgtctctcgaattggacagttgctgagtcaagcttatatgttctaacccgatcatttggcatgattaatcttctactatgtttgttatgggttgcatagggggtaaacaccgctgggaggatagctgagcggcacggctgctagggatgagagagggacttgggtactgtttatgtttttgttgttttctgtggacatgcctgcatttgtttgctcaatttcagaacacacagcagttggctgcatttacatgactacatttttgttgaaacaatttcttttgtaggtattgaatagatgaactattgaatatgtactgtttctctatttcatgaagttttaatcggagtaaccaaatgggtcatcccagcaacgatcaaatgatttgatcatgagataatccattctatgccatcgtcaaagcatgaattttacaatatgccactgacaaaacttagttcaataatataccatccaacaacttgttttctttcttatatgtcatcgccactagtcaaccattagtcaaactccgttaagggagagaaaatatctattttacacctaggatatcatgctacatgtggattttattggtcatgatccactattttttctcattgatgaaaaatagaaacagcatgtctttttatcatgtaagactatttgatgtgatatggcattgtgcaaaatctcaattttatcctaggggtaaaattgtcattttccttcccttaacggcgtttgactaacggtgatggtatataaggaagaaaacgaattgtttgatggtatattgtagaattaagctttgtcggtggtatattgtaaaccaatgacatagaatggattgttgtgatcatggaacataatttttgttttcatttaaggtggtcagcctggtaggactgtgaagtgtgaaccgagtggaaagcaacataaaatgcatgcttttctaaaaaaaaatactaatgttgagtatgggttaaattacaggctagagaatcctttatttcagaatatttgctgggaagttaatttatgtgcttaatttttttttgttgtacctatattcctatggatgtctattcgagctgtttttacttgcttgagaattttctttcttttctctgaaatctgttatgttgcttactttcttcctctgctaaatttgtttatgactttactttattcattttcttatacttgtccctaatttaaacaggtacattgctgtgggaaatgagccattcctgacaagctatcaggggcaattccagtcatatgttcttccagcaatgaccaatattcagcaatcattggtgaaagctaatcttgcaaggtacatcaaactagttgtcccatgcaatgctgatgcatatcagagtgcatctgttccatcacagggagtgttcagacctgatctgattcagattattacccagctcgctgcttttcttagctcaagtggtgctcctttcgtggtcaatatctatccattcctcagcctttaccagagctctgatttcccacaagattatgccttctttgatggatctagtcacccagttgtggatggccctaatgtgtactacaatgctttcgatggcaattttgacacattagtttctgctttgagcaagattggctatgggcagctaccaattgcgattggcgaggtgggttggccaactgaaggggcaccaagtgcaaacctgactgcagcaagggcattcacccaaggcctgatcagtcatgttttaagcaacaaaggaactcctctacgtcctggggtgcctccgatggatgtatatcttttcagccttcttgatgaagagcagaagagcacattacctggcaatttcgagcgacactggggagttttctcatttgatggacaagccaagtaccctctgaatcttggattgggcagtccagttctgaaaaacgccaaagatgtgccatatcttcctccacggtggtgtgttgcgaaccctggtcgagatcttaacaatgtcgagaatcacctaaagcttgcttgtactatggctgattgcaccaccctctactatggtggctcatgcaatgctattggggagaagggcaacatctcatatgctttcaacagctactatcagctgcggaaacaggacgcccagagctgtgatttcgatggacttggcatgatcacttaccttgacccatccatcggtgactgccgctttcttgttggtatagatgacagtagaacatctacaatctattcttcaggtgactgttctcggaggcgctttggattgtggatcttggcgttcttggtaattgggttccttcagattggggtttatttgtgattttggttgtcgagagtcgactttaaacagctcccttgggcacacttcccatgtccttgtgaagtagcttcgtcaattggtggcttctagatgtaggaaaggggggacactgttagatgtacatgatcactagcttgttcttgggattgtgctgtccaattctgcaacttccgatcttcatgctaaggtggccaaaagctttctctagattgaaatgaagatggtagatgttgttgcaacctgattctgccattctttggtaccaccattttgatttggggcgaatatatttcttttgtagggggtatatgaggctatggtattgctgtggtcttaaagatacctcatgaaaccgctgaaattcatactggtggaatcacgagaaattgttttgtttgactagctttgtccactggatatacattagggtttttgtgcaatctcaatgcctgacatccattatattgtgctatatgagaatgtcataaaaacgccatgttttgctgttccctcgttcacaaaaatacaggtacaagaaatggcagccatgtgcccatgtcaattcggagttgcatcaggcctcttttattactcctagcttaatgccaggtcaaacgttggttgcgttcctcaaatcagatcaaggaattacatcaaaggcctcacagtcaagttcctcttccacagcaactagaggtgcttaaagggtagagtatttctaaataataaagcatctttataagcttccttttctccaatgcaagcaccttttcatgagtgctcaactggttgcaagaacaattaatcagggatggttataagcttaagcagctgctaagcaccaatgcagtaatcttccaatccaattttaaaaatattcaatatgaagtcttcaaagtttttaatcgaagttttcaatttgaaatataaaacctttatgttcagtaactttcaagttgatactttctattcaaactttcaatttgaatagcaaaaactttatgatctaaaactttcaacggcaatctcaaaaactttatcgtcaaaacgtttgaatcataattcatccaattttaacccattcaaaacttttacttataacttttcactctcaactcaagtctcctaaagtttcactcatgacatcaaacattttgcccaaatgaacaaacttttatctcaaataataaaaaactttcaatccagggatgaggtcagcttgtggccaggtctgaggaagaaagaggtgcaaggcctcatcgatgtcacggggattaggcctaggggcttgttagtaaggaggaagaaaggtactttgagctcataggggagtagggagaggggtatgggcggcatgccaaggaggaagaatgtgactcgaggctcacttacactaagacaaggaggatgaaagagtggtacaacatgatgatttgacaacaacatatttatgtgtaagtaagttcgcgtgtcaatacaattgggtgactgttggaataagtcttttcgccatgttgacaggcgaaacgattttgtgcaccaacaagttatgagtactactttgtgtaagggtatgataaccaatggcacaactttcctcatatgatcaccaaaacaaagtacaagagtgctagggcaaggttaggaatacaaaattagagagcatgaaaagacatagcattaacaaaccaaatctgatatggtacatgtgtgtgaggtgggcacaaaatgatctttttgctatgcatgactaggaaatccattggaacaaacaatattttcaacaaaacccaataggattcctagtaggctcttcgagacgtagggtggagaaaatggaggaatggtaagaatatatgatgactttgataggaatgtaagtgtaaaacagtggatgacatgaatgcaagtgcaaaaaaaaagattgcaaaagaaaaaaaaaatctatgagtgattgtttgattagatttcatgaaaaatgcaaaaatcaaatgagagaggtggactagaagtgaaaattttcaaaaggttagagctcttgctaacttttcttcaaaatttatatgcactaaaccatcccttaggaattttggagccccattgaattggaggattcaatttccaaagaaaattttcccatggaaagcttttgattcataggaaaaggattaaaaaaatttcataagaccttcatatggctcaatttcatagggaaataagccaagaaatccaacctctcgggaactataatttgctttgtttatttcctatgatggtattaaagggaccttcttgagctttcccgtgttttctattcatgtaggattagagaaacatgttactttaatttctacggttttcctatcacacgtttcaaaggagtcactttaattttttcctacaagttgtttggcaccaacaaaaatgttataatcttttagaatggttcccattcctccaatttcacaaccaacaaaagctgaaggaaaacaaaatccttcacaccgtttttttctaatatacttaattaatcatgtttcaaaatttgtatgttttcaattccatagtcatttattttgtgctctcgtattttttttctgtttatgtatttttagtcctttgttccaaataatgagactatggaattttgaaacaatttggaatgcagattctgagaaaacgaaccaacaagagagagacgtgtcgcagacgctccatatctcaaccgcttccatcctgggtcccacctgtcagctagccacacccttgataaatacccgtgaaacccaggatcccgtgggtaactccccaccttaaaccccagacaccctcaaaaaccctaatcccctccctcccgccgccgccgccgccgccgccgccatgggctccgcctccgcttcctcgctcccggcctccgccggcttcggcgagaacctggtcctcatcctcgacttcggctcgcagtacacccacctcatcacccgccgcgtccgccagctgggggtcctctccctctgcgtctccggcacggcgccgctcgcctcgctcgcgggcctccgcccccgcgccgtcgtcctctccggggggccccactccgtacacgcctcgggggcgcccacgttccccgaggggttcctcgagttcgccgccggcgcgggcgcccacgtcctcggcgtctgctacgggatgcagctcctcgtgcagtccctcggcggcgccgtcgaggccggcgagaagcaggagtacgggaagatggaggtggaggtaaccgcccgctcctcggcgctgtacggggagggggaggtcgggaagcgccagacggtgtggatgagccacggggatgaggtggtgaggctgccggaggggttcgaggtggtggcgcgcagcgtgcagggtgccgtcgctgccgtcgagaaccgtgagaagcgcttctatgggcttcagtatcaccctgaggtagcgaccgttacgattcttacacacatttttcaattggtgttatctaaatcaatcaacaaattcaattgcatttattagtcgttcttggaatatcatctctttgttgaaatgtgcattttgtatttggattgatgttatctaaattaaccagcaaattcaattgcatttatcactctttctcggaaaattatctttgttgaaatgtgcattttgtatttcggtcgatgttgtctagattaaccaacaaattcaattgcaattattagttctctttgttgaaatgtgcattttgtggagcatataagatgtaaattttgtgggaaactgattggttattgacgattgattattatttagttttgaaggtcaatttttgttttgaccttttggatagtgggtcttcttttcctgaaatagctgggtatcctttggggaaggaaaatagtcagttatatctaaacttccacaatatgaaaaggtgaaatagctgggtatcttttggggccataatatgaaaaagtgaaatagctgggtatcctttggtgtaaggaaggttgttagttccacaatatgaaaaactgcaactttagaacgactgtgattgcgctacaactttaaattttgctttgtttcgtatttcctgaattaacctggatgctttctgcttatctagatcttgtgctaagttttataatgcaactgctgtatatggtgctgatgttttctgcacagagtaaaataaatttgtgtttggggcttagcatactgttgattgtgtgttcacttgattgggatttattattatgcactcaatttggttcttttgtagttggcatgcatgcatggcaaacatgttgttaaactgtttacaccaaagcatggttatgacgaagtattaatttaaactgtttacaccgaagcatggttatgacgaactattcattcttttcattatacaaggtgacacattcaccccaaggaatggaaacactgcggcgcttcctttttgatgtttgtgggataaaagctgattggaagatgcaagatgtgctggatgaagaaattaggacaatccaaagcatggttgggcctgatgaacatgtgatttgtgctttatctggtggagttgattcaactgttgctgccactctggttcacaaggcaataggggatagacttcactgtgtttttgttgacaatggcctattaaggtagtccttgtttcattatgttatttagtgataacattttcagaatcagtatgcaatggaactgacataagaccccttgtacagatacaatgagagggaacgggtaatgttaacctttgaaagtgacttgcaccttcccgtcacatgtgttgatgcatctgagcaatttcttagcaagctaaagggtgtcaaagatccagaaatgaagagaaagataattggaagggaattcatagcagtttttgatgattttgctcacaaattagaacagaagataggaaaaagacctggatatttagttcaagggacactgtaccctgatgtgattgaatcatgcccacctcctggaagcggaaggacacattctcataccatcaaaagccatcacaatgttggtggtcttccaaaagatatgaagttaaagctaattgaaccactcaagctcttatttaaggatgaggtctcattgaaatttatttacataatatctctccatttttatcctttgcatgatcttgtgcaataaaatttacataaattacattttgatggaaagattctgataagtaaatttcaaacatatttttctattccaaaaggtacggaagttggggagtattttaaatgtcccagagtcattcttgaagcgacacccatttcctgggcctggtcttgctgtacgtgtcctaggtgatgttacagaaggcaatgctttggaggttcttcgtcaggtttgaagcctttcaaactgttgaaaaatcactacatcagctttggtatatgatgttaattcgcattgtcatttatttgtcaggttgatgaaatatttgttcaagccattaaagatgcaggtctctatgatataatttggcaagcatttgctgtgtttttgcctgtacaaacagtgggagttcagggtgaccagagaactcactccaatgcagttgctttgagggcaattactagtgaggatggcatgactgcagattggtatgtaacactgacgttctggctcttacacccacttgcaatttgttgattgtcgcagccttcgttgtgccattttgcagcagtttcttgtggttcgacagatatgttatatacattgcacagttcacaataggatacttgtgaattgaatcatgcccaccttccagtagtttgaatgatgagatgatagttcagcattcacctttatacccttgcctattgccttcttgatcatttatgttaataatttgctgcttcatttttcatcggtttatcagccgtagagcaaacaacgagagtcttggtttatcagccgtatagcaaacaagaagtcttggttatctttgaaatatttttaaattatttgacaaatacaaatttagggtgttcattaattttatatttgtctctggtgcttgtcctgtatgcctatttcttggtgtgcaattattgcttaggtctgctgatagttcgaacctacagaaatacatttgttttgtgttgtgtgtgtgaatcttttgaaatcttgcatgttttcttatgtgataactttgccctgtgaactcttttctcaggtattattttgagcgtgagttcctggtagatgtggtcaacaagatctgcaacaatgtgcgaggtgttaaccgtgttgtccaggacatcacgcaaaagccacctgcgacagtggaatgggaataggaacttcgtgctctgaattctgatgccgtggagtggcctacttttatgctgcaatggagtgggaatatcaacatattcccatattatacatatagctgtttattactagattgtttgtttacatcctttgacaaatccctatttgtcaacctgtgatagattttgaactgagaaaagctttgaactgcacttattaactgtgctttctattcttgaatagatatcttcacctttgaagaccttttatcttttggagtaaatctttgttgctacaaaattttcattatcccttgtgccccccatcttttagacaaagagatgtgccatctacaggatttggattttttttttcaattgttcttttaggacagaatcttttagacaaaagggatgtgccatctatggatatggattttttttttcatattgattctttaggatagattattggtgttgaaaactgacgttggagtcattgggccttctggttttagcggacgttggctaattgactgctcgattatggcattgcattctgaagattgagcatctttttcctttttatggccccatcgtgaaacgatatatttacaaataaaaagtaatttgtgaataaaatatttatataaggtcttcttagtgatctaaaagcaaaagctgaaaaataaactttgatgaaaaaactgtaaaatcagatttaaggttgaaaatttaaattttggatgataagtatgagcataagcgaaaaaacaaagctcttaattgcaaagcgtcgaaatatattaacactaactggcaacctttactgtggcaacctttactgctgcggtgcaggatgtgtctgatccattgttaggtttttttttagataatggataaaatccagcctctatatctaaagtggatatacacagccaaaggttgtttacacaagtgcatacactctaaaacccatgattgagaaacatgaaaaagaacaaccgaaaagaaaacactagaaagtagatgcggagctagcccgcccttccacacccccctgctgtcactgcaaccaccataaaagcttcttcattctagtctaatcaccttgtagttgccaagcaagggtctcatgctgcctgaacaacctactcatctgcggtgctaactactatcgctaccatgccgtcgtcgctgtagagaaccatcttcgtcgagctgccatagtgccatagcttatctcgccaaaagtcgtcgttgctacactgacaccacatcacacgacaaccaacaccccaaaatgcaaacgacaccctgttgccccatcgcccacctccgccgagcggccaaagcttatctcatcagaggacctccgctgccaagttttcgtcattacagaccaaaactttcgccaagccgttgtagcttatctcaccgaagagttgtcgctgcaatgccgatatcaccgcagaacaatgattcatcttgttaggtttactactgattcttcttgtttacaatttttcttgaacaatgacctctctaattattttaattctctctattttttcttattttatcattattttgaatggagttcaatggttaaaacggatcttaaaaatatatgtttgaaatatataagccatcaaaaaaatttaaatagacagtatacatgtattactcacattgtcggaggctattgtatgcgtctcgccgtaagattaattcgtgcgtgcgcgccggttagattttatcaatttggacatatatccaatgttgttttcacttgccttaactagtaattaataaatattgttagacaaaagtgataggaaaaaagtcaacatgttatttatttatattaaaaaaacagaggaagtaaaaaatgtgaaaaaccaacaggaaaaaaaatcgaggaaagtactctgcccggccagatgctcagccgggcccggtgttgaagcgttcctccggtgatctggactatttttcgcggtcaaggttagccaaatttaggacttgagaaaccgtccctgcaagcaaaacgaaacgaacaaaaaaaaaaaatcctggatcaccaagcttatttataccactcagtcacactcactggagatcgatcaagacgacgacgagtgatcatcctcatcatccatggcgagcagtaggctgttcctcgccgccgccctcctgtgcctcgcctcctccgcccaagcattcaagaaggcaagcacaaaaccacacagaattcattcatctactctataatttctgatgaatttcttgtgtcatttcgattcagtgaaacaaactgggtgtgatcctttctgatgcttttttttcttttttttttctttttttttgttgttgttgttgttgttgttgttattatggccacaatgtttgggcgcagccctacatcgtgtatctgggatcacacccgtacggcccagatgcgtcggcggaggagcacgcccgtgcgacgcagtctcaccacgaccttctaggatcagttcttggcaggtaataaactcactcacctagattggtgataatcgctattacagactgtgtttctatgattcttctttctgttcttgattgatggaaacaaaaataaaatgttggactaatgcacggacgcacgcagtaagcaaaaataaaatgttggactaatgcacggacgcacgcagtaagcaattggccaaggacgcgatactctactcctacaccaagaacatcaacggcttcgcggcgcatctggaggaggaggtagcaacccagatcgcgagtaagaagagaacatctaaattgatcaagaaccgatgagtagaatacataggacaaattcgatggcacatcaacgaaaatgtttggagttgcagggcaccctgacgtggtgacggtgatggcgagcacgatgctgaagctgcacacgacgaggtcatgggacttcatggacatggagagggacggccagatcctcccggactccatctggaagcacggcaggttcggccaggacgtcatcatcgccaacctcgacagcggtacgcatcgctatctttatttatttatttattttttaaataatagaataaaactttcgacctttgcttcaaataaactacagtcacctattacaaaattctctcaaagagagcaaatacacaggcttattgccatcttaattttgatgcgtttttgggttcctcgagctcccatggttgattactaattaatctctgccgttaatggtgatcgaatcaaggtgtgtggccggagtccaacagcttcaccgacgaggaagtggtcggcgaggtgcccaagcgctggaagggctcctgctctgacaccgccaagtacggtgtctcctgcaacaagtgagtggctccatttctcggccgtctttgaattgcagaatttttttttctttacccacctcattaatagttcatcatatacaataaagacagatttggagtttcaaatcttacagaattttcaaccaataaatacaacctgtttaaaatgaaaataaaaaagagagagagaggaagaagcatgtcaaaatatcttaaatctaggggaaaaacagttgtaaaatctttttcttttgcattgtaaccgagtattattgttctataatcaagtgtaggtgctctataactgagtgtaactacaagtttagtctacaggaacccgaatcttgatcaaagattctatggatgaaaaatcgagctaaaaaatgtatcgtaagtgaaatattaaaacccgatagattatattaaagagagcatttttgactataagcagttagtcataccgatcaggggatagtgtttttacaataaacacttgtcgaatttaaatttatcatgacactataaaattcctgcatccgccggtggattcgttcatgtgagattttgcaggaagctgatcggcgccaggtacttcaacaaggacatgctgttgagcaacccgggcgcggtggacggcaactggtcgcgcgacacggaggggcacggcacgcacacgctgtccaccgccggcggccgcttcgtgcccagggccagcctcttcggctacgccaacggcacggccaagggcggcgcgccgcgggcgcgcgtcgcggcctacaaggtgtgctggtccggcgagtgcgccgccgccgacgtgctggcggggttcgaggccgccatccacgacggcgccgacgtcatctccgtctccttcggccaggacgcgccggtcgccaccgtcgcctccttcctccaggagcccgtcacgctcggctccctccacgccgccatgaatggcgtctccgtcgtctgctccgccggcaactccgggcccctcgaggacaccgtcgtcaacgccgcgccgtgggtcaccaccgtcgccgccagcaccgtcgaccgggacttccccaacgtcgtcacgctcggcaacaacgcgcacatgacggtaatgatcacctcgtcccacgccattgttaactatagctatatccatggacgaacacttgggacgacatggctcacggtgcaagcttgtctctcccaatgctgcgtgcgtcgcaggggatgagcttggagacgacgaccttgcactctacccagctctactcgatgatcaaagccagcgacgccgcgctcgcgagctctgaccccgccgtcgcgtacgtaccatcctttgaacacgtgaaattttctttctaatttgtgtgagatgatatgagatcgaattgaactgattcgtgtcaaaatcatggcaaaaaaatctgtatggtttttcaggtcgacttgcccaccaggcacgcttgacccggagaaggtgaagaacaagatcgtggtgtgcgtgcgtggcggcgacatcccaagggtgacgaagggcatgaccgtcctcaacgccggcggcaccgggatgatcctcgcgaacggcgagatggacggcgacgacatcgtcgccgacccgcacgtgctcccagccaccatgatcacctacagcgaggccatgtcgctgtacaagtacatggactcctccaagaaccccgtggcgaacatctcgccgtccaagacggaggtcggcgtgaagaactcgccgtcggtggcggccttctcgtcgcgggggccaagcgggacgctgccgtgcgtgctgaagccggacatcgcggcgccgggcgtggacatcctggcggcgttcaccgagtacgtcagcccgacggaggtccccaacgacgagcggcggtcggagtacgccatcctgtccggcacgtccatggcgtgcccgcacatctccggcgtgatcgggctcctcaaggcggcgcgcccggagtggagccccgccgcgatgcgctccgcgatcatgaccacggcgcgcacccaggacaacaccggcgcgccgatgcgcgaccacgacgggagggaggcgacggcgttcgcgttcggcgccggcaacatccacccgaaccgcgccgtcgacccgggcctcgtctacgacctctccaaggaggactacttcgtcttcctctgctccatggggttcaactccagcgacctcgccaagctgagtgccggcaacttcacctgcccggagaaggtcccgccgatggaggacctcaactacccgtccatcgtggtgccggcgctgcggcacacgtcgacggtggcgcggcggctcaagtgcgtcggccggccggcgacgtaccgcgcgacgtggcgcgccccgtacggggtcaacatgacggtggagccggcggcgctggagttcggcaaggacggcgaggtgaaggagttcaaggtgacgttcaagtcggagaaggacaagctcggcaagggctacgtcttcgggaggctcgtctggtcggatgggacccaccatgtcaggagccccgtcgtggtcaacgccttggactgaggcgccgagattcgtgcgcgcgctatcgatccaagacgggcgcagatcagggtttaggtgttcttttattatttattttttgattgagagggataatattatagtccattatagagtgagaggctagatctcttggttgttaataaggttggatattttttcggaattgctgtaaagttgtcgacggttttttctccaaaagattttcactttgtggacctttagattattgttgagatttgtgatacttggcgttcaatatatagttatgtgataaatctttatctttactacttaaaaattctgtagtggtggtggtgactccaaccctgacagacacgcgaaacatgagctgtcagatcgccaaatccaactgctaagatcgatccccagtcccataccacgatcgcgcttctccccctcgatccgcctgtgaccccacccacaaacagcgcatcgcactccccactattcgtgcacctacctccgtcgcccgctcttccgctccccccactgccttcgtccaaccgccgctgccgcacagaggagtcctcggtgagaccaagtgctgccagcgcccgtcgcacctgccgccaggtaatcgtcgtgtcattgccgcataccgcccctccggcgacatcgcatcccccttcaatttgctgtcgccgtcaccatcgattcctccagatcgggcgtcgtccatcttgcctcccgttgcccttgcccgttaccgctgcggtcccctcgctctcggcgccgcatcgctcccctccgctgtcatcgcggtccgtgcctcgtcgctgcgccccttgaatcgttgttgctgtccatcgttcctccctgtgcccacgccaacggccgcccccgacgacatcctcgcagccccctctgcccaccccaatcgcccccaatgccgccgacgcatcacgcccgcccccgatgttgccaacgcatcgcgccgccgtccttctaccccaacccccaactgcaatctcctcagccttgccacgattgcgattccttgcctctcccattctgctaccgccaccgacgcggcccttctgcctcgccaaatcctcacctgaatttgacgcgcccttctgatcatgtgcctatcagtccaccggccacgggagtcatcttatcctaatgccatcagcctacccacatcatcaacgccatatatatccatctcgccgcgtacctcgccatcgtcgcaagcctattcgcccacgggggccttggatcctgccgcgtgcggaactctgtcgatgaagccaagcgcaagcgggctctcccttccacaatatgcactcgcaggtggagcttgattcggagtgcaccgcagccagaggtttgaccggtcattagcgtcgggcatcccaattcaccgatggcctaggtcatccgctagacaatggagctcaaggatctatctgatagatccattagagcaggtacaatagcgggctattagccagctatacacgtattttaatgaaataaaagatgagagagaagagcagcgggctacagatttgtagccagctgcagcacggactccaagacgcgatgtgtgtattacatgtgagaccatatattaatagtatagtaagcaactattatatgaattggctattagattagctataggtaaattagagccaacagtgggctatactattgaacttatagccatcgtgctgctgctgaggcgtgtgataacaggagaggagtcccgagattctcagtagctggcgacggcatgcagtggcgcctgtgcatgctagaaggaggattctttgtacaggtgagagcaatattaagggcccaatatgtgttcaaaatagattgagatagaaaatttgctctgcaaaatatatgaatttgtgtaccatactaccatctgcagtgtagatggaagttctaaaaaaaaaaatcagttgcaggggatgtcaaatttgcactttgtaccgtttgcaggggaccttcacccttctacttatactaaggtaaaccttccgagcatggtttttcagttttgtccgccagaaagatttctttgctaacgctgatctgatccgtccagccaagacagatgcacatgctgcgctgggtggttgtaggcaccatccgttgctggattttctaaggtattgtttagtagtactgccttcagcattgcgtcctaatctgttaggattcaatgttcgctcttttctgctattgttgggttttggtcttgtaatattgtttgtgatcttttctgctgtttacttgtgaatccggagattgcttagtgcataaaccgagatcatacatcatggaatttctgttcttccatacatcacgaaattttcatttactatgattcctcaactattaattattcttttgcaccctatgtttgcccttattgtctcaaaatttggacagtggttagtgtttagtgaacaacatgtaatttgatgattctatgtactccttctgtttcaggttataagatgttttgactttggtcaaagtcaaactgcttcaagtttaaccaagtttatagaaaaaaataataatattttcaacccaagataaatttattataaaaatatatttaattattaatttaataaaactaatttgataatgtaaatattactatatttgtctataaacttagttaaatttgaagcagttggactttaaccaaagtcaaaacatcttataaccctgaaatggagggaatactaaggtgttgtcatgacattatatgtcatctattgctcagtatagcagaattccttacttagattccactgttgcttttgtttagatttgcaatagctgaatcatgcatttgttgtgccttttgcttttctgttgtgcaaaaatgtaaaccttttattctggcaagctaaggtcaggaaaaagctggaaaataccatatgcaactagctgatttgtgtcttgtggggcgagttgcagtacggttggttgtgtcagaagattcacagggccagactcaacaacgatcgtcgagaaataggattgttatgttactttagagaagtcttgttagtggtactttagatataagtcttgttaaatcaggttaagttcagatatatattgagttaaatcaagattaagttaacttgagtttgttaaggggtcaagtctatataggagatgtaatcgtactgttatggcaactaataaactaatcaatctccaagctcatataattatcgttccccttttctcttcttcctcctacgttccctcttccctatgcatattctttctttcttgtatacagagccatcaccaccgttgtatatttctttacttggtctcagaatgcactgaacgtttctactttttatgtttactaaaatagaaagcacaaattgtttatttgacaatggtattagttgtatggagtattgtgtttttaaatttgaagaaatgaggaggttaacggtttaagatgctttgcatgaacattactttgacatttagaccttgagctcaaagttgtcttattgtccagggactcaacttttgggatgtgtttattggcatggagaaaaaaaatacaaatatatgaagcctctgacttattaagtcgttgtatgtgttagttgatggcaatgcagagctggcactataaggaaatgagggtgttgaagcaagtgtagagcaccaaacttcttctgcaacaaccctatcttccatgggaaccattgtgttatttgttttgctatagaatgagaaccattgtgtagaatttcgcaaagaactttaaccattgtgtagaattttgtaaaggattatgtttcatttgatgcattaggaatgagaagcagatgaaactatagacaatctttccaaagtattgcgtgaaaatatgaagtgtatcaatatgtaggttcttaatgttccgttccattaatcaattttgttatatggggtactaaaatgtgaatactataaacatgtgaaaattataaatatgtgacataattattattagttctatattaaatattttgttacagttgatttacactcattgattatttaccatcatttcactcagtgtgatttttccccgttgcaacgcacgggcacgctgctagtttatggttaaatttgtaggtttaattgactgttttttctactccctccatttaaaaacaaattctgattacgaatatagaaataatattgaaactgagaaattgtttatatttttatggaaggtgtaggtcggaaagtttagggttaaatattgtctagtttcaaagtttatcatcgttttatagttttgcaaatattttggtatgtaaaatgatttttttaaaaaaatactcctccgtttcttaatagatgacgccgttgactttttctcacatatttgaccattcgttttattcaaaaattttatgcaaatgtataagatataaatcacacttaaaatactataagtgataaaacaactcataacaaaataaattataattacgtaaattttttgaataagacgaatggtcaaacatgtgagaaaaagtcaacagcgtcatatattaaaaaacggaggtagtaacaattatatcgtttaacatcataatttgtaggttttgttgataacaacaaaaaattagacacaacaataaatcaagtgctgttttattacgtttaggaaaatgtttcgttactagctcagaaatgtttcaaacatgtatgcaataccgtctaaccctagccaaaacattttctctatcgcgtgtgaaatatcgaaatacattagacggagacattgaaaaatcacaaaatgtacatcattaccagtaacacgattagccccgagtgccaaaatttttctgacgtgtatctattagcttgtcaagagcaaacaaatttttctgaagtgtgtgtaaaactgtcagaaaaaaattattttcctaacgtgcttttaacaccgtcacgatatcacaaatttctctgaagatgagaatgtgtatttagtatatgaattttgtacgtaccagaaaaattggtggcctagtgggtatcatttattgagtggcaactcaaattttaacactaacgatataaatagtgaaatatagtttaatttttatgacgtgactttattgttagtgagattctaatgaacctaacggcgttgacaacgtcggaaaaattcattgtgacgatcaaacctgtgaggattaatattcgtcctcatggagactagtcatgcaaactaaaattttcctgacaagcaagttgtaacgaaattttccagatggtttctggctgtcagggctagttgagtttgtggtagtgcatgtttagatcttgcttctttcttctctcccgtcgttggatctccagcctcttcttcatgggcaaccatccgatgaagacagcgaactagtcggcctcctccctcctccgccgaagcatagtggcacgctggtgcaggagctccagcgaggagggctcctcccgacgcacgcgtataccgtcgatggatatgtctcgctgtgctcgtgttgttcgcacaatgccagcattcaggcacccttcaccataaaccaaaattcctcgaaaattaaacctttttgtcacaaaagaaatagccgataatgataattagtgcctatattagttataggctatagttgttaagaaagatgaaagatacgccaatgggaggtgcactagatctaacgtaatcagctactagaagttagtaaaattcttaaccttagtttttttttttttggttgttgtttgtcatggcgagggtcttaaaaattgctagaggtttaaaatttacccattcgacatatatccaagattgaacataagctgtcgaaagggcaaatttcaaaccaagattgaacataagctgtcgaaagggcaaatttcaaaccttgagtaatttttaagacaccacggtattatcatgtatcatttaatttttgctgttaattctttcattatttagaatatatacgtacaatcatgtacaccactatgcatatgcacactcatataacagtgagagctagtgcaccctctttttttaacacacgataaagaggccgattccaataacaaatccataaatatagctaaactctcattaaaaagagcatccatgtgtatagttgtgaacatcatttattgtatctccaggtgttatactaaagtaatactgggcctgttcggctgcactacagggggctacgatgctgcagcctcgcacagtattttatgtagcgcacactactagaaaaatagtttttagaggcagtcaaaaacagttatcgcaggcgggggagacaaccgccgctatccaattgcctgtgaaaataggtgatttttgcaggcgggtccgcgacccacctgcgaaaataattttagggaacaaaaaaaaaatccggcgctacccgcaggtgacgccgccggcgccagcatccccctctgaccgacggctctccacctctgtccggcgccgctgcccgagggcgaggggagcgccgcctttgccgccactgccggctggctcccttctcagatctgggaggggagcggctggtgctgtctgtgcccccgcggccgtcggctcctcttccgccgccggcgtctagggggaacgaaaggagaggattagtgcccagagccgccgcctcctcctccttgcgtgcgccgagacgccgacggctgccggttgctcctctccttgcgcgcgccgaccaggccatcggttcctcctcctttgacgtcgccgcggtgtcacgccctgaagttccacctcccttgctttaaattcataaaataaatcgcctaaagaagttgcttcaaattaacctagagttgaatccttaattaataaatacatttaataatcgaattcggcgtggtggaattttttttgagttccccatgctcaaatatattaacagaatttttagtggaatttttaaagccttggaaataattttaaccaattaaaaatgagcatgtgcaatatttaatcctaggaaatccgttttctttttctctttttcttttcctcctttttccctcttcttgggctgtcggcccatcctttctcccgcacctctccctccttgctgggccggcccaactcccctcccctttctctagggtgccgacaggtggggcccacctgtcggtcatcccctacctccagccgcccgcgcccaagctggcaaccgccgcccacaccgccgctttccccgcttcccgtgccccactccgcccatgctccgcgcccacgtcgccacccaccttccccacgccttaccgcctccgcgcgcgcgcccgagagggcgggattcgattttgaatccgcccctctctctctctctccaccccacgtcgccggcgccactcctccaaatccggccacctcccggcctcgcccgcttctcactcggctataaaacgccttccccgagctccctctctcgtttcccctactcgccgccttctcccgtgctctccaccgcgcccgcgccgctcgccccttgcgccgccgcctgccactgcactccggccgcgcgccgtcgccacgccacctgccgccgcctctagctccgccgacacaagggctacctcggccgccactcagttgccgcctactgccgcctccaaccgccactagccgtcgatagtgccattgccgcgccgctttgttgccgccgttggcctcgtgggtccgagggccgcctcgtccatcccgcgcaccccgccgtccgccgcttgccgccggtgttcgccgtcgtctttccccactccggccaactcacggtgaggcgctccctcctgctcgtttctcctccctctcccccctagcgccgggccgcgccgctgcttcgcccgtgcgccgtcgccttcggccgacgccgctgccacccgcgccgccggttgccatcgccggcgaccgctcgccgccgccgccctcgccataaccggccagtcggccttgaggccgagccgagcccggccggcacctccctcccctcccctttgagccaccgcctggtgggacccacccgccaggcgcctcctcccctcttttggagccgctgccagtgggacccaccagccaccccccccccgctgacgtcagccctaggcaatattgcacaataaataattaatgacttttttcttttatagtaaaaacacaaataatcttcttaaattcataactaactagccacatggttgcgctttgcgcaactctaaatacatgtttaagaacctgtgtcaatggcatccacccatacacaaacacaatcatctacgtggccaagacccctgagtaacaacttgatcctaagcatttatattgtgatgcgtagtagtacattataatgtacatgcccacaaaaaatttgatcccaaatctaataaaataacaaaaacaaatgtagtagctttgtgttcttccaccaaatgcatggtggtaccgtggtattcacctggaaacataaaaaatataatctttttaagagcaaatcatagattagcaggaccagttgatttatgttcttccaccaaatgcacgttggtattcacccacaaaaacaaaaagtatgaaattcttatgagctaatctcatatgagaaggaccagtaaggacatagtctcatgtaaaaatgatagaaagatatgctcctcaatttgtacaatgattaatgagtatggagtactacagtattacagatatagataggtgtcatatgataatccaatatctaaagctctgccaaatattccaatagcagtatgcatggtattgcctttggattgataagaaatgcacctaggcctattaggacagtaaagaatctacgggttcgtggaaattaccataataccgttaattaaacttctaagcaagatttatgggtggtgcataatcacaaagctagcaattaacgtattataattctttcttgtaaatatgccttgtttaattttaaacgagaacccattcttcctgtcgacacatcattcacacttctacacacacacaaaatatcattgaaactcattgctcttatagctcaattctatgcttgatcaagtagtctaagacattttactggcacttggaaaaataaggataggtgtaaatattacttaccgatggtctgtacagataatttatttctccctcctccgctgcgtacccaagcataaggccccaccactgatgtcgatgatttaattacaacgctgcagccgtgcagtgcctgctgatgcaaaataaaataggatcagaatgaagcatcctaatacgggccgatgttggccaaaactacatcttgtgtgagttaaccttttttgtttaaacagttagggttatccctaaatcaacatgtgctactgaactttctactgttgcaggcgcagggaaaaataatttcagtcgagatgtcttcagtagcagcgatataaataacttctagaaaaaaattaaataataggaatcaggaaggctataccaactaaagctggtacccgaataattatcctttttaatagtagtgcacacaatttagcaagatagaagtgtatacattattgcagcccttatgtaaactgctgaaatcctttccatgagcaaatatttttctaagtcagtcataaatgaagatagtaatccactctccatgaatagattattagtgtaattaagcattggtgacttgagctgtacagtatatgcatctgtaaattaatactaactataatcgatttacatgagtctctaatttgtctggtccctctgaagctaaagctgggatttttcttttggtgtatttgtttgtgattcatgaaacatttagatacacttcatcatctgttgtgcgataccttagagaatcatttactttgagtataggtaaacagatctacattctacaaaatatttttatttgctgatacttgcagttctactcagttgtcccaaacttgattttctcaattgtaattatagccaatcatggagcctaaattgatacgatttttgggcttatgaaataaagcctaataaagataattaatattggaattcataaggtgcatacatataatacaaatcaatatagtagtatttgaaaggctaacatccaatcaacagtcaagaaaggaagatagagaaggaaacagagaatgaggaatagagaagagagtgaccttggttgttctgccctggataccgatttggtgaataggtgtggacgcagctcctgcggataccctcctcctcgccatcgctattcatctgtcaaccctttccccccttcttcagggtagcgggagattagaggtggatgtgatgcgccggtgccggtggggtatacggcggcggcaggggtgggatggagccgcggtgatgaggggatgagtaacgccggcaatggagacagagaggactagagggggaggtagcggcggcttgggagaagaggcggcgcgcggcggctgggcctcaggagcggaggcggcgtgaagacgagaagagtcgcgttctttcttcttctttttttaccgcagggacgtggaaggacctcgttgtgaaagaaatttctagaaggaataagaagatatttcgccgatctaggatctaacggcctgaaactttctgaataggaatcggacggtccatattttgttgatgacgtggctcaatgttgttttgagaaactttaataatttcactacttttgattcatccgagctccgtttaagtccattcaagtctcagtaaattcataaaaaatgcatagaatccattaaaaatggtgttgtttcctgtttcagtagtcttatagcatgttttgcttgtgtgctttggttgtcgcgtagatttcggttgttttgtcgatccgcggtttctcgaagacgttgctgagacctcatcagtgcaagagcaaggtaaatcatgcattacaattgatcatattgtacccaccttacaaatgtcccgcatttctattaaatgttgcattgttttacaatatcatatgggatgggtcctactactcagccatatattgtttacctgatgccattgataacttgggtattaaaatgattagatgttggtttagggaatgcttagccatgcttagttcaactagtacacaaagggggaatcacattaatgcatagactttgattattggtatagctttggaatagtaccaccgcaatggtgttagctaattaaaatacactacatggtgggctgtgggtgcatggttttgctaatcgtgcccatgacgattaaggaccggttcgcgagatgccctggaagaacttatcgtacttaccataagccagcgtgggcaacggctgggcttgtagtgtagctttcctctagccgacatacccaggttagggtgggtatgatggagttgggtcggccggggtgttcggttgatcggcttccggattcactgtggcacgagaggggggctgcccgttgcctgctggggacgggggcgaaccttgaggtgtggtgcgatcggttagagggggttatgcgaagggtcctatcacgacctctttccggtatgtcgtggtggcatgtcggcgcacagatacatgtcgtggggctgtgtcttgtgggtacagttgtatacctctgattagagtaaaactgttcgaatagatgtgcccgcggttataggcggtcgaccagattcaccgttgacggagctcgtggcccctcaccgggagaccgcgcaggcccccctttgccagttcggccgggggcttagggtgagatctcaagctctctctctctctctgtatgtggaaagatcacccccccgcaagacacacgagacacggcgatgtatacaggttcgggccgctgccaagcgtaataccctactcctgtgtttttgtggatttgtgtatggacaagttacaaaggattcacttcctttcccctccgccttccaaaagggaaaaaagtcccctctctaaatgggcaaggtcctccttttatatctcaaggggataccacatgcccctttctctttccaaactggactgttctttttctctttaatgggcggagatcggtacggtttccatccgggagcccttctgatgggacatcccacacctacccccacctcccccgaagacagagatgacgcgggaccgtagctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacagtagcccccggcgttatgccagagcaatttcccttctcaagggaagcggtcaggtgtgacgccacccctaaagcctggtgacaggtgggaccggtctccgtagttgggcacaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaacgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccgttgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccaccattttcttctttcttcatggatgtcctggagttctacgatctccagatggcgcacctcacccccaatgcggtgatgacattggccatcttcgcgcacctgtgcgagatgttcattggggtgcgcccttctcttcagctgttccggtggttcttcaccgtgcagtcggtgtcaccgccgtcggtggttggcggctgctacttccagccgcgggggccggtgttgaaccgctacatcccttgcgtcctccgcaagaagtgggacgactggaagagcgactggttctacacccccctcgccaacgaagcgcgcctccgacttccaagccaggccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccctgcgtcgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccttcgcaggttcgtctcactctcattgcaaccatctttctcccaaaaggaagttttttcttactcattttgttcgttttctggttttttcttctgcttcagcgatgtcccgtcgcattcctcccgccaccccaagtccggccagtccgaggccgaagatcctgcggccgcagaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggttcgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccgccgctgcccgagagcggcgggtaacagaggctgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctacgccgaggaggagtgcgcgctccgtctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcactggagcagcgggctgctgacctcgaggagcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggcccggcatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcgcgggtcggggatgctgccgaccacatcgtcaacggcttcgagggctcggcccctcggctcgcgttcgcccccgactccgacgaggaggggaacgccagcagtggaagcgacggtggcaacgaggccggcgacctgggcgcgtcagaatgagcccccaggcccccgccaatctccaattttttctttttgtatagatcaacttaatctgcaatcaaaaatgatgaaaaatttctatgttaactttattttgctatacatatgagttgaggatgatttgtgccgtggttcttttgcattttagcttgatttaagggctcgtgctcaagtccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaaccgcttttattgaaatgctgaaataagaaaagtaagactgtgcatgtgtggtagcccccggctaaccctgcacacccgaggggggtgcggggttagcccgagcccgaaacctgacacccgacccccccttcccctcaggggtagaagcgacgaaggtgctcgatgttccacgggttcggcagttcagtgccgtcgcccgtggccagccgtacggagcccggccgggggacgccgatcactcgatacgggccctcccacattggtgagagcttgctcagtccagcacgcgtttggacgcggcgtaggacgaggtcgtcaacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaagcgggccgtgatgcccttaatgaatttaagagcagagtgtttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggaatgatctgcagggcctgggccggctggtggatttgcttggcgtggaactgacacgctctgcatcgccggaccatgtcgactgcatcattgagagctgttggccaatagaacccttgacgaaaggccttgccaaccaaggtgcgcgaggcggaatgggctccgcattcgccttcatggatatcggcaagaagctcaacgcctcgttcctgaggaatgcatttcaggaggattccgttagccgcacgccgatagagggtcccttctatcagcacatagcgtttggaaatgcgttggacgcgttcactcccttcgcggtcctcaggtagagtcttatctgtgaggtatgcttggatctcagagatccaagcaatcaatctaagggagcttggagcgctcccttcgggtcccgagacctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcatcggcaatcatattatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggcggcggatccccagtccggccgccactctgagtccggcaaggagtccctcatactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtgtgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcgttcttcgtccaagtggcctctcggggcgcactcgtcttctgtgccgatgtcctcggggtcggaggatgacaggagcggtcttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcgcccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgctcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacgcacacttatcggggttcagctttatgcgggcggagcggaggttctcaaaagtttccgctagatctgaaagtaaagtttcttggttgcgcgtttttacaaccaaatcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcgtctagaaaacacaaaaggtcgcaccccgcagtggagtcgacggtctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgtgactttaaggtcgccacggacagagatggggccaccagggcccggcatcttcatctggaggtaggcgtagtggaccgccgccataaacttcaccaacgcgggcctccccaggaccgcgttgtagggcagactgaggtccaccacatcgaagttcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcaaaagccgcgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgccttctgtcctcctcccacttcctcgttcgctcagccaggtttttgactgcacgacagtccgcgagatcgtggagggaggtattgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtccgacctcttcttcctcctcctgtcacgccgccctgtctgagcggcggatccgggggcggccgaagctgtcactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcagaaccgctgaatgtacgagcgaagcgactcatcatcgcctcgctgtactgcatgcaagtccgcttcttcgcctgggcgcggatatgtgccttggaaattcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcacggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcaacggcgtggattcggctccccgtcgtcgccgctcacactcggagagaggtcgtgcgcttttccttgctcggccattaggctgaacaagaaaaacttggcgcacacggaagagtctgagagctcagaaaacacacactgagccccctacctggcgcgccagatgacggagctcgtggcccctcaccgggagaccgcgcaggcccccctttgccagttcggccgggggcttagggtgagatctcaagctctctctctctctctgtatgtggaaagatcacccccccgcaagacacacgagacacggcgatgtatacaggttcgggccgctgccaagcgtaataccctactcctgtgtttttgtggatttgtgtatggacaagttacaaaggattcacttcctttcccctccgccttccaaaagggaaaaaagtcccctctctaaatgggcaaggtcctccttttatatctcaaggggataccacatgcccctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacaaccgtgattagtcttacccctagttagctatcgaactggtgtagttcaggtggttggttgggcctgttgcaacgtggtgtagcgttagacaatgattggttaatattgattaattactacaactgttttactgctttcaactactgcttttaaatgctagctttatgcaaaaggacctttagcctcccttggatatatcctgcatcatacctcctcttccggtatgacttgctgagtatagtgggtagtactcagtcttgctctcttttcccccataacagagctgaagatcttcctagttggagctgtctcgttgaggttggttttgtcgctgccgtcaagtattgcctgtggaatggagtcgcccgctgcaggagtcaagtcttcaggcttagctcgcttttatcttttccgctgcatctgtaatcttttatatttttgtaagacgtggagctgtatgtcaacaattgtcgtttgtgtaccctggctggtcctggacaggggtttaatgcacattcagcttagaaattatggttcgtgagtttctggcgtgacacgcggcccccttcctcccgctgccgccaacctcccgccgccgccaccgccgcacgagtggtcaccgccctccccccgccccctcaggccagatctgggagggagcgagggaggggagcgccgcgggccaccacccccctcgggccagatctggaagttagggaggagccaggagccgccaccgcctccaccggtagccactgccctccgccgccaacctcccgccgctgccgtcgctgccgccgcacgcgtggccaccaccctccccccgcccccctcaggccagatctgggagggagcaagggaggggagcgccgccggcccccgccctccgccgccgcctccaccggtagctgccgccctccgccgccgtcagcgtcggggagaggaggagaggtgaggggagaggaaagagctgagagctgaggaagagaggtgaggtgaggtgcgggagagagctgagaggtgagggaaagaggacttagaaaaaatctagcgtatgtagcctctatttatattccctatgtattttcgcaggcggaccataaggtatttttgcagccgaccgtttaagtggtccgcctgtaaaaatggattttcactggtgggcagcgggtttcaccctaatttacatttttgtaggtggctatttggctccgaagatcatgtccgcctacgaaaataaatacccaacgtcggcaaaactgtttttctagtagtggcagctgcctaactggttgtgttacagccgctgtaagatgctgccgaacatagccacgggtacctaggtggatttaaataaatgttttttaagaaaaaatttgcagatgtttattcatgccgtttgttgtttacaacattttcaatatgattgagtcatgttcgcagttctacccctccagggtaaaataacaaaaagaaaatctgacagcgctcggcttcagttttccattacaaaatcgcatctaatttacgatggtaggagcttttcaggttaattgcaattgtataatattattgtagaacacaaattgtatacgtaaagttgagaacgatcaatcactcatattgtcatcttagaaaaggaagaatcctacttaccccataccaagtgtcattattaaacgtctaatccaattcagatctgcaacattccacaagattttcccacaaagctatgccatcagatactacctgcccctgtactttcggcaatacgtttaccttatccactgggcatgccgacgccattagtgtcactgtcatgccagcctcacactcattccagctcaagctaagcaaagctaaccaacacattctttctagcattatccaaatccggcactgcgagcacttgccacatctgatcacatcaagagattaaagctaatcccaactcagatgtgatgcatcaaattttatatttttgggtcacactcgaacacactactcccaaacacttgaaaccgacatagtattgggtggtgacaagagattgctacaggcccagccattcattgtccttgctgtctggtctcccactgctgaagttagctggctgtttcatggataagattggggggaaaggaacatagccaaaaaagggaactggaaagggagaaaattgcattttgtgtgtactatgtgagatgctgtgatctgtggttgtccaaatatttgtttggcttatcctttgtaacggtttttgtgggtatgatgaacttgaggcatgaaagggcgatatctagaggttgtttgattctttgtaattgtttgtgtcgccaatttgggaatggtaaagatttgcccattgccaaaaaaaaaagaagcaaatgtgcttgtttggattgctttataagtatttcataccaaataatttgtcaatgacaaaagtttggttacaaattaaatgagtgacaactttgccatgtttccctaatttttacttcccctttctcgttgaatcgtctgataaatttaactgtttcatattataggtcgtttgacttttttttcttagtcaaagttctttaggtttgatcaagtttattgaaaaaattagcaacatctacaacaccaaattagtttcattaaatttaatatataatatattgtgataatatatttatttttcatgttcttgtactagatcgcacctatctacgatgtttctataatgtagacacaatttactctttttacttctttgattacaacaaatgaaagaattactgatatgtagggttgaaagtgattcggatagtctccgtccgaccagacctttttttcggattcggatagtttctattggatatatccggaaattttcaaattcggaaatgaaaacgaatatgatataggtgatatccctcggaatcatataatggtcaaatactatccgatatttccatcggattcttatgcaaaaacatgtttttcttttctttacttaggtggaacaaaacaaaccatatgaaaaagaaccaaggaataacaatcaacatacaaacaaatggaaaaattcaattctgaaaaataaccactcgaattttcaaaaactttaaattcaattctgaaaattttaaaaagagtaaattgcaccgactgtacaacaacttgacaggtggtgtgtgatacaatgtaagaacttgagaattgaacgtctgagtgcaacaacttgtactagaacgcacccacttgtcaagttgttgcactcagacattcaattctcaagttcttgcattatatcgcacaaacctatcaagttgttgtacagtcggtgcaattgaattttggtatatcaacttggctaagcatatggtaggcgagttttttttcacgatgttaatatgccattacatagtaatcatacggatattaccttataatattgaatttaatctttaagaattatactgcatattgtagtacaatttacatccaattaccttatcaaatatcaaccaaaatataataatttctacatccagtttaattgactttttgttattagttattaggataaaaatataaatatacttatataaatatacttatataaaaacttcataagtgatcgtataaattcaaaataaatatttaaaaattgaatttataaaaaaagtactccaaataattaagttgtcgcataactttttaatttattgtatcaaaatcgtagcaaccttgcaaattgttgcatttatacgatcacttatgaagtttttatactaaattgtacatacctgccaagttgttgcactagaacgctcatttctcaaattattgtaccaatttgcacccacctgccaagttgataaaccgtagatacaatttactctttaaaaaacttttaattcaaaaattgaaaagtttcagtttgaattcaaaactctcaacccatctttaaaaaattcaactcaaattctagaatgtttaattcaatttcgaaattctcaactccaattgaaatgttcaacccaaaatttaaaatattcaaccaattttcaaaaatttcaatgtgcctgcgaaaatttcagtgatacaattaatttatttgtttcaggataacataaatttgtatagaaaataaacacaacattttctatctcccccttgcccttgcaaatagagataaaatttgaaaatgttgatgttttgttttttaaaactaatggctacatctcttcctcgatttaagaagcttactttgaggggtcttgatattttgataattattcgtcaccgtattcgtttcgattcgtattcactccatatctgtattcgacaatatttgattatgttttcgtatccgggtttctgattccgatttcgattccaagaaaaaatatgaaaacaaatatgatagagctagtttccgaccgtattcgatccgttttcattcctactgttatgtttgtttaaaatatacttcaacaatattaaataaataattttagcttctgcaaaattactaaataaaaagtactccctccatcatgtactcatttttagctcattccatttgtcccaaaataaggttatttttagagtaatcattgtattagaatttgtgaaaaatagataattcttatattgggagtcgataaattgaaaaataattgtattgagatttgataaagtaatggtattatagtgttttggttttgtattggtatgtattggatggatgaaaaaaataaacttagggcctgttcaggtttctgccaaaataaacctttctaaaatttggcaatgtcaaaattttaataagttgataacattgccaaattttggtagaatcggttaactatgttattgctaaaattctttagacattaccaatgtttggtaacgaactgaatacatctacatgtttattaatttttttaaaagtaatatagttcgaaatggtattaatctgaacaagcttttaatttgggagggaggatgagggagtagtcaaaatgtaaacagcaagtcagcaacagcgaacaatcttatctatcgtgaaacagaggtgtaccagcacatgcatcatccacccagacccagagtgtcccagttaactttagaaaccagaattaattacgccagctaattcgtggctcaacagcaaataaatgaccaattagtctggaagggtagcaagtggcaacggtggcgaggtttagaaaagactgaaaatgcacgtacgtacgccagtattacatgatctgcaactgccacttaaactacgaatttgtaccatgccagatttactgacagcgaatcactttttttttctctatggagtagtgctaatataattaacgttaattaatgttgggtggagagtaattaagcatgtctgcttttgtgtactgtactagctgattccagagcattggcgtccctttttccgtcacagggcattggcggcacatgtggtttaggtaacctcacaccgtcacacgtactaatgacatggtcctaacacatggtagaatgataggctagtctactggtcattccaaaactacactttttggctttgtttagaaaaacaaaatattttctctgaccaaatatatgtgacaagagcattaaaaaattaaatttaaactcgtgtcatatccaaataaaatttaagaatattttttcacgattttgcatttacatacgaagggcatcatcttttcgcttatgtttatccatatcagcaaaaatttaaattttaacattaaatttggaactgattttgtggttttttcatcgaagtttatttttcagtcttttaattagctaagacacatatataaaatttttatttacttttcatttgcaaatatgttgggctagaattttgaaaaaactagcggaaatatctgcgggttgggatcgcgccacccaacatatgaccaaaacttcttgtttttttttttactcacaataccatgcgaccaaaacaccatattaacaccgaataaaaaaacaccatattaacacgagaaggttagtttaggcaatgtgaacgatgcagtcacgcggataagctatttgtggtaagcattcactgctggttggtgaactatgttaaatactcaatctatttcaggttataagatgtttaaactttgatcaaattaaactgttttaagtttggccaagtttatatatataaaaaatattttcaacctaagctaaatttattataaaaatatatttaattattaatttaataaaactaatttggtaatgtaaatattactatatttgactatacacttagtcaaacttaaagcaatacatgttataacttgaaacggagggagtagttcatttgacgagttaataaattcattcttatccaacatatattaaatcaaaagagaaatacgagaactaatagtgtgtaacaaatgataaacaccatgtgttacattttgttttgtcccttttcacacaaaacagcacagaattgtcctaggtacatatagctgtatagggcgtgctgtacctaaaattgtaaattggcaactggcacgtttaattttttttgaactttggcatgtttaattttagtacaacacgtccagtaggattctcacgtgatgtacactccatgaggaataaaaaaggtgaaaggtcaattataccaatcaaattttaaaaaatatgaaaccaaataaaaaaagaaatggataacctccagcacagatattctcatctcaccgaccaaattccccaaaccccaaatcaaatccaaaccgaaacctctttcctaattaaacgaaaaacacagggaccaaactgtaaatgcccaccactccctcccctaaacttcagccatgacatgagtgctcctcgcattttcatcagtggagaggaaggaagagaggaaaccccattgaggaggaggaggagatggtgaggcggcggcggcggtccgtgctgctgctcctcctcgccctcacggtgctctcgccgctcgtgctctacacgcgccgtctctcggcggcgctgaaccccaaccgtgagcgcatcttctttttctcttgttccttttcttttctttctttttcggtgtaattttggtgtagagattgccttctgtcgggcggtttcttgggcattggggtttatggtgttaccgtgtgatttcttgcagagaggagggatttgcctggcgaaatcgtgaatcaggtgcgtgtttctcggggttcttgcgagggattcgggagatttgtttggattttgatgagaacatttttttatggatttttttttgttttgctagggccgtggtgttaaggctagcaagctaaatgcacttcctctggtaaattttgttattgctcttcgtttcttcattttttgtttattttttcttggcgagggcgacgaataaaactggaggtttttttcttttggggttcaggaaactgtgggttctttgaaagaacccgttggcatcgtcttctcggaggagtcacgcgaatctgcaagcaaatcgaccgaacccgatagccaaggtctgggattttattttcttggtcctgtttgcatcttgtgttcctaggtccatggtatcgctctgtgaaattaaactatgatattttgagtttgtgctctgagttcgtttgcacgccaactgttcctagaatttctattgaggaaggcaggggagcacaagaaccgggtgctctctgaggccacggctgctgatagtgccagatcggaagacgatgacttgatcgagcaagtgacaagcaaggatggagaagatgatggcttggcgacggtgtcagttgatcagcagcagataaccacggcatcccaacagcgatctgcttctgaggttgatagtttattattgtcaagtttttatgtgcatcttaccaaatttagttatgttgtcacctgtggattagtcatctggacctttgggacctccgcatgtgctttagcttctatttgggattgcattattagtgttggggccaaactctgaatttgtggtaggtagggaaagtcttttttgtgcctattatacctaacttatcaatatctggtaatgttcctttcttgtgaaaagacagtggctactcatatcttgacgtatctttcttttcttgtcgtagtaggtcaaagtacctaagatgcaatgatgcattattttcaacattaaagaatgtgttggtaaattgttctgctcatgtcgttagaggaaaccatattttttagttgaacatgaattaatttatgcaatgtagctccgtacaaagtaactcagttgttttgttttcaaatgtgtgggtaaaatgctgtaagggtgtccttcagaaaagatgatgatcatagtttatctgacaatgttaatgcacagtttactgtaacaagatttatgctgttaaacaactagactaatgattaatcatggagtatgtcaagattcaaagcatttatgtttatcaattttgagaatgtgtgtatttggttcagttacggtcttctgcttcaggctaaagttaagtttctttgttatggaatgttctttgtgcacgcttttgttaatatgcttgcctctttcagccattccttaactttcctgtaagttaacttgactcccaatattcttgcctttcatgtttgtccacccaaaccgtttcttaagttgagattcttgtaccaactttgcaaggcatccctaaagtgtagaatcttggcacctgatgtgaagtccatttcacattatattccctcaacctttacaaatacaaggcacatagcaacctagacaaagtttcgttttgggaaatgaaactaccagacatttaaaaggctactcacatgagcacgtgcacacacattttcataattccttttgttgagttgactagaaatttctagatttggtagatctgttcacatgtttgtgcatccatatgctggggtcacctaaactgtagcactcatgcagaatttgtgccattttattatcaagtaatggtatcataattctgttcttgaatttcctttttaacaaaattcatttgccatatgttgagataatgatttcttgctaaatggtttcttttttattgcatggtcttctatttacaggcaagttcattggagaatgtgcctgaacagacatccatggaaaactctctggaaggaaacaaagatggtgctttgcttgatactagaatccgcaatatcagggatctgttaatcaaggcaaaggtctaccttggtcttggagccattcgagcaaatccccagtacctcaaagacttgaggcagcggattcgggaagttcaaaaggttcttggtgatgcatccaaggactccgatctacccaagaagtaagggtttcctatcctgtccgattgatgtatttaacattgtagctagttattatgttcaggatagcagcctcatcaattgttctgtaaccttttcatctgtcttgatttgatcagtgccaatgagaaggtgaaaacacttgagcagacactgatcaagggaaaactgatgcaggatgattgttctgttgttgtcaaaaagcttcgagctatgcttcactcagctgaggagcaactgcatgcacacaagaagcaaactgttttcctaacacaacttgcagccaaaacccttcccaagggtcttcactgcctccccttgaggctagctaatgaatattttttattggatcctagccatcagcaattcccaaacaaggaaaaacttgatgaccccaaactatatcactatgcattgttctctgacaatatattggcagcagctgtagttgttaattcaacagtgttaaatgccaaggtatgtaatattctgtcctagtttgaattacgctggaagatgatagcaagcatcatactgagtagattttattttatttgcagcatccttctcatcatgtcttccacatagtaactgacagactaaactatgctccaatgagaatgtggttcctctctaaccctcctgggaaagcaacgattgaagtacggaatattgaagagttcacatggctaaatgccagctacagcccagtgctgaaacagctcgaatcacaatcaatgattgattactacttcaggacacatcgtgcaaactcagattcaaacttgaagtacagaaacccaaaatatctttctattctcaatcatttgcgattttatctacctgagatttacccaaatctccacaagattgtctttcttgatgatgatgtagtgataaagaaggacctaaccagcctctggtcaattgatatgaaggggaaagtaattggtgttgtagagacttgtggagagagcttccatcgttttgatcgttaccttaatttctcaaatcctgtcattgtgaagaattttgacccccatgcatgtggatgggcttttggaatgaatgtctttgatctggctgaatggaggcggcagaacataactgaaatctatcactcctggcaaaagcttgtaagattcacatattctttacttccttgcataaataaaagtacttgctagaaatatttctatctattgaagccaagatacttcttaacattcaagaaatcgtgttgtttgtagtgagtagttagtattgaaccaatactagcttgagggctgtatgcctttatccctgtacgtaaagaatgtgacagcgtactaaattttttttgaactgctacatggctggtttttatgtacaatgaacatacctatttttccgcttaaaccatgtatcaaggcttaggcccactttgattcaaaggaaattcataggagttttagaggatttcgttcctataggaatctttcctatatagctctttgaatcaaaggaatgaatcctatggaatcctatgaaattcctatggaatacctaataccatgctagttttggaggaattctaacatgaggttttacctcatggaaactttcctttgagtctttatctctcctctaattcctgcgtttttcttgtgattcaatcaaatgaccattcctgtgttttgcaatcctcagttttacacttacattcgtatgaaaatcctgtgtttttcctattcctacattttctcaatcttgtgtttttcctattcctacgttttctcaatcctgtgtaatcacttgtaatctatgaaattacctttttagaaaggtttgtaattagtgtagaaattatttatggaaatgataactaaaatatagtgtgtatcataagtgtcaggtggctttgagtgcttttagtactaacgttgagttgtgtactttcatgttcattttggttcacatatgtactgaaatatatcaatctttgcttgcagaatcaggacagattactatggaaacttggcactctgcctccaggtttgattacattctggaataagacgcttcccctcaatcgttcatggcatgtccttggtcttggttacaacccgcatgtgagcagcagagatattgaacgtgccgcggtcatacattacaatggcaatatgaagccttggctggagattggtctgcccaaattccgaaactactggtcggcatacctcgattatgaccagcccttcctgcgggagtgtaacatcaatccttgaagaaagatggcaccttcaatgatccacactgacataaccaatagttttccccattcgtgggtcttgtgctctttagtttagtttttctagtatttgattgatttttttttaattgtagatgtcagttgttaactagatttccttgccacctgtcctttgtatccctacttctgcataactgcagatatggttgtagatgttttgatattacattctctcctggggcaggaaaatgttaaatagtgtgattctcctgtgtatggctttttaatccctacttctgcataactgcagataagttgtagatgttttgagactgcattctttcctggggcggaaaaatgttatatggtgtgattctcctgtgtatggcctttttatctacctgaaagtttgttgcattgtcacttgaaacttatggaagtgtattccagtccccaaaaaaaaaaaatgaaaactggatattacaccaaacacgacaggttacccaactgtttccaccatatggtttgccggacgtgagcacatcgtgagtaaagtctagctcagctatttaacggtgcatttggatgtagtacactacttgcttgggctctggacacatctttgatcagatttagcaagttctccctatgatgtcaaatgaccgtatctaatccttgcagattattgggatattgatttaacttcactgccgatccaaagggattgtgtacatcttttctttatccaaaattatgcagccgaagtaaccgatggtgagatgaatagttcacggttaaatgaagggagatgaagccactgttttctaaaccgagccggattttcctggaccatttttatataatcttcttcgtgttcttattagtgcatatttgagacagtttagtatttttggggaatttccaatagaattgtgcatctgtttattaagactttcagaaagaaataaagaattaataggttttcaatttcaaaattggatatcatgccgggggtgaccgaaatttcgaaaatttctggctgaaattttttgaaatttgattgaatttgaataaaatgtgaccaaattcacaataatttgcaaaaaaccgaaaatttcgagcgatatttgagcatgccggtggggggggcgaaattaccgagatttcggaactttcaaatcctgcgtcacaccacaccaccaccacaatataaggaaacacggccacaccgagaaccttcaaaacaacgtctccaaaaagattacaacattaaaaacgccaccatcgctcatcccgaaacgatattgttttctcctagaggataacattaaagagggggaggaaggcacctcgacaaccttctcaagagggttacggcggcaaaagacgtcactgctgtcggataagaattgggctaaggttttgtcccgagccaccggcgcggggacgacgcgacacacgaaggggtatccgacagcagcaactctaatgagatggaatgatggatcgaaccagacggcttttgagacagtttagtctttgttccaattaattaagcatgacattggggtattcacaagttgagtgattcagaaactaatgccagtaatcggcagctcacttataccacgtacagaatccactataattaagcgtcaagggagaggggaaaaaaaaatcaaagcaacaaaatcgtctaagaaacgtacatgaaggagaaaagaaaagaaaatcgtctaagtagcataaagggaaaagaaaagaatcacaaattaattaagctcagtgcacgacacattaatcggagctagctaagctagtgtctttgttgcttgctaggtgcatgcttgccaagacagcatgcaaaaaattaacgatctcgtcacagatcgtcgtcatggggctacgggcacggcttggggttctggaagccggcgtacttggccctgacgttctcgcacttggacgacgagacgccgttccccttgtaccgcaggtcgacgtcctgcagcacgacgccctggcacggcaccccgcacttgagcagcaccgccacctgcgtcgtcgccgtccccttgatgttcttgaactgcacgtccttgatcgtcaccccggacacgaactgcacagttcgacgacggtcaggccgatcgatcgacggcaatggcgaatgaattaggaagatgaagatgcaccttgtgctcgcagttgtagtaggggcagtacttctggtcgatgatgatggggttctggacgtcgttcatgacgaggttctcgaacagcatgtgggcggcgttgctcttggtgggggagttctcccacgtcttgatgcggacgccgttcatggtgccgtggaaggtcatgtcgcggacgtggatccgcgtgacgtccccctcgccgacgtaccggccgaggctgcccacgctcatgccgtgccccggcccgcagtggacgcgcgccacgtcgatgttgtcgttcccctgcccgatggagatgcagtcgtcgcccgtcgcgatggtggtgtccgcgatggacaccccgttgctccgctcgatgtggatgccgtccgtgttcgggctgctctccggcgcgctgatcttcaccccgctgatcttcgccccgctgcactgcagcagcgccatgtggaagaacttgctgttcaccgacgccacgttctgcaccaccatgtttttgttgttcacgaacagcacgctctgcatactcgccattataatgtaagcttaattagctgcacactctgctaatggcgatgatgatggattgacgaaaggaagaagcaagatgctcacggtggggaggactttgcagtccttgcggatggggcacttgttgaagggccaggaggcggcgccctggccgtcgaaggcggcgccgttctggccggagacgatgaggtggttcacccacccgaactcgacccagtcgttgccgaacctcttcaggtcggtcgccgccttgagcgtcccctgcaaaacgcacccacccaccacacaccaccacggatcgttcgatcgatggatcaatcggtcagcccagccccacgtacttgctcgatcgagatggatggatgcaaaatgcaactgcatccatgtcacgtagtggccggccatggccacgggaccaaactgcctgctggttggttggtatacagtatacttgcctgcatgaggaaggtcatggtggtggccttgctgcaggggccatggaactgcaccggcccgatgtagtaggtccccggcgggagcaccagcgtcaccgccccggtcgccgcgcacgccgccttccacgccgtcatcagcgcctgcatgtcgcggacgaacacctcgcagttagccaagaagctaggggataattcaaccaaggagctagcttgatcgatcgattgttcctcagctaccttgctgtcgtcggtttggccgttccccttagcgccgtagttcctgacgttgaacgtcgggtccccgtggtaccccaccaccgacgagttaccggcggcggacgcgacggcggcgcagtgcccggcaacaacgacgacgacgacgagcagccgcagccgcgcctccatctccacagctagatagcgcacaggcacaggcacaggcacagcactgcggcgcggggaccgagcacacgcagagctagagagctagctatacagctttacaccgccggccgccgtctccttcgtcttcttcctcggtcacttgatctcagccacagtgagaggcatacactagttgatttcactcggcggcggcggcagggagatgatcctgatgatgagatcttgatgggggcatcggggatggaggcacagatcgatcgatcgatcgatagagagagttgaggggggtgcggagtgatcaacgagagtggtttttgtggaggaaaatctggtcttatagcggtcggaagggggctaagtttagagcagcatggagctcttcgcgcggcggttgtgccgtgcgggcggtggaggccgagcatattccactcgttctcactagtgtgtagcgatctgcatgagtaagggaggggagtagtagtagcccgaggtgccaagtgtaacctcccactacttgatcgatcgatcgctcgcgcgcgcgctgtggatttttgatttcattctggtcaaaacacgatctcaaccgaccactaactttagaccacggcccaattacccttgcacggtcttttctctcttttttttttaaaaaaataatttttttgtgtgtgtgagagaaagagggagagagagggggaccgatgtctgtgcatgttagatttatttcttgtgtcagatcaagttgacacttgcatttgtgtacgctagctagtgtcaaccgttgcataattgttaatttccaatatgaaaaagaagagggtgaattggtgacattgcaaatatggctatttaggtaaatgatactacagttcgtctattcgtaactgtgttattgaaatctattaatttattaaagtaatagaaaaagaagactccacgttctctctcatggtctagaaaatcccacattaattgaaggaaaataagaaaaaaaataaaagtcaaatcctagacggtaccgcattaactgctgaaaaaaaaagaaaaacaaaaaaaaaatcaatcggacaccctatactatagattgcttatctggattctttttcaatttagaaatagtattttcttttggaaaataacagtcatacatggttatcaaagtgaaacaaatcagaaacaaaaatagagtaatgcatatgtttctattccaaattgtactctctacatacatgtcaaaaaaaaaacatagacttaccacctcgttcgctcttacggcctagaaattaccacgttaatcgaagaaaaaaggatggttatcaaagtgaaaccaatcagaaacaaaagcagagtaatgcatatgtatctatttcaaattgtactctctacgtacatgtaaaaaaacatagacttgcacgttcgcttcacggcctagaaattactacgttaatcgaagaaaaaaagaaaaaaaacaaacgggcatgtattcttttggaaacgtgacaaccagagacatactcatgcattgtataggtttaggaaactaatcacaactcttaatcggatgaaaattagaagagaaaacaaacggacaggattgttttttggaaatgtgatataacaataaatattcgtgtatggttatggtgtaggaaacggacaacagtaacaaaccaatcataattagattcgtacatggaattagcatccatgtcggtatttatttatacgctttcgaattgtacacgatttatcccgtagtaataaatagatcgatactcctagcaatgaaagcaaatacacaaaacacccataaatcttctagccgcaatcagctttgccaacaaattagcaagacggaagttttgcagccggaatccacttcattaacaaattggcacccaagaatgccagaaatcttatagcaaaggatcgtccaacaaataaatttgtgtgctgcaaattaacatattaggttggtaatagaaggaaccttcatgttggttcaaattgtctaggaaaacaaacattaattacaaaataaaaatataaatatatctattgatttatctattaacttattagaggaatagaaaaaagagcctccacattcgctctcacggtctagaaattctcatattaatcggagaaaaagaaaaatagagttcatatagaaatacaatttaaaaatagttgaaattcgaaattaaaaaaataaggaatattggaagaggagactagacaattaagaaataatagaaattcggaattaaaaataaggaatattagaaatagagtatagagtccatatagaatttaaaactaacgaaagttcggaataaacataataaaattaaaactagagtttagagttcgtataaaagtacaatttacaaataactaaaattcaaaatttaaaaaaaacatgggaagaacaatcaaaagtcaatataagaatacaatttagaagtaactaaaattcaaaattaaaaattaaagaagagtaaattgcatccacggtgcatcaacttggtaggtaggtgcaatttagtgcaataacatgaggaatgagtgttccagtgcaacaaattggcaggtagatgtaatttaatataagaactttataagtgatcgtataactacaacatcttgcaaggtaggtatgattttgatacaataaattaaaaggttatgtgacaacttaattacttggaacattttttttatataagtctatttttaagaacttattttgacaatatactagtgcggatttgtataagcatatttatatttttatcctaataaataataactgaaagtcaattaaactggatatagaaattactatatttcgattgatatttgagaaggtgaagaaaaccaaaaaaaaataatcttaaaggcaattggatgtaaattgtactactatgtgcagtataattcataattattaaattcaatataaggtaatatccgtatgattactatgtaatggcatgttgacatagtaaaaaaactcacctaagatatgcttagccaagttaatacaccaaaatactaaattgttaagtttttgtactagaacgcacccacttgtcaagttgttgcactcggacattcaattcttaaattcttatactatatcgcacccacctgtcaagttgttgtaccgtgggtgcaatttactcattaaagaatattgaaagatgagtttagagtccacataaaaatacaattagaaataacaaaaaattcagaattaaaaataaataatattagaagaagagcctagagtctatatagaaatacaatttacagataacgaaaattcagaattaaaaaaagaaatattgaaagacgagtctggagtccatataggaatataatttacaaataactaaaatttaatattaaaaataattaataactaacacgtagagtatataaaatacaatatgaatattacacattagtagtttcgcaatgttagtacaaaatttaaaattatgttgtcattttaatatatatgaataatacattgagaaacatatatgctattatatgagagaaaatataataatgctagccgcgcaatctgcgcgggccaccatgctagttctataaaattaggacagtgccaccaccatgcatcaagttttccatctatctcttttttttccgttttcttccttctttctcccgtcttcttcccttaagtgatgttctcagcaagtgaaagatgacaatgatgatatggcaacatgggaggagtagcagcacagtggcgtcaccctcacctcatgacttgaacgactacttgggtgtggtcagcaaggtggaggcatcatcgacaggcgccgccacggtgcacgccttcatctcgaagcagtaggactaggtatcattgacctcggcggcgaggggggcggagttgctaaagcccttggcggcttgggcggggggcggggggcgaggaggtggtcgagggtggcgtcaagctcgacctccttctcccgcagtcgtcgcgctgctgaagccacacgcaccagcgcctggcactgtcgcttctgcacctacttcagcccggcgcgcatccactcgcactccatccgcaccaccgcgtcaatcttcgctctatgtggtcacaactccgacagtagtgcatctcccaccgccatagccgaggccacgaaccacccactcattgacgtcattgccgactccaccaatcggctcatcggtgcagccaccacaaccagctgcatcatccccgggatcggcagcagcgccgcggacaccactaaccccactgctgttgttgcatgacagcttgctctgtgccgcattgctcaccacagtggcacggtcatgccgtgttgctcaccacagtggcacggtcatacccatcgccctattgttgtagcaaccacccgccgcagggaatatcgctcaagggaagaagacgggaaaaagaaggaagaaaatgaaacaaaaaaggagatggatggaaaacgtgacgacagtggcatggtcctattttgtaaaattttagtggaacgactacgaatagatgaattgtaatgacatttatttgaatacgcacatttgcaaggcatggatccaatttacccttaatattatagtgctttagaatatgaaataatgaggataattaaaataatgatgatggacaaatttagaaactttagaagctttaggaaaccaaaagagtaaattgcaccaatgatacaacaacttggcaagtgggtgcgatatagtgcaacaagttgagaattaaatgtccaagtgcaataacttgacaagtgagtgcgttctagtacaagaacttgacaatttagtatttttgcgcatcaacttggctaagcatatgctaggtgatttttttcacgatgtcaatatgccattacatagtaatcctacggatattaccttataatattgaatttaatctttaataattatactgcacatataatttacatccaattaccttttaagaattttttgttttcttcaccttctcaaatatcaatcaaatataataatttctacattcagtttaattgattttcagttactagttattatgataacaatataaatatgcaccaaataataaagttgccgcataacttcttaatttattatatcaaaatcgtacctaccttacaagttgttgcatttatgtgatcacttataaagttcttaaactaaattgcacctacctgccaagttgttgcactagattactcatttctcaagttcttgcaccatattacatccacctaccaagttgatgcaccggcggtgcaattttctcaaatgaaaatttagggataataagatttatattgctcggtgattgtaaatgaattgaactattagcatattaaacttaactctaccaacattagagactttagagttaggaaagcaagcgaaatatctctaacataataaaatagatcatttagcaaagtatgagttgttcttccatgtcttgcgcttaacatccttaggggctacgagcatcttggtggtggcaacaaggtgatggtccaagtggtgatgaagactgctggagtcggtggtggtagatcgttgaaggtgccagtgacatccagggtggattgacccaacctaatggccagatcactcccgggtgtcaaaaaggttgttgtagtgagaatgcaaggtgtctacaacgaggagcggcattgacataatgagatggtggataggttggcatagctgacgaaagatggggcacaacgttggatctagggtctaaatgccgctagatctgcgatgctcgttcctgaatctttttatatagcaggctagcagcaagctaaggggtttcttcttttcgacctccactggttggcattgcaagcgaagccactaggggccataaattgtttgatcgaatcgaatgggtccgactgacgacaagggaagagtagtggaaggagctgatctaatgtgattgaaatatggatgagggttttaggagttcgggttgcatatcaagattgacccagtaaggttttttgtgcggtaggtctcgccagacaatagaaggccaaagcttagtcttatagtaatttctttttcttttctgttttgtcggttatgagacttgtaacttttggctgtgttgcggatatacagccatatacagcaggatatttctatccactacgtaaaaaaaatattgagtaacatattgatggcctgattcggacgtggtctcctcaaatgctttaattttacgtgatggatagtatcagtgtgcaatggagttattggtgcagatgaagtcctaaaggctggtgatttgtgtcgactaatccacaggttcatgatcaaagcctatgcagattcagacgaccatataggtgcttgttttgtggatatgtgtatgcgaagcactgttgcaataagcctttttcgtttaatcctcaaaaggaaggaattggagtgcatcgagggaaaagggattatccgaacaagaccttaaggatttgattatgcagaaaaactagtgaacggaatcccatgagataggatactacttaataatgaacaccccaacatccttccgtttcttcttccctagaactatttctcctcctttctctcaaactcattctctccatcctccaccttgctccctcccccaactcctccactccaatcaatccaacctcccttcgccagaggaccgaccgccatcatccctaacactgatggcatgtcccattctcttcgccttccctacaccgcatttattgggcatgtggagtccaacgaggttatatggttgatggaatcgatcaagttggcaaggaggaaggtaactgcggtggtgaggttgccatttgccgtggctggggagggagaagagggaggaggtcagggaaagggggatgaggtcaggggcaccaacggacaatggtaatgcatagttggtcattctcagcgtgaggtcaacctcggagtttatgcgggtcttgaggttgtggtactcctcgctagctcgttgtgctgctcctcttcattataggtaggtaagttactagactagtatcagatatcagctgtgaaacgtcgaggatatcacagctgataccaagtatcaggcatagtacctcggggaatcacgactgatacccacaagtatcagccctggtagccagataccaagatctgatacctaggtaccagccggtacccacaggtatcaggtactaagtaccaggtgaaaggagggaacgcacgccatcgtcgctaggccagctagtgagctccctgctgccatatcctatcatctcctctcttcctctcctcaacgtgcccctcttcccttctgttgatgtggctagcgagacaaaaaaaaacaataagtacagttgctatttgcttgcatgcgaaagctcagctatacataggaaaagaagagggaggattcagtgatagcactgattggtctgggtgatatggcctattctgattgggtgtggttggtttgattttctgttaagcaagctccaaatgattttttctcctaaaccgtttatctaatttatgatttgattacactattatatttgttacaattaaatctttaaaacaagatctcggatgattatatttttgataaaaaaatatatatgacaaatgggtcccactaacttatggcttttcccatccgtgctatatccctccaaccaaacaagaaattggatcgccatatctatacaaaccaaacaaaaatttggatagccatatccatcaaaatatgtatggacatatcccatccatgcatgaccgtgaaccaaacacacccttaagtatcctatcctctagtctctctcttgattatgtggaatgcactgttctcaagcagtaggtgccacaagcgatgggcttctcagctcatcatgttcaccactcagggccgaatgaaaagcccaccgacgcagcagaaaggcccaaaaaaaacccttcctagtagtaacaaacaagcagccacgcttcccttggtttctcagcgactcgactccgcccgtccggccaactccgcggagtcgccaacacgaacccccctcctctcttcctccctccctcggtctcatcgaaaacccccactattactaccactccccctcgccttctccgcctccacagcgaccagcagccgcgccgagctcccagatccctcgtgcattccaccttctcccgaggtgagccacccgcttcctcctccctcgtccccgatccgtgccgcccacctcctcgctcgctgtgcgtggcgcggtgtttcactgatctgtgctttgcgggagaaaggaggagagttggagatgttttgtttgtgttgtcttgttttgtttcttggacaggtcaagtgggggatgcgggttttttttttcttgccccagggtttatcagcgaaatgtttgttctgtccaaatcgtgctcctggcctgggtggggaatgatttgagcgctgcgtcgccggttttgcatgttagatttctctcttgatttgtttgtgcaggataggttctttaggcttgtttttttttttcttttttgatagattccatagttctgaaatactagtttctcgagtgagctttggagaatggaggtgatacaaatcttgtatctttgtttcgatttgttctgtttgcctgaatacgggttgaacagttgaggctgagttagtagaaggacagatcattcgtgtaatgtgtgctgtgatgatcttttgatgcagcaggacgatgggcgcttctgcagctaccggtatgcagatggtggctgcacgcccctgcatctcagcctcccagggaatgcttacttccagggcggcggtctcccggattggccgcgcactcagcaccaccactggctttgcaacctgtcccagaatctgctactccagccctcttggttcttccaagcgcagcggtgtcgccatcagagcaatgtcaagcgaaagtggcccccaaggcctaccaattgatcttagaggtaactctttagctgcatatctgtagtaatcatgcacctagcaatgctatgtgatcatgttcttttcctttacgcattcatgtttccgtgcaacattttgattgcttagcttctattttctcaatttttcttttgcatctaacaagcatagatgctcatggcatacgttggtttttggttaactatatggttgaagccaaatattattaaccccgtcagctgtggtgaatgtttgaatggtgtgtgcttatttagttcaaaccatctaattgtaaaaactgcgtgctttatggaatctagtattttacattctggtcctcgggaaaaaggttactgctgttttggttatcttttatggacgatctaatggtgattcagtagtaatattgcgtttactactctttgataatgctgtaagagccagcctcatacatcaccgtgtagactaacatatgagcaattaccagtataccagggagcatatcctgtgcaaatgaaagtgttttaaattccatttttacttgatgtagatgctttaaatattctaaagaaaagcaaaagttgggtttgacatactgtatattcatgctaaggtagggtcttgaaaattttgatgagaaatatcaagctaaatttcttttaattatttgagaattttttttttagaacttatgtgccttttgaaggcctcattcatgaactctacatattaaggaagtatcaactttatgtgcttgctcattaaaaaaaggtcaaatataaatgctttcgtcagctgtaatgaagtttagtggcccatagcattatccaattattaacagatggtcacaattatacagaattttgcatagtaattacaagtattttgatttgttgtcatattgcttttgttattggtttgattgaaaaactaaaggagagatttttttttcaaaaaaacagagaactcgagcatattagtagtacaaatccttctcaattgctgccactcttctaatgtttgtatgatctctcaggtaaaagggcgttcattgctggagttgctgatgacaatggctatggctgggcaattgcaaaggctcttgctgctgctggtgctgaaattcttgttggtacatgggtgcctgtaagtggatccaactcttgcagtgttcaatagggatcatttttttttttcctctttgtcattcacttaatggagagttctacctgcacaggcactaaacatatttgagacaagcctaaggcgtggaaagtttgatgaatcacgaaagtttgtattatatttctatttttcttgttttatctagctttgctctgaaaataacatttaactcttatctaactatctcttgatacaggctgcctgatggatctcttatggaaattgttaaagtctatccacttgatgctgtctatgattcccctgaagatgttcctgaagatgtaattttcttatctattattttcttctgtttagctcccaatgcggctttatgacaatcatttttatttttaattttaggtcaaaggaaacaaaaggtatgctgggtcatcaaattggactgttaaggtgtgtagatgcaatccatttcattccatatgtctacccagttgatatacttgggtgtgcaaaaacaacattaggcgcgttatacaatttctataattggattgttttttaagcttttgagctttgactaaactactcctatttttatttgataggaagttgctgagtcagtcaagaatgactttggcagcattgacattttggtgcattctctagctaatggtccagaggtatagtgcctctgcctatattcctctgtgcttactgctagtgatgaaattattgtccatacgtgttacgctttcaactaatgatcacctacctctgtttgaaggtaacaaaaccactattggagacatcaagaagagggtatcttgctgcactgtcagcatcgagttactccttcgtctctttgcttcagcacttccttcctataatgaatccaggtagtgcttactccgcagttctaactctccacgcctgcacttgaaccgctatcttatacactcctagataaatcaagccgttactgcctttcatatctttgcagttttatttgtccagtgaatcatagtaatgctgctgtttacttatgtgtaacttgtctcctgctctgatctggatcaagcttttctgactgaacagcaatgctgaaatttatccaattgcattaagaaataacttgttatgacgctcaacctatactaacctatactattttcattggcactgcctcatatatgtttaatatttccaggtggtgcttccatctctctaacatacattgcatctgaaagggcaattcctgggtaactacattatttgagatttaaaatacaaagcattttgtatcattacttaccggtggtaattctgattatatatatttttagatatggtggtggcatgagttcagctaaagcagctcttgagagtgacacaaaagtatggtcttctagaatatatatgttattttcaacactccctccatcccaaaataagtgcaaccctctagttcaaatttgaactacaaggctgcacttattttgggacggagggagtatgtaccatgaatgtacttttttaatctttttctgcaaatctttgtaggtacttgcttttgaagctggaaggaaagggaaaatcagagttaacaccatatctgcaggtattttcttctgtaggaatattctcttggaataaagctagcattgtaaatcttggaactaggtgattgcctatgcgataccatttggaaattaatgacaaatgatgcaacatttctttctaattttacatgtgaatttcggtttgtcagcacatgcatatgatgtgctatttcccttggatatgatttgcataattatttaggatctcttactttaacgatgtaggaataattgtgagttcattctgatttattaaatttactcataggtcctttgggaagccgagctgccaaggcaattggattcattgagaagatgatagaatactcttatgttaatgcaccgttgcagaaagaactgttggcaggtccaaaaccgccttatttctctgttacatatgcttcttgttttatttaaaagaacaacttttcatccagatatactctaacgaaagcattttgtatgtcgaacagacgaagtggggaacacagcagcattcctggtgtctccattggcttccgctatcactggctcgactgtttacgttgacaatggactcaatacaatggggcttgcagttgacagccctacaatatcatcataggtgtggtatggtagatagatgggttttcctgcttcattgcggcttgtttcttgaataaagagcttagttaggtagtataagagctaagggcaggaagaaaaaatagagcatgaatccaatttggtccttgacatttgagtaattcctgcactggggtactcgagcaatactactaggtggttcggaatgattcaagccccagttaccaatgttctgtgctgtatcttgaaatttttaatcattgatactgtgtttcttcgtataaactttgtcaatacagtgaaaatcatgtgcaataataagaatggataatgtttggtagtctcttctgtataccttgctgttatgttgtgcaaaatgtcggtggtgtatactacaatccactcttttcattaaaaagttaagagtaaatcgcagtttgggatagatgttcttatcagatttttatattggacaacccttcagcacatcttttcacttaacaccaactagctttatcttttgtttcaacttagatcacccccccatccaatcaatcctactactcggacgactgccaccgcggctcccattgcaacaccggccacatcttaacctattctctcacgaacactatctcacctctttcgttcttccctcgtgacgaaggtgaggtgataacctctttcttcacttatgcccgatgcaacaaggaggagccctatctagcgtcactgatgtccaccatggttggatccgagttccctctggcccatgctgttggccttgacctccacagctccactaggacatcaccatgcatgatgacggggaggaaggagagacgattggcgggtgcttctatatgcgagaggtgaggagtggcggcgtgcactgtggcaaaagagcaagctctacactcgaaagtggtaaaagtagtaaaggagaagagctgtcgaaggtggagagagaggagcagtggtgttcatcatggtggaggaagagaggacgactgcggacgagggagaagctgcggtggaagtgcgtggaggaggataggagggaagggtggctaatgcttccatggcagaggagcttgccatcgccatccccaccgagcaggtgagaacctttcccttttttctccttttctctcataagcctattgacaggtgggccactagcctaaattaaaatgattggtagcaatatttgattttaagtgaaaagattcagttaaaggtggctgaaagtgacataagttggtcactagcccaaattgtaaaggattagtaacaatatctagctaagtgaaaatattgagttagaggtggcttaaagtgacattttggtaataatagctcgaccaatatgtaattcatatactcatatgtactactttgcatttaaatacatgataactttatttatttaaactagcatattactcatgagttgcaatgtgattttaaataaagaaaattattagtaacatgttagtaccctctctttctaatatagactaaccacgtcagaatgatgctactagattatttatcaaaaaatagcttctttttatggtggtatttatagtttatttctaattaagatgatactagagtaataaagaaaatcattagggtttaattaaataaatttttattattacaaacttgaaaatgaattttatctcatattttaaaacattttctgtataagaagttttcacacgaaatatactatttaactgtttgaaaaacacgctaatgaaaatcgagataaaatgtatgtatgttaataaataaattaaaagaacggccgcttgtttcgtacaacgtcgtcctggcttcagcttgagcgtgcatgttcatcacaaaggttattgtctttttattttaataacttaattttatagatattaaaggttaaagcggtattgaagaccgcatcaatcataaaatggattagttggagggagtcaatataaatcactaagactgcgttggagtgagtggttgtcttgagcttttcccttgcatgcataaaaaatataaatcattagatgaaaccctcgtgttactgcggaagtttagtatgatagcagtaagtagaaataatatgtaagatagatgatataagctcgtataagttgatatagtttgtgataatttaaatagtatatagaataacgatccaaatataaaagtaaggtgacgaggtttcatgagaaaagaaaaggagggggtaatttggactataaattaatcatctaaggattaaaagcaattgatgtgatatgacttaatgtgagaagaaaatgaggaaaataatttggaccatagattaatcatctaagtgctaaaaacaattgatgtgatatagtttaatgagagaagaaagaaataacattaatcaaagtgaggataaactgtataggtatatagcatattataaaaatgatggagagatatattaaaatattatttgaattaattgggatgatgatttaacatgcttgcattctaaagttctaaaatttaataaattatataattatagataatatagcatgtttatatgatttttaagatataataattgttagtagatgacggcgttgcgtctttgcatgctgaattttaggatttagtgggttataactttatagtcgatgtttaaaataataattgttagtggatgatgacgtgtggcatttctgtatgctgagttttaggatttagtgggctgtaactttataataagataggatcagtgtaagattaattaagtattagagtaactactgtaaatttataaactttatttgattttttttaaaaaaacttttaccgttaaatattttagagaacagacaccggacgcttagtaatttgaaaaattaaacgtgcttagttaaaattgagaaaacagataatccattaatgtgattagaacttagcctaagggcttgttctgatgggtggtttggcagaaattttggtggcatgccaagcgagataacctattaaggcaagttctaagcacaaactctaaagtgacatgtatgtttaaatgatgatgtagagaagagaagagaagagagaggggatgagccacctctcatgtaaggggcaaaacttaaagaaacatgagaaaatgagatggctgattggtgggactagtgtataaaatgcaatgcatttatataagttaattttaattttttagatggatgatgtggataaaattggaggtgactaccacatctattgtaaaacttgccctaatcaagtactccatccgtctcattttaggtgcagccatgatttccctgtacagctttgaccgtccatcttatctgaatttgtttttaaaaaaaaataaaaaacataagtcacgtataaagtactattcatgttttatcatctcatgacaataaaaatactaattataaaaattttcaaataagacagatggtcaaagttgggcacggaaacttacggttgcacttaaaatgagacggaggaggtattaattattaaaaacttgaaaacaatatttatttgatttttgaagaactttgatatagaaaacttgtatatacaacacacgatttagctatataaaaaatgtggcaataaaatcgagtaagctataccgatatgtgagatggcgaaaaatactgagccgtatacgttgaccaagaacagcgatgcatgtcgccgtattattatcatgtcttcgtatatgttgtcaaatatatatatatatatactagtgctctcttccttctataatatagcaatataaagtccaatgatatgctataacgaatctagatatgtcatatgattctatgctactgtattatgggacgaagggattagcaaattatggtttagttggccatatatagcttgacaccctgctcagcgatttgatcaatctggacatcgcgcttaaaaatcgaaaggaaaagagaaaataagcggtcctgggcgttgtgctggtttggtacggtggcaccaagctgggccgtacaaagccactggtgtgggcctgatcgttcgcccatcatgcagatcgctctggtgtttgcgttgcctagtaatcgtacacgtgtaatacgttttccatatatggtaaatcgcaagaaacatatgaataccctgaaagtttattgtgttttccacaataaatgtcgcatgaaacatacaaatacacaagtttaagaacaatatgttctaacatgatctagcctactttggtaaccccctcttggacacttgttgtggaggtgcaaagtagacaacattacaaaatggacacactttttcacaacttaacaaacacttgaaaggctcaaagcaaaagagttgtcttcaggtgcattcaagagaactcccctaagtaagagaaaagaacacaagtatctacacaattgattcgtgtcatccacaataacttcaaatgtaaccctcacaatctgcaatccacaataacttcaagttgacatggatattttgagctgcattaaaaaaaaacaaaattaaccaaagaatatcactacttggagaaaaaaatgaaaactaaaccaggaacattgaaatactctcaaactgaataagtatttgtacaatttttggaaaagagtatcacatgtgttgttagacatacatttttgaatgagcataaccgatttttccaaactccagaaatttctttcagtctaaataaagttgcaatagtgaaataagttatatggtagagcaaaatgttagggtatcaaccaaaatggttcagtttgagtctagcagaaagcgagtttcatgccctcattgtaaaatcaaatacaaatgttatacttccaatacctgaagaacatttttttcctaaggatggtaaaaagcctcaacttatgcaagatataaggtggcaggcagatacgattttacaatttttatttttgaactttgaagaaagatatgtaaaactaaaaccaagtcataaaacttaattctgtaactaaaatataagtgttaattttaaagggctacagttcaagaatatccaaatcagataacataatgcaatatgctatatatcctaagtgtgaggtaataaaaataaatcagataaaaccatggaaacttttgcttgctgagaaaaccaataatttaaaatagcatccttaagcactcatatcatcaatgatcctgtaaaatgtgaggcacatgatcttctagtagcagattagaatagaaaagactgttgcactgaagaaaatgttgatacctggcctcacacatgatgtaagactgcttctttgttaaaaaaattgcaaatgttagtttgcacgtggtaaaaaaaggttctagcagttttttatagggatacaaaaaaaatgaaaaaaaactacatttggcagtttttaataaatattttgcactgaaggaaatcatgaagttctacataatttagatcaattaagtagaccaaatacaaattcttcttgttcttcatgaacaacagtgcagtataaatgacaaaaccaataaacatttgaactaaaattgacacagctacagtcaagaggtatactaagcccctctctcaccttttccttttgttttccttattgcaacctttgcttctgtctagaccagatcaagagagcaacctagattaatttaacagaaaaacatcccacaactgatgtaacagaaagaataggcaagcagataatccatcattgataaatgtatgaaatcaccatgttcaacctacaaaagaaattttgtcaacaagaatcggagatttctgaaattaattaccacactggccatcaaagccaagtagagattgctaaataaaccagccaccgccaagttgtgtttctgcttctacaaagtatatatgccaagtaacgcttctgcttctgcaaagtagaggattctttcacaagtgattggtcagctttagggtcattccaaaagactggaatggtgtgtttgagaaagaaaacaaagcactgcaacggttacattttgcctaaattttcagattaaactgcaggttcatcataatagttaatagagaaatcgttattgtaatttacatacagctgttgcaatctacagtctgaagtgagggttcacctgggtgggggcagatcctccaccatagccatgtcgcacaccccagctatgttcaaagagaggaagcgagtggccgggcgattgctgagagagcatcagggtgcaggcaagccggttgagtggtccgggtggcggaagcggccggatccgctcagcctcgagccctctacggagtagggctttgactccacgctgctcctgccataatatcccaaatgttccggcttgagaaaatggagacaatgagttgcagatcgagattatgtgtcatcacaatcatgcgagcaacagggtgcaggtgcagttgctggtggcctgtggttgatgtcagacggtgtcaggagcagagaacggggaggggccagtaggtggatcagatgctggatcggcttggcctccctggcaggggcaacctcgacggatgaaccaatcggattgactcggactcggcaacaggcgcgaggaaccggcgacgcgatagggtgcgatcggcggggcagaggttgcagcggcggagaaatcgcgatggagcagcggatgggcggagaaatcgtggtggagtgcgcggcggcggcggcggcggatggggaagacctcggctccatggggggctggggaagacctcgcctccggttcagtgcgtggcggcggaagaaagcgacgacctcgagggtagcggtgcattgcggcggcggcggcggcggatggggacgacgtcggctcctgctgcggccggccgcggcggatggggaagaccacggctccggcggtggttgggaagacctcgcctcggttcagtgcgcagcggaggcggtggagtgcacggcggcggcggcggaatgggacgacgacgcgaggaggagcgagtcgcgtgttaagagggtgatgaggcgtattctttgcgcggagaccgcgcgtggagagggtgaaatcatgcgtcggagatgggtggatggtacggattacacctgaggtgcgaatggacggtagggatttaacccgttgatttggcatgtaggggtgaactcttttttatattagtacttcttccgtcctaaaatgtaagtatttttgaggttagcacggatattaagaaaataggtgagaataattaaagaaggtgtgtgattggttgaaaagagaaagtaggtgaaaaagaatggttgtgattggttgagaggagaaggtagttagaaaaatagcttcattttggaacaaagtactgtgctagaaatagctatatttttggacggaggtagtacatatgagtgttgacgcgttgccgtatttgttaatctcatgcacaaagcaagcagaaatacgtggaaaggatacatagaagaaagaaacaagtaaaaataattttgcaaaatctttggatagataaacatagtatgggttcaacttaaaaattgagtcgggtcacatcgatattctatacttatacaaaattaaaacaataattatgaaaagtaaattgtataaataatataaaagttggataaaactttataatcctgaaaaatattatttttacaatatttattttctcctaatactacaatctgtaatgaattatacacaattttttaggttttatgaagtcgctacaattttaagaaaacatacattttctctatttttttcctaatatcgtcaaaattaaatagtatatcctgaatccaaaataattattgacaatcaaatcctatttcagttcatttctacaaacacaattaaaatccactaacatgtccttttaaaaattaaaaggctatgtcctttgaaaggttatgggcattaaagaactcatgtaaagtaactttttatattatatgtagtttgcacgagtataaactagccggcgcgtcaactggcacgttgattttcttgtggagtactaattttcttccatcagtttagaattcttctgttttccaaagaatctgaagatcatttttttttctagaacatgaaatctggaaatacttgcgaaaacaacataggtcacgtcgcttgggcttcctgcaccgatgttcccagcgctagtctcgggccgaacggagtaaaaactaaaacgctgcagaattgtttagtaccacctcgcccagccacggtagaggggagactgaggcgctgtatataatgcgacccgatactgtcttgtaaagcatacctttctcggccttttgactaagatcaagtgtagtatctgttcttattagtttaatatatgatacgtgggccatgtgtccacggatattaaattagtattttgtgagggagggcccaccacggtagctcgctactggggccctcatgtgtcgcctaggctttgcactgctgccttgtctcggtgcaccccaaccaaatctgtactttaaattttttcctaagcttttgctcactaatttggtttaatcattgaccaaattaaactgactaggaatgaagtcattgacgaatttttgacttgacttttcagtgagtgattttaagatttatttgtccaaaccgtgagtgattttggttccaatttatgtagaaaaacaaacgagagtctgtttggtaagcgttatttcgaaatggcgacttgctccgctgcttgcactcgcccagccatcgtcgtcatgtagccggccatggcgcggcggcgcgccgcctcctctgtctacctccctggtcggccgccacgcggcagtgtcgtgtgatgcagtggtcggcctataagcggtgggatctcgaagaagggtaagatatgttcttgtctcgcgtgggattttttttgcttggaaaatctaacggtagccgtggtcgtggcagcggtggtgctgtgggtggcggcgaggagtgcgtcgccggtggtggtgatcgccgtggtggtctacaaggtgaggtccagtctcctcgtgttgccaccaccgcctccgccggcgaggccctaggaggagcccagcgaggaggtcctgccgcctccggagccggtgcaggtgggggagatcatggcggaggagttgttgcagtacgacaggtccaaccctgagaagccgctactcatggcgatcaaggggcggatttatgacgtcttccagagcaggtcgcttccgttaacaatgcttctgttactctcattagtcattacaatgctttttctgttactctggccctgtttagtttccaaaacaaaaatttttacgctgttacatcaaatggtttggacacatgcatggagtattaaatacaaaaaaaaaacaaattacatagattgtgtgtaaattgcgagacgaatcttttaagcctaattacaccatgatttgacaatatggtactacagtacatatttgctaatgatggattaattaggcttaataaattcgtctcgcagtttcttggcagaacttataatttgttttattattagactacgtttaatacttcaaatatcaaatatgtgtctgtatatccgatgtggtaaccaaacctaaatattttccgcaactaaacaaggcctctgtttcgggtatggatttccatccttgtttgcacgtcatctaaatagttataaaaaaatttgaaaaaaaaattaacaacatagattaatatgaaatatatcactccacaaacatgtaagaccaaattcgacttctacaagttgcaataaaagaaacaaattaaactgaaaatagttaacgtacattcgcatatatatttgttatttttattacaactaggaaggtagctcgtgcatttgtgcgggcatgtatcgcgagggcattcacgcggattcgtattttttaagaaacttataataatagaatatatatcaactcgatgacacctaccacgctttaaaagtactatttctctacaaattttcttcatcggcattgcttgcataatttttccaacctatctttagctttaaactatacaatatttattcatgccggtaagaaattaattataatgtttctcattatcttgcaggaaggttgacttaatttgtttaaaacaaatttctaacaaattaagtgtaaattaaaaataaggtgttttccttgcaagttgaatgtttacttgctctatttttgaacaaatcctagaaaattattattactaacaatgagttttatttgtaccataaagctgcccctctttctaattggttcatgctcacacaatttgttacattcttacatatatatgaatgaataaagaaaatatatccacatatcttgtttccatatgatatgtgatctatagaatttatttaaatacgtattcaacataagtgctaaaatttaaattttatagtaacaaatataacttctaaaccaactacttgctgccttagtgcggcttgtatatatgcaataatatattaataaacacctaagtctatggtatacggtacatgatagattgaattacattattagtatataaacacttaagatggttatggcaatagaataggcaatgtttgttccaatttaagtgaaaatatgaagcatttttaatgaatttgagatattttctccaattggttcaatctagtgaactttctttaggagtcatatatattctcccattggtaatatggatcatgaactatttattcacttataaataaaataacagttcaaacaacctgaaaagttagttgtatatttttgttctttttttttgaaaacatcacagcaggggaggcccccgtgttaaaaaaaattattaataatagaaagaaccaaaaagattacaacaacctaatccagtttaaaattacatctttatctctctcgttcaatctaaacaacaaaagaaagagatcacccttaagggaatatatccaagaagccaaggaaggaaaaatattctcaaaaagtatatttttgttcttaataatcttttgtctcaaaatttgctttctaaggtatagcaagaaaatgggatagggaacgtgatttagagagagggagtgaataataagagaggggacagaagatgggagtaagcatgtctgtgtccatgtataggccagggtggggtttaggacatgggtttttcttcattaagcttggttgaaaataatgggtttatcacattaagtaaaaattgatggctagatgttttttttttcatagaattcgtaggaatctttcataatttattggagcgtcacatggtaggttaggaatgctccatggatacgatactatgtaactaaaaagcatgttaattatgttttacaaggttattaatgtttaagtggtggcttagtctactaattttgaattatatagaaaattcttaggagtactctacggctgcgctcttttcccctcttttccaaactcacttcccttattttccgcgcgcacgcttttcaaattactaaatagtgcattttttgcaaaagttttttttatgaaagtttctttaaaaatcatattaatccatttttcaagttttttaggctaatgcttaattaatctcactataatcgtgttctttgttccgtgtcgagcggcaaggttgggaaccttgcctcctgaaacagcctaggtcgctaataataataatatatcaattttaagttaaaatagaagtcaatacgggtcttaaattgataaaattatcaatttagttgtaaatacaatgatgaatagataaaaatgagacatactaccccatctcaaaaaataccaatttttagctttgaacctgtacacacttatccagatacgtagctaaaatatgctatattatatgatggagggagtataattttgaagttttagctgtttaaaattcattatcccaaaattttatctgacactgctatatgtaaaaagaagagagaaataggagggaagcagaggttagagatggagtgtatttattactaaccggcaagcaaatcaatcagtgtatatataaagagaccacaggtacgcgtgcataggcgtgtgaataacaaaattcaaaagccaaaagtgaattaatcatcagcgcttcacatatgctgaaaggtggagtcgaaggaggcaagggcgtatacgaaatacgagcaggagcaggatgaccatggcgatgctctagggaagcttcgctctgtgtggccccgagctagcagttcgggcggtgtttgttttaatcttaattaagttggatggctaaaaatattggaccaaccacttacgtaaaaattgagggattgatttttactaataccacgtgataccttgagagcggtttaaggattaccacgtggtagtgtgagagtattttaaggaagtttaatggacttttaatatataatagaagatagatttgtataagttaatttttaacttagatgttcgtggagtgatatattttatattaatctatcttactatttttttaatcttttttatgattatttacgtgatatgcacgaaacaagaggatatacgggatgaaatcaccttccctttgtttaacatacactactggaaaactgatcttcgctcggtcgccccaaaaccataatagtcccggttataaaaagaacctggactaaatatgatctttagtcccagtttaaaaccccatagccattctacgatctttagtcggactaaagatgatctttagtcccgattcatcccctgtcagtcccttgtcagaggggcggggatctttagtcccggttggtgtcacaaaccgggactaaagatcaccactttagtcctggttggtattaataaccgggactaaagatctcctatatctttactcccggttggtaataccaaccgggactaaaatcacgcgtagtatataatccctattccctgtcatctcccccaaaaccggcttcaatctcctcaacaaccggcctctcctctcctcagatccatctccctctcctccccttcctcctcccatcccagccctctcctccccctcctccattcctgtcacaccccgaagttctcctcccaagcctaaatttaatttttaaaacgaccccaagaaaatgcaggtgcaaatcaagagaaaaccctaagaaagtaatgcaaataataatcggatttggcatgtggaatttttcttgagttctacatgtcgaaattcattaacaggatttttagtggaattttcagagctctagaaataatttgaaccaattaaaattgagcaagcaatattttaattccagggaaaatcctttttcctttttctttttctttttcctctctttttcctcctttttttcaaatgggccgtcggcccattttttcccttccttcccccctccctgcagggccggctgcaggccgaggcccagccaggccgccgccgccctcctctcccggggtcgccgacaggtggggcctacctgtcgggtccttcccccacctccggccgacgccgagccagcaaccgccgcgcccgaaaccgccggcgcgttcacgccttcgtcttctccgggccacgtcgaccacgcccgcgcgtgcgccgcgttccccgcgcccactcccctctctctcccgctcgcacccgcgcccgagatggtcgggattcgattttcgaatctcctcccccactcccccacgtcagccggcgattcccgcctctcccggccacgtccggccctctctctccctacttaagctcccccgtcgctccctctcgctttttccccatttcgcctccctctcccgagctccccatcgctcccgcgccgtgcgcccatccgccgctgctctcccgctactccggtcgcctctagccgccgctacactcgccgccgcaccgcgccgtcgccgctgttgggttcgcgcggccgaggtccacctcgtccacccctcctccgtagagattcgccgccgaagccccatccccgtcgtgcgctggaggttccggagctcgtcccgccgtcgccatcgtcctccgtcgcccgccgtcgtcgaccgttgtcggtgaggcctctcctcctctttctctctctcccgcaccgtttagccgtcgcgccgccgcttagccgcgtagctgccgcttcacctctagccgccgctctccgccgccggtcggtcgccgtcggccgccgtcttgcgccgctgccgcatgtgcgccgctgccgcatgtgcgccgcgccgtcgcgcgccatggtcgccgggccggtttgcgccgtgcccgcgcgcaccggccgcgagctcccgccgcaagggtagatcggggccatcggttcggccgccgcgtggcgcgccgctcctccccggtccgtggacccgatccgccgtggaccgccctccccgagccgctgaccggtggggcccgcttgtcggcgcccttcctccctccccgagccgctgaccggtggggcccgcatgtcggcgccgcgccccgccttgatgacgtcagccctggaatatattgcgcaataaatgagttaaggtttttcttgtatagtaataaaaacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgagatagtcgccgaggttcctccagcagcagagcaaggcaagtcatgcttgtcacttgaacatgttgatcctatattgcaaatgctctattgttttctttcaaatactgcatcgttttataatgttactatgagttgtttacctattgtcatagccatgctattgatgtaccatgtttctttgtcagcttggggttataacatgattagagtttggactagggattgcttagccatgcttagttcaactagttcacaatggggaaaaatcctattaatgtttagactgttggttctaatggtttgttggattagtaacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctaggcttgtagcgtagctttcctctagccgacgcatccaggcaagggtgggcgtgatggagtttggatgggccctgcgacggcctatgcggctttcggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacagaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaattcctgtttataaatgctcgctttatgcaaatgaaccactttagctcttctttgatgattccctgcaccatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagatgtggatctgaatgtcaacattgtcgtttgtgtaccccggccggtcctggacggggattttaatgcacattctgcttgaaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttttcaaaacgagtcagtctagggttttagtaaaactgttgaggtttattcgtcagtcagttgggatctgatgggtgaaatgcattaggtcatagctcaggaacatgggttgcaaggtatttatgctttatttgttattattagtatgtatctaatttctcattattttatcgttatgtgagtctgtcttatttattcgctctcatgcaaaatgatctatgcataaaaatttcgctcttattcgattcccttatttgagtcttttattgctttatttaaattctcaaaacgaattagcagaggtcaagaagcaggttgatgagcagctgcagaaagggtacattcgaccaagtacttcatcttggggtgctccggtcatttttgtggagaaaaaggataagacgaagaggatgtgcgttgattatcgcgcactcaacgaggtcactatcaagaacaaatatcccttgccgcgaatcgatgatttgtttgatcaactgaaaggagctaaagtgttttctaagatagacctgcgatcaggctaccaccaattgagaattcgggaagaggatattccaaagacggccttcaccactcggtacgggctatatgagtgcacggttatgtctttcggacttaccaacgcacccgcattcttcatgaatctgatgaacaaagtgttcatggaatttctggacaagtttgttgtggtgtttatcgacgacattcttatctactcaaaatccgaagaagaacatgaacaacatctccgtctagtactcgagaagttgaaggagcaccagctatacgccaagttcagcaagtgtgacttctggttgacggaagtcaaatttctgggccatgtcattacagctcagggtgtggcagttgatccatcgaacgtggagttggttaccaaatggaccccgccgaagaccgtgtcgcagattcgaagttttcttggacttgcaggttattaccgccgattcatcgaaaacttctccagaatcgcccgacccatgactcagttacttaagaaagatgagaagtttaaatggacagctgagtgcgataagagttttgaggagctcaagaagaaattagtatccgcaccagttttgattctgcccgaccagatgaaagacttccaagtctattgcgatgcatcccgccacggacttggatgtgtcctaatgcaagagggcagggtggttgcgtatgcctcgcgacagttacgtccacacgaagggaattatccaactcatgacttggaattggcagcagtggttcatgctttgaagatctggaggcactatctgattggcaaccgctgcgaagtatatacggaccataagagtctgaaatacatcttcacccaaccggacctaaatctccgacaatgaagatggttggaactaatcaaagactatgacatgagcattcactaccacccgggtaaagccaatgtggtggcagacgcattaagccggaaaagttactgcactgccctatgcatcgagggcatgtgtgaggaattgcggcaggagtttgagcatctcaacgtgggaattgttgaacacggttttgtagccgctctggaggcacggcctacgctcgtggatcaagtcagagcagctcaagtaaatgattctgaaatagaagagctgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcatcgcactctgcgatgtttgccaacgagtgaaggcagagcaccaaagaccagcaggtttactccaacctctttaaatcccggaatggaaatgggaggagattggaatggactttataacgggactgccccggacatcgtcgggtcatgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgggtcaatcaaatcttggaagatatgttgagagcttgcgctcttgattttggtggagcttgggacaaaagcttgccatatgcggaattctcgtacaacaacagctactaagccagtctacagatggcaccgtttgaagctttatacggccggaagtgccgcacacctctcttctgggatcagacaggcgagcgtcaactgttcggaacagaggtattagcggaagcagaagagaaagtcagaatcatcagggaaaggttgaggattgcccagtctcgacagaagagctacgcggataaccgtcgaagggagctcacttttgaggcaggagattacgtgtatcttcgtgtcactccgctccggggagtacaccgttttcagacaaaaggcaagttggcaccacgcttcgtgggaccatacaaaatcctggaacgaaggggggaagttgcttatcagttagaacttccatccaacatgatcggcatccatgacgtgctccacgtgtcccaattaaagaagtgcttaagggtacctgaagaacaggctgattcggaacacattgatatccaggaggacctaacatacgtggaaaagccggttcgtatacttgataccagtgaaaggagaaccagaaacaaggtcacccgattttgccgagttcagtggagtcatcattcagaagaggaagcaacctgggaaagggaagatgagttgaaagccgcccatccgcacctcttcaccaacttctccgaatctcggggccgagattccgtttaaggggggtaggtttgtcacaccccgaagttctcctcccaagcctaaaatttaatttttaaaacgaccccaagaaaatgcaggtgcaaatcaagagaaaaccctaagaaagtaatgcaaataataatcggatttggcatgtggaatttttcttgagttctacatgtcgaaattcattaacaggatttttagtggaattttcagagctctagaaataatttgaaccaattaaaattgagcaagcaatattttaattccagggaaaatcctttttcctttttctttttctttttcctctctttttcctcttttttttcaaatgggccgtcggcccattttttcccttccttccccccctccctgctgggccagctgcaggccgaggcccagccaggccgcccgccgccctcctctcccggggtcgccgacaggttgggcccacctgtcgggtccttcccccacctccggccgacgccgcgccagcaaccgccgcgcccgaaaccgccgccgcgtccacgcctccgcctcctccgggccacgtcgaccacgcccgcgcgtgcgccgcgttcccctcgcccactcccctctctctcccgctcgcacccgcgcccgagatggccgggattcgattttcgaaatcccgctctctctactcccccactcccccacgtcggccggcgattcccgcctcttccggccacgtccggccctctctctccctatttaagctcccccgtcgctccctctcgctttttccccatttcgcctccctctcccgagctccccatcgctcccgcgccgtgcgcccatccgccgctgcctctcccgctactccggtcgcctctagccgccgctacactcgccgccgcaccgcgccgtcgccgctgttgggttcgcgcggccgaggtccacctcgtccacccctcctccgtagagattcgccgccgaagccccatccccgtcgtgcgctggaggttccggagctcgtcccgccgtcgccatcgtcctccgtcgcccgccgtcgtcgaccgttgtcggtgaggcctctcctcctctttctctctctcccgcaccgtttagccgtcgcgccgccgcttagccgcgtagctgccgcttcacctctagccgccgctctccgccgccggtcggtcgccgtcggccgccgtcttgcgccgctgccgcatgtgcgccgctgccgcatgtgcgccgcgccgtcgcgcgccatggtcgccgggccggtttgcgccgtgcccgcgcgcaccggccgcgagctcccgccgcaagggtagatcggggccatcggttcggccgccgcgtggcgcgccgctcctccccggtccgtggacccaatccgccgtggaccgccctccccgagccgctgaccggtggggcccgcttgtcggcgcccttcctccctccccgagccgctgaccggtggggcccgcatgtcggtgccgcgccccgccttgatgacgtcagccctggaatatattgcgcaataaatgatttaaggtttttcttgtatagtaataaacacagcgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgagatagtcgccgaggttcctccagcagcagagcaaggcaagtcatgcttgtcacttgaacatgttgatcctatattgcaaatgctctattgttttctttcaaatactgcatcgttttataatgttactatgagttgtttacctattgtcatagccatgctattgatgtaccatgtttctttgtcagcttggggttataacatgattagagtttggactagggattgcttagccatgcttagttcaactagttcacaatggggaaaaatcctattaatgtttagactgttggttctaatggtttgttggattagtaacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctaggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacagaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaattcctgtttataaatgctcgctttatgcaaatgaaccactttagctcttctttgatgattccctgcaccatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttctgggcgtgacacttcccatccgatctcctcctcccccttctcctcttcctcctcccatcccggccctctcctctccactactacagatccggacttcagtgacgggtcaactgtgacgggccaacgcaactcgtcaaagatgacggctaccagagaggacccgtcacagatgtgaggtcatctgtgacggcttgcacttgtaacccgtcacagatcgtctgtgatgggtcacaaccatggctcgtcacagatgacatgtcatgtcatgtcatctgtgacgggtgtagtattatgaaccatcacaaaagagaccactcatctctgacgggtctttaactaacacacgtcacagaaaacgttatctctgacgggtggtagttatgacctgtcagtgatgagtgaaaattcaaatttttaaattttgcaaaaaacctcggattgagacatgtcctatataaaagttatagctctcgatgatatccacaactttataactaacaacatttctattagagatcgtttacatccctgaacatgcattacaagtgatcagatctacttttaaaaacaaaattttgagttttttttttcaaatgacatggatggatacatgctccgtatcaaagtcatagaactcaaccagatctacaatattataattgaaaatattttcatttcacagagtttacatgttcaaaatacatgttataaagtgagatatattttgaaaaatgaaattttgaattcttcaaacaacattggatgaagatattttctatgtaaaagttataaaacacgatgagatctataattatttagttgataatattttcatttgaagtcatttagggtgttaaatatatgttaaatgattcagacaagcatagacaaaataataacattgggtgcatagtcaatatgtgctgagtaggtgagttggtaagggagctctatatggaggttgaggtcttgagttcgaatctcatgtgtagcatacaagttatattgcgggaaaaattgtgaatttgttaggtagtgatgtgtaaccatgaataggatggctagtaaaattcaaaatatttttttgaggtttttttgttgcgtttaaaattcaaaaattatatttcttgctttgtgaatttgtaggtagtgatgtgtaaccatgtataggatggctagtaaaattcaaaatatttttttgaggttttttttgttgcgtttaaaattcaaaaattatatttattgctttatcatcactaacgtgtcgtaagttacaacccgtcagagatgagtcatcagtgacggtcaggtagttgcgacacgtcactgataactcatctgtgacgggtgacaagttttaacccatcaaagatgacttatataccggtcagagatgggttatctgtgacgggtgcccgtcacaggtgattttgtcatcagtgaccactaatcactgaccaagaccaaacccgtcaaaggtgagggtttgggcccgtcagagatgacctggtccggcgtagtgctccctcctcccttcccatccgatgcccagcgagggccgccgcctcctcctcctcctcccttcccgcacgcgtcaggcggggccgcgcccggcggggccacacgctgtaggcggccggcggggccgcacacaggccgcgcacgggccgagtagcgagtggtggcaggcggcgctaccggcatccattctttttttcttttttttacaatttgtgattcagcgagatgtataattttgtgatttgctgtatggatctgagatgtataatatgtgatgtatttggtctgtgtgtaatttttttatgatttgtgatgtatttgatttgtgtgtacaagtagcttaagatttttgatgtgaatgttttgtgatgttactttgatttggggtttgatttgggaatatgcatcccactcgatttgggagaaaatacagggattaaactctggctaaaaaataataaaaaaaagaaaaggagacctaatgggactgccgctaccctctctttagtcccggttatttcacctgggactaaagatagtgatctttagtttcggattcatagtcccggttgaataaccggggctaaagggggttacgaaccgggagtacaaagggcttgtttggttcaataccctaccaaaatgttggtagtgccaaaacctaggcaagttttggtactaccaattttttggtggggtagagttgtatttggtttgaggccaatttagaaccaagcattgagtagaatatagaaaatatcaaattgggcattggcaatgccaatgatttggcttcaaaccaaaattaccagatacactgttcaaactaccaaagtattggtagggcacgtttttggcactaatccaaaacagcccagagggtttctccactagtgataacaagaaacttgtttagagcgtacctgcttcccaagcgtgtcgcccttatccggctgcctcgtgtccagacacctggcacaacacacatcgcccatcttacacgtgcacatgctcccgtgtcacctcctcaacacttgcacgagttcttcgttgcttgccgctctataaatttccagcttcctttcgatcctcttcaacaattacaataatcatcaagcttcttcttatgttcatccaaatccacagccataaaagtagccatacttgagtttaggtagccagcatgcaggccgggaagaacgcgatgcagtcgaccaaggaggccgcggcgaacgtgggcgcgtcggcgcgcgccgggatggacaagtcccgcgccgccgtgcagggccaggtggagaaggcgacggcgcgcaacgcggccgacaaggacgcggcggaggtgaggcggcaggagcgcctgcaggccgccgaggaggagaagcagcacgccatggccgccaacgcagccgccaaggagcgcgccacgggcggcgccggcgcgtaccacccgtcgcagggcgcccccggggtggacccgcgtgcggcgcagccgacgggagggcacgtccaggacggcgtcgccgagagccggccggtcgggacggccaccggcacggcgaggcccagcgccgcccacaacccgcacgtcggcagcgacttctcgcaggcccacggcaccggcggccagtaccagtgatctcattctcatatcaatgtgacaatttatgatctactagtagctgttcatcagttcatgtagagttcacttcgctactatgagttgatggggaataaaattgtacgtgttagaagtggtatcatgttgtgggagatgcttaattatgaaataaaacagagtactctcttcgtttcacaatgtaaataatgtaaatataagtccttatagtattttttatattcatattgatgttaattttctatatttatattgatattaataaatttagattaataaatttagagacatcaatagtacctgaaaatatggttacttcgatatgtgtatgcttgattgtgtttgttcatttctatccaaatatgactacttcgatgtgtatgattgattgcgttcgttcatttccatgcactcagtgacgtctgtgtttaataattactttctgatggataagcagaggtactggatttggtactagatttatcccgtgtgggaagtttttatatgttagtcgtgtgagacgtactccctccgtccttaaaacctaaaaaaagacagcttatttttagtctaaatttagtctaaaaaaaggacaaaccttgttttcgtgcttaacgtttaaccgtccgttttagtccgtcttatttgaaaaaattatgaaaaaaataaaaagacaagtcacatataaaatattaatcatgttttatcatctaataacaataaaaatatgaattatagaaattttaaattttatataagaccgacagttaaaattggacatgaaaacccagttttttttttcatcagacggagcataaaggatgggttttgcatttatttttctttttatttttattttttttgatggagggagcatgaaggattctcgaacgtacgtaaactactacgtcctactaaatgagtagtcaaagtatatattgggtatctgttcatctagacttagatcttgtgttacaaaattgggtgggtatcttaaacacgggtcttgtacattacttaaagccttgagatcatgtagtacgtctctttgactcttgaagatatagatcttttacccgttccttcaacatatatgtacatatctagaataggtacgtatgtatatatttttatctagaatcggtacctttacttcggtttatgtttttatctgttatcggtaccttttagttttttattacagctgtcgattttttattttgatattttttttgtcacgtgaaggtgggaatcttattttatgttgctcataccctgatgattcagggatagggaccccagttcccattccttcaacatatatgaacatgtttttatccaacatatatggatatgtttttatccacaagcggcacctatagatgtttaaaatatttaaaggtgttggttctttattgtttttaccatgtggaggtgggaaacaatgttaataggtgttggttttaaaaccagtatatatgagttgtttcttattagagcttttgttgtagtgatcatgattgttacggctttcataaggcggtaaggcgtgctcagggctcaagacgtctgttccgccttaccaaccgtgcataaagtgtcaccttagggcttgaggcgtcactaaggtgtgtgcaagacgttgcaaggagctaggtaaggcggcatgaggcgacgccctaggcgcgaaagaagagagagatgcatctggagatctaatctcatctggtggcggcatccttcccatctgatggtagcgtctttcccatctagctgcaacggtaccctcgatggccagaaccacccaacggcgaggagcggcggtgttaggggaagagggagccaaggaggagcagaggcgggcaagtggcaggggaagagggagaagtggaggggatgaaagggatggaagcgacagtggagcggaggcgagttggtgggtgcagatgcgattggggactaggatagatcgatagatatttgttagcatcttccattttagtccttggactttgtagatattacggagaagtccttcatttcctatttttgtcttccattttagtccttggactatgtagatattacgaaaaagtccttcatttcctattttcatatttgcataaggcatcgcctcgccttacgccttaccgcctaaggcgtaatgcgtgctgggtccttgccttacgccttaccaccttaacaaccatggtagtgatttgaaaaacgagaagacgttaggtagtccaactacaactaccacatggtcctgcatcttagcaactggtaccatctaccaccgctgcgcgagagagaggaagagacaaagaatagagagggaggaagaggggaagaagagtaatgacaggtgggtcccatattttttaattaaataaaatgctgactggattgccacgcgtgcaccacgttggacaaaaccgctctggattgggtcgagggaggtaatttgtccggtattgaaagtttagggtgaacaatgaccgattttcgggttttggggggtaatttggacgatcgcgatagttcgagggggtaattcgtacttttcctaatactaatatcgactccacagtaattgtctttccatgatagacatgggcaagattacggtgtgctcggttcatcacacccttttttttttctaggggtctgttcactttatggccaaaattaaccataccaagttttggcgtttacaaaatttggaaagctaacaatccaaacattgccaaaaattgtttccactaccaaagtttggtaaatctaaaatcttcctctcacaaaaacttaaaaagaaactaaacatagcctacacttgtcaactttatcaatttttttgtagtgccaaaatttagtaactttaatttaggcatcaaagtgaacaacccctaagtctttatcactcttctagctgcaaggctactcttccggaaaactcaattcatcccggtatatcttcttatttttgcatgttacttaaaatgtcatcaaaaaatttgaaaaaaattagtaggatagattaatttgtgatatgtcacttcacaaatatgcaatttcaaattcaacatatacaagtagaaataaagataacaaatttgacaatgaatagaacgcgtaattcacggttaaatttgttatttttatttcgaattgtataagttaaattttagcttgcatgtttgaaaaaagatactcatatattgatctatttaaaaataataattttttaaacgacatgcacaacaagagaacgtccccgaggaaaaaaatccacttcctatactccgtgacatcagttgctatattatattcctattcctagtcggagttgtagtagcgtttcagttcgtacgtagagtccgagtcagcttccacatcgctcatatatatgccgcgtgtttcgtaaccgtcagtgaaacccttcgcgcgaagcacagcaaagcaaagcaaaaccttttttcccgccaagaaacctcaatggcggcggcgaagatggcggggctgacgccggggttcaagttcgagccgagcgacgagcagctcgtgcagttcttcctcctgccctacctgcgcgaactgccggtgcccctgggcg

SEQ ID NO: 75059 - DNA, 8154 bp, Oryza sativa
tccttcggcttcgcagcatcctcgccgacctagtccacctctccgtttcggtcgccgaccgccggagcgccgtcgtccccgtcgacccgagccgcgccaccacctccctccgctccggccgcctcctccgtcgccgccgtcgccccggggtgagccgtggaccgtcgcctcctttcccccttccctcccttctctcggccgccgctccgccgcgccggtggtcgccggcggcgaccatcgggacgcgggcgcgccgcctcccgccggccgcgctggcttggccgccctcgggcgcgtcgagtggctgccgtgtggggcccggccgtaagccgcccgggccctcgggtgcggctgacgcgtgggacccacggcgccggccggtgtgagccgggtgcacccggtccaccgtggaccgtgaggctgccgcgtgggccccactcccgtggacccggtccgcgcgccctctcccctcggctgacgcaataattccgattttaaattaaaatttaaatgaagaaattcgcaaatattcaattaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaagttgaagccggcgtttgggaaagcgagcaaggcaagtcacatcatccttgaacatattaaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctacttacggtaccactagtatgattttaggtagatgcttcgctgtttaattaggtaacattaggtggttttacaactctagactttgggatattctcatcacctggacactttggaattgttggattattgtggaattggattcacaccgccccctctattcaaaacccccaaaatggttttaggctgggctcggggtgcatggtttggatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcatgtcttccgtccatatgccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataataccgtgtagctttaggatcgtctttttaaaatggctttgggcaactaagtgacttttaaatgctgtttactgcaaaacttaacccctttattattaccccttgtacccccttgcattaatcatgcatctgccggtgtggcttgctaagtactgtggttgtactcattcttgttcaatctttccccccttcagtaagagaagcttcggagaagatgtcttaggtggagtcctggcttataccccagttgagcgcctgtgaagatggagccgtaggcccgctagtccgctgctgtttatttttgtttgtcaggccgaagtgcctttgtaataatgtaaatattatcgatataataaagatgtgccttttgtatcatgtttgtttggtgtaccccggcttttcctgggacggggattaatacactagcgttcgggaaaatgtatttttctcggtcgcgacaagctggtatcagagccatctcgactgtaggataagccaagtggataaaacctaaggacatattttataaataaaactatttgcgaaagttccttctttctccttcccctaatgctatttgcaaaaggtttactcccttcttccttcttcggatttcaactagtactagatggtcaggtcagtgaagaagaagacatcgtcagttgtttgccgaagctccggaagactgcaggatccgttagcgaagtggaggaagcagtgaagccaactgtgaagcaggagtgaagatcttgggaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagaaaaacaccaatgcgaaccgaagatgaagtccgtaagatgatcattaccagcatagaatggcctccaccaggaatgacaaaacgtcagagaagaaataccttccgaggtgcaccacagttgacagagcatcttttagctaatggaggtagggtgtctgatagtgaagattcagatcaagtctcctcagatgatgaagatgagaagtctccccaaggtttcaaccagaataaaatggaacgaaaggcatgctctcgttgtggagaaatcggtcatgttgccagctcgtgtgccactacatgcgttcattgtgaggaagaccatccacccgacaggtgcccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatcctcgtcaagattacagttttagcctaactccagtgccaggacagaggaatcaaaatgagaaaagaaaatgccgagtccggaaagatatttgttgcttcaattgtcaaggaatgggtcatttcgccgacaagtgcccaaaaccgagaaacatagctgccagcacctcagtccacgcaactccctgcaatcagaagcttgctcctcagcgaattgtcatccatgcatcccgaagcagtcctatagcccccgttgcaacagctccaactccagcgagtgcattaccacaaggtgtcaatgctcaacttcagccccagccaccagttgacaacacagaggccagtatcggcattgtacctttggatgttccagcacagcagccaagaaatcaagtacaagataaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctaaaaactgagactccaacctttgccattgccgtcgatcctatggaagccagtgattggttgcgcacagtcgagaagaagctggggttggttcagtgcacagaccaggagcgggttgtcttcgcaactcatcagttggttggactggcttcagaatggtgggatagctacgaagcatcacggccagaaggacataccatcacctaggacgagttttcatctgtattcaagatatcacatgttcccgcaggaatgatcacactgagaaaacgagagttccgctacctgaatcaagaagatttgaccgtcacagagtacctgcacgagttccatcgtttggctcactatgcaccggaagatgtggaaaatgatgaagacaaacaagagaagtttctccaggcgttaaaagatgagatcgcagtgcaactactcctagaggaatatgaagattttgagaaacttgtggacaaagccatacaactcgaaagtgagcataatcggatgaagaactgtaagaggaggattgtcagcatcccagtatcttcatgtggtaaccaaagacagcgcactgagccacttcagatcatcggatcttctgttgcacatcaagagtttccgccccaagaagatggacacaatgcagacaacaacattagcaatactaatgatgatgataccaccaacaaccatgctccatgccccattagtgaccactcaaaccaagcgtgcaatgtcaacatcattcaccaaggtgtcgacgatagtatcgatgatggcacccaaaatgacaaccctagcaattgtgactctgagaaagactccaatggtgatagcaactatggtaccactgatgccaatgttagcaaggatttccaaccaccaattccaactccaagtcagaatgatcgtccccagacggatagctcagcaaagaagacgttgatttgctacaattgcaaagaaccaaggcattactcgagggactgcctgcaaccaaggcaaagtcgacctccacattaccgccaagttacacaaagcagacatcccaatcgtattgtggtcactggagcaaacaccgtacccgtgaggcctcgtgttaatcagaacccatagcagaaacaatgtaccgatgctaagcacttttccttttaggcagtgcttagtattcatgtaatgagggagaaatgtgtaatacagacaagttctatgaggattcttttggaagatgcggatatgtgattatgtgtataattgcttactgataaaggagacctagggtctcattccagaggaactatgttctaacctcgagttaataaccaaccggatgatggaaaagaaaatcaagtgattaaccaaagagacatttgtttggactaagtgtttcagatgtgtcttctttggatcaaaggcaacaaccgtcagtctagcttttgatgaaccacttgaaggttctgtgaaaggcagcaggctcaagtaccacattgccccagaagcatcctcaacacccggagcgaagagtacctggttgagaaaggtcgaaaggtgattaatggaagggatcggaaaagatgtttggttactgggaaaagaagtaggtcgaaaggtgattgataaaggataacgagaaccacgatttgtgtcactcgaggaagactcccgatagcaatcaaccctacaacagttgccctgtcattaaagtaggtgaattcacgagtaagagagatgaccacaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcactagtatcgttcaacgcacttttctagcaatcgatccatcgagaaagaacacatcaaggctgaaggtgcaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaagataatgatcagacaataagaagtccagcagtaaaactatttgggaaggcgtcaaagtatatcaagtgggataagttggttctcttgggaagcataattcaaaggcaaagttatcgacccttgcatcaaatagaagaagtagctatcacccggagaccaggaaaactaatatgaggcagttggtggcaagttagaagtaaatgacaagcatggtattctcatgatgacaagcatggtatcttagtaatgacgagctgatctcgacgcatgacatgaagtgggtaacttgtatgaggttgacgccaaagatatgaatgataagaagttctagaactgaagccccatcctcgaccgccacagcctagtctgagtcagttagaggtgcaaccagggaaaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcatgctagcctcctcgaatctcggggacgagattcttgtaaggggggtggatttgtcacgtcctgataaattcatcccgaattaaaaatcattcgctaaaaggaataatagaattaattaaaattcgaaaagaaattgacaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgattttataaaaagaaaaaccctaaaaagtctttttctccccccctccccctcttgggccggctcggcccatctccttccctctctctcctcctccccgcggcccactcggcctctccccgagcgcgccgctgacgggcgggcccgcccgccaccctcgctgacgggtggggcccacctgtcatccctatcctcccgccgctcccgccgccccgcccgcgccctagcgccgccgccgccgcgaatcccgccgcctcccgccgtccccgcgcgcattaaagtggggggaattattccccgcgatcccctctctctttccccccatttctccctctctctcccgcgttcaaacgggcggatttgcccccgcaaatctcgccggcgccattgatgacggccgacctcccgcgccggtttcctcccttccccggccaccctctctcgccccggctctatttaaaccctccccgcacctcctccgtccggttccgcctctcgccgcccttcctcctcgccggatttgagctcgcgacgtcgctctctctttccgccgtcgccgccgagctccggtccgccgcagtcgtcaccccggaccgcctcccacctcggcgccgcctccttcggcttcgccgcatcctcgccgacctcgtccacctctccgtttcggtcgccgaccgccggagcgccgtcgtccccgtcgacccgagccgcgccaccacctccctccgctccggccgcctcctccgtcgccgccgtcgccccagggtgagccgtggaccgtcgcctcctttcccccttccctcccttctctcggccgccgctccgccgcgccggtggtcgccggcggcgaccatcgggacgcgggcgcgccgtgtcacgcccggaagttcccctcccttgctctaa

SEQ ID NO: 75060 - DNA, 8509 bp, Oryza sativa
aaaccctaaattaataaatgcaaatattaatcggaatcggcatgtggaatttttcttggattctacatgtcaaaatacgctaacaggatttttagtggaattttcagagcattggaaataattttaaccaattaaaattgagcttgtgcaatatataaatccctggaaaatcctttcttcttttcttttccctcctttttcctttttcttgggcccggcccattccctccagcgccggcccgcttcacctcccgcgccgaccttccctcggctgggccggtccaagccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgcccgtaccgcacgcccacgtcgccgcccaccttccccgcacctcccgccagctcgcgcgcccgcaaacggcgggggatttgaaatttcccccactctctctctcctcctccatttcccccacgtcgccggccaaatcggccacctttccggcctcgtccgcccccccgagcccatataaaccatccccgcactcccctccacctttttcctctttccgccgctctctcccgtgccctccatcactcccgcaccgctacacccgccgccgccgccttttccactcctccggtcgccgctcgccgccgctggagccgccgccgagccaatttgccaccgccattagcttcgccgccgccaaagctaccccggccgccgcatccccatccaatcccgccatcggggcccgcttctctccgcgcgccggtgagtaccaccatagccgccgccgtcggccatggtttccgcccgccgtagaccaccctctctccctctaacccctcacacttcctctcttagggtgtcccggagctcggccgccgttcgccgtcgcccttcggtcgctcaccgtcgtcgtttgccgtcgtttcctcccgcgccggccgaaccccggtgagaactccctctctcttcctcccgcgcgcgccgccgctccccgcatgcgcgtcgccgcgatgcaccgtcgcccgcgtcgccggccgccgtcgtcttctcgccggccgccgccgtcggaggccgcttgccgccgccgccctcgccataaccggccggccggcttgaagccgagccgagccaggccgctttcccccccccccttgtgacgctgcccggtgggtcccgcctgccagccgcccctctccctctctcctgtgcctctgtcccgtgggtcccgcatgtcggcgccgccccaccccttgctgacgtcagccctgggatgaattattgcgcaataaattgattaagggtttttcttttatagtaataaacacagtgaatcttctaaaattcataactaattcatccgagctccgattaatcccattcaagtctcagtaaattcataaaaatgtgtagaatccattaaaaatggttttgcttcctgtttcagtagtcttatagcatgttttgcttgtgtgctttgtttgtcgcgtagatttcgcccgtttcgtcgattcgtggtttcgcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactgattagtttaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacaatcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgttcttttgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcatcatttttcatgcatctagtttatgcattaagctatagtttagtcagtcgcattagtgtctttatccgggttcatgaaaaatgttctatgcatacaaatcatcatgcttggctagtggtttgggccatttgttgcttggtttaaatttggatttgagcatgcattgattcctatcccttgtctaccttagaagtcagacatgttcttcgatcgcaagcgccgctccgagcttcagagtcgccgcccttagctttatcgtcttcttagtctgtttgcgtgctagtttttgtgtttaggtttgttgcttgtgggttaatcggcggtcgatatcatgtgtgagtggtatgacagccttaattaggaattgcgtgcctctttttcagtgttttaatcaagattaagataattgcacttaattttataagaaagattagtttccgagccatctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctgatgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgctcctgaagacgtgcgcaccgatgctgagaagcaggagaagtttttgtttgggctcgatgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacaactaggtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggccattttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcgatagtagaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcatcgcagaagcccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactactccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacataagcagcatctccgtctggtactcgagaaattgaaggagcaccagctatatgccaagtttagcaagtgtgacttctggttatcggaggtcaaatttctgggtcacgtcatttctgctcaaggcgtggcagtggatccatcaaatgtggaatcagttacaaagtggaccccaccaaagatagtttctcagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttataattctgccagatcagacaaaagacttccaagtctactgtgatgcatctcgccaaggattgggatgtgtgttgatgcaagaaggcagagtggtcgcatatgcttcgcgacagttgcgtccacatgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccaggacatcatcgggtcacgattcaatctgggtggtcgtggatcgactcaccaaagttgctcattttattccagtacacactacctatactgggaaaaggttggcagagctttacctttcaagaatcatgtgtttgcatggggtacctaagaagattgtatctgatcgagggagtcagttcacttcaaaattttggcagaaactgcaagaagaattggggactcgtttgaatttcagcacggcctatcacccgcaaactgatggtcagaccgaaagggtcaatcagatcttggaagatatgctgcgagcgtgtgcgctcgattttggtggagcatgggataaaagtctaccttatgcggaattctcttacaacaacagttatcaagccagtttgcaaatggcaccgtttgaagcgttgtacggacggaaatgccgcactccgctcttctgggatcaaactggagaacgccaattgtttgggacggaagtattaactgaagcagaggagaaagtcagaaccgtcagagaaaggctaagaattgcccagtctcggcagaagagttatgctgataaccgccgaagagagcttactttcgaagcaggggattatgtgtaccttcgtgtcactccgctcaggggagtacaccggttccaaacgaaaggcaaattggcaccacgctttgtgggaccatacaggattttggaacgccgaggtgaagtcgcttaccagcttgagctcccatctaatatggttggaatccacgatgtgtttcatgtatctcaattgaagaagtgtttgagggtacctgaggaacaagctagctcagagcacattgacatccaggaagatctgacttatgtggagaagccgattcgtatccttgagaccagtgagagaaagaccagaagcaaggtgatcaggttttgcaaagttcagtggagccaccactcagaagaagaggccacctgggaaagagaagatgaattgaaggccgcccatccgcacctcttcgccagctcttccgaatctcggggtcgagattccgtttaaggggggtaggtttgtcacgccctgaagttcccttcccttgctctaaattcataaaataaatcgtccgaagaaattgtttaatttaacctagagagaaaccctaaattaataaatgcaaatattaatcggaatcggcatgtggaatttttcttggattctacatgtcaaaatacgctaacaggatttt

SEQ ID NO: 75061 - DNA, 1610 bp, Oryza sativa
cggcccaaaaccctctctctctctcctcctcggcccaagtcggcccaagtcaagccgagccacgcgtgcgctcgctgcggttgacaggtggggcccacctgtcaggcctgtcgtctacctccggccggccgccgcccgaaccctagcgccgtgccgccgtcgtctccttccaaatccagccgcccctttccgtttccggtgaaattaatagaggggaaatgatccccgggatcccttctatcttttctcttatggaatcgtcggctaattttgtttggaaatccgtggattcgagttcgattcggatcgatctctctcctccgaaccctagactttccttcgcgtcaccggtcgccgtgagccttcgccgccgccttccaacccctatataaggacccccaagcctaccgctacccgtcgccacccttgccttcgtctctagtcgtccgtagcgccctagccccgtgagacctcgcgccgccgtcgtcgccgccgctccagccgtgcgccgctgtcgctccagtcgtcgccgtcgctcggggaggtcgccatcgtggtcgccgtcgcgtcgccgtcctcgtccgccccttcaccgtcgctgtcaaccaccggagcaccgtcgccgtcgtcaagccgaagagtgccgccgccttttcctcgtcgccgacatcgtccggtcatcgtccgccgtcgttttggtcaccggtgagttcgccgcgtcgcccgctacgcgtaggtgtcatccgtttgctccgccgcgccgtaattcgccggcgagcatgcgcgcccgagatgccgccggtggtgacgtcgtcgctgacgtcatcgtcgtcgtccatccgtgagccgcggtggatccgatcgatcttggccgtccgttgtagttaggatcgatctcggccgcccaatcttgtgaaccgccgccgtgcacccggttcaccgcgaaccctagccaatgacgcaataattcccttttccttttcaaaaataattcattattgcgtcataattcaattaaaatctatataagtgttttaaaccgatttaatctttgaaaattcataactaattcatcttagctcggatttagttggttcaagtctctaaatttttctaaaattgagatctacatgttaaaaatatctacatgtactgttcatgcttgttaatgtgctgttttggtgttttgctcctttctgtttagattccgacgtttccggagagtccgttttcgcaggagaagaatttgaagagttccaaggccagcaagtgtcacgccctgaagtacccctcccttactctaaattcataaaataaatcattcgaagaaattgtttaatttaacctagagatgaatccctaagtaataaatgcaaataataatcggaatcgacatgtagaatttctcttggattctacatgtcaaaatatgctaacaggatttttagtggaattttcagagccttggaaataattttaaccaattaaaataagcaaagtgcaatattaaatccctggaaaatcttttcttctttttctttttcctcctttttctctcttcttgggccgtcggcccagtccgttcgcctcccgcgcgctcgccctcctct

SEQ ID NO: 75062 - DNA, 64653 bp, Oryza sativa
aatctcaaaaggtggagcagagataaaattggaaatataaagaagagcattgaaagatgcagaagagagctagaagaaatgagaatgagaggaagggaagactcagaaccggatgttcacaggctgaaaatttttttgcaggaactgctccatcgcgaagagatttggtggaagcagagatcccggatcacctggctgaaagaaggcgatcggaatactcgctactttcatttgaaagcgtcttggagagcacggaaaaacctgattaagaagctgagaagatcagatggtatgatgtgcagtaaagaagaggagttaggagagatcgcacgcagcttcttccgagatctgtacacgaaggatgaaagccttaatccaggtgagctgttgaatatgtttgaaccaaaaataacagatgaaatgaatggcatgttgacaaagccttttacggatgaagagattagtgacgccttattccagattggtcctctcaaagcaccgggtcccgatggttttccggcacgcttctttcaacgcaattggggtgtcctaaagagggacgtgattgaaggtgtccgagagttttttgaaactggagaatggaaggaaggaatgaatgatactgttattgtcatgattccaaaaacgaatgcaccggtggagatgaaggatttcagaccagtcagcctttgtaatgtgatttacaaagtggtggctaaatgcttagtcaatcggcttaggcctttgttgcaagagattatatcggagacccagagtgcctttgtgcccgggcgtatgattacagacaatgcattagtagcctttgagtgctttcattccatacataagtgtacacgagaaagccaagacttctgtgcgttaaagctggatctttcaaaagcttacgacagagtcgactggggattcttggatggagcattgcaaaagttggggtttggaaatatctggagaaagtggataatgtcatgtgtgacgtctgtaaggtatagtgttcgactgaatgggaatatgcttgaaccgttttacccaacaagaggtttgcgggaaggagacccactcaatccatacctatttctttttattgctgacggcctatcaaatattctgcaaagaaggagggatgaaagacagattcagcctctaaaggtctgtcgctctgctcctggtgtgtcgcacctgttatttgcggatgacagtttgttattttttaaggctgaagtgatccaagcgacgagaattaaagaggcactggatttatatgagcggtgtacagggcaactcattaatccaaaagaatgttcgttattgtttagtgctctctgcccgcaggagagacaagatggaatcaaagctgtattgcaagttgaaagaacatgctttgatgataagtgtctgggactcccaaccccagatggaagaatgaaggctgagcaattccaaccaattaaagagaggtttgagaagaggcttacagattggagtgagagattcctttctttagctgggaaggaagctttgattaaaagtgttgctcaagccttgccgacttatacaatgggagtgttcaagatgccagagcggttttgcgaagaatatgaacaactcgtccggaatttctggtgggggcatgaaaaaggggagaagaaggttcattggattgcctgggagaaacttacaagcccaaaacttttgggtggactgggctttcgggatatccgatgttttaatcaggctctccttgctcggcaagcgtggagattaatcgaatcgcctgatagcttatgcgcacgagttctgaaggcaaagtactatccaaatgggacaataactgatacagcgttcccgtcagtttcatcgccgacatggaaaggaattgtgcatgggctagagttgctaaagaaggggctgatatggaggataggagatggaagtaagacaaagatatggaggaaccactgggttgcacatggggaaaatctaaagattttggagaagaaaacctggaataggcttatatatgtccgggagttaatcgtcaccgacactaaaacatggaatgagcccttaatcagacacattataagagaggaggatgcggacgaaattctgaaaattcgaataccacaacgggaggaagaggatttcccagcgtggcattatgagaaaactggcatattttcagtaagaagtgtttatagattggcttggaaccttgctaggaaaacatcagagcaagcttcttcaagctcggggggagcagatggaagaaaaatctgggataatgtgtggaaagcgaatgttcagccaaaagtgagggtttttgcctggaaattagctcaggacagattggccacttgggagaataaaaaaaagaggaagattgagatgtttggaacctgcccaatttgcggacagaaggaggagacggggttccatgcaacagtggagtgtacgctggccaaagcgttgcgagcttcattgagagaacattggacactgccagatgaaagcttgttttcaatgacaggaccagattggcttctagttctgctagacagactaagcagtgaaaagaaggcccaggttttatacttgttgtggagagcctagtatattaggaatgaggtggttcatggtaaaggtaatgtccctattacagattcggtgcgttttttgattaattatgataacctacagttgcccgcccgaaaacacatggaagacatcaaggggaaaggacctatgtttcaggatccatgtcagaaagagcagacatgtcagttgaatgcagagaaagaaaagtggagttgcccgcctgatggaagtgcaaagctcaatgtggacgcagcttatagaactgaaacaggcgaagcaagcgctgggattatcatcagagattgcaggggctagtactcctggctgcatataaaactttgcatcagtgtacctcagcggctgaagcagaagtgctagcatgtttagaagggctcaaagaagcaatgaagtggattcatatgccgattattctggagctagacaatgctgatgttgttaaggctctaacacagcaggtagcttcaagatcctcctgggcgacgacggttgcagaaatcaaaggtgtgatacaatgtatccaacgggtgcaagtgcacaagattaagagagaagctaatagggttgctcatgtgttagcacaaatggcaatgagtactaggtcgtgtggggagtagaggctgtgcgccgcccccgcataatcctagacttgttaaatcaagaatgtaaccctctatttagtcattaataaagttctctcttgacttaaaaaaaataatctaaacgaaaatagatagatttgtagaaaaaacaacaattttcatcacgaaaaaggttcaaatacagtacagtagtaagtttcctattctcgtcctgacgccgcggcgagccaggaggcagcgagttattttactcgatatctcgcgttttctcgtcactcagatctgatctgatctgacccctcacagtgaggtaacccctctcgcctcgccacctccccccctgttttctccatttctcctcccaatttttttctccgcatccgcagaaattctgtcccctcctcctcctcctccatttccgatgtattttattcgatttcgagatttgttttccggtgcatagagctcacgtacaaccgccgcgccgaacggtgcatgtgaactgttcggcgaaacgcgcaggtgaggagaggtcgcgaggagcggctgctgcggcggcggcggcggcttcgattcaggtgggggtgggtgccctagggtttcgctgccgggatggatggccgggagcagcagcagcagccgcgcgtgagctcgccgccgccggccggcggcggcgtgatgatgcctcagcacccctacggcgccgcgccggcgatgccgccggggtcggcgaatgttatgcacggggtgccgctctcgttcaaccccatggcgtcgccgaccgcctcgtcgcctatgaagcccgcggatatgtcggggaccatgtaccgcaccgatcccgtcgtgcagggcatgcagcagcagcccggttccggcggtggcggcacggcggtcggcggaggggagctcgtgaagaagaagagggggaggccgaggaagtatggtcctgacgggaacatcgggttgggactgaagcccgcggctgcagcagggacggaggccggcggaccttcaggtggtgcaggatcgaactcgaaccctgacgggaagcgcagagggcgacccccaggatccgggaaaaaaaaacagctagatgctttgggtaagcctgcatcatttctctgctttgggtttatatctgaactctgaaatgatatggcttaatatgactgaaaagtgcaatgttgcttggcctgtagctttggaaaaatatggtccaagcttgtggcgggtatggagtgtgattgttggaaatggaattaattcatgtgtttgcttgtgtgcattaaaaagggcatgtgtggaataatttttttaaggatccctcatcattctgaaggaataaaaatatggcagaatagtgcaggcagagatttgaataataaagaaaagtacaagcactctttatcctttcctggtgttgcactgggcacagtctaaacaggaaaagtaggaattattcaaatatgagcttagtctttgaatattgaacattcattggtgattggtttcttttatatatgttactttctattaagagccaatctatgtgcatatactgacaaatggacaatattttgctgatgtcctttttgcatgttttgaattacaataacttctacacttgcccctgcagaacagggcagtgtcaactcggtttacatattagtagtagtttgttctgttccatagtccttacccatgtggcacggtcagaatgataatgataatgccatttgtcagatttcgtagtttttttttgggtctcttttaacctcaactgaacttgaccactttgtgtggatcaataattatatgccagatctgatatatatgttcttttatgtgctgattttcaggatcttccgggacatcttttactccccacataataacagtgaagcctaatgaggtacctgaaaatgctcccctctctgctatctagtacgagctgaaattcattatttgtctgcttatgttgtcttgttgtgacaaagttacttttggagaacttaagtttttgatttcttgcttgtggtttgtaaattgtaataagtctttgtgccttacatattacatctgtctgctggtgggatctcaagtaatacaaccaaatacataagtgagagctaagaagagagatgtgtagcataagcttcctataataaataccaaactaacatataatgtattcttcagcatctttaaacttgttccctttttgagtttatttgagttgtcaatgccatttacagaatactccgtataaacctttcatttgtttctgaattagtaattttacaattcaggagattgcatatatttatgtcattatttgttgacttgattctgtcttggccaatgagtgtccttcctggctttgatcatcatacacttgccacttggttgtttttttagcgccaatctactacggattggacaccttttagcctattctcctcttctatgtttctacctgaagtccaagctgatgagcatgcatgcatcacctcttctttttggcaggatgttgcttcaaaaataatggcattttcacaacaaggccctcgcactacatgcataatttcagcaaatggcgctctttgcacagcaacactacgtcaaccagcaacttctggtggtatagtaacatatgaggtatattcaagctaaactatctgtgtgcagtgtgcttactgctcagagcaatgcttgagctccactggtgttctttctgtgaaatagtaatgaatatgcttaattaaagttttctcgatgtctttgtttcattacagtgcagtacaaaataggtggctagatttttcttagtagtatatgtgctactgtacagtggtggatccaatgcctcttgacaccgatgagttgcccaggcttgccatcgagccacagtagagcagtgctctgcagtctgcacttcctgtgttcggcaacaccagttgctacgtttgcctgaactacaagaaactccagtgtctgtcttgcactaacaaaccagatatatacatcacaattgccagcaacccctttttgaactttgtatgctttggtaggatgcactcagttgtccagctttctggctatgataacttattttctgatgtattccaatgataagaggagaaatgactagtatagtagtatgtttagaatgttatcacaaattgggggtgggggatagaatgaaaattttattcttctttgttctcaacagtcacaccaggtgcaagtaacataatatctaaatctgatgataaaggcttctggtcattttcatttacagcatgtggttgttagtggccatttctatgtggacagacaaattcgaacaatattcagttgctttgtttataatataattgtatttttttattgtagaaatcaatatatgaatatgaattcttactgtgatgtttcacagggccactttgatattctctctctgtcgggctcatttctgctcgcagaggatggcgacactcgtagcagaacaggtggtttgagtgtggcacttgctggaagcgatggacgtatagttggaggttgtgttgctggaatgctgatggcagcaacgcccgtgcaggttccccattcatctatttgctgctatcactttgttttcagctggtttgtgccctaaactagcattttctttggccttctgttacattctgttttccaggttgtagtggggagtttcattgctgaaggtaaaaaaggcaaggaagaacatctgaaacgtgagccaacatctgccccgacgccgaaccacgcagctggctttggcgcagccacggctgccagtcctccgtctgatggatcatcaagcgaccactccgatgacccagggagtcccatgggacctaatggcagcacattcaataattcaggtcatcccatgcattcttcgtatgctcctgttagctggtcgctatctgggaatcaaggccgttacgatcccgacctgaagatgatgaccgactagataatcctgtgtttttaagctctgttagctgttgacccagtagagtgtagggatcagggattcagtgtttcctgcaccgacaccaccggcagcgttggccaataatccggtgcgctagtagtaatcagtatcacaatgcctgaacaaaagagatcaggaacaaataagtagccccagcgcatggcttggcctgtcaggtagctaatttttatttttctcaatcggtagcttatttagcatgctttgtcagttgtcagcctagttgtacggttttcttatgaatgtttgtacacctttttcttttctcgctagtattcggcgtgtacgaatcttaattaagattggaatgacatgttattggatattgtcgtttttcttcgctgtgtttcaccctgcaaaaccattccactactgatgcgttttggtgtagggatcacatagacatgaattctgatcgcattcatacatggtaccagtaatggtgtgtataagtctatggcaaagtgccaaaatctatcgagaatccgcaaggaaataacttgtaaggacagtaagaaaataattcttgtgggataggaacactagagaagaattaataattgtgtttaaagacaaggtatttgccgtcagctcggcctacagcttccaaaatggtggcagcaggtgcgtctctgttttcggtcaaaggcacagagccgccttcgattctctgtgtatgttgatctgctggaagctttggaaagaaagaaacgtaaggatttcgattctatgttcatgttgatctgctggaagctgtaaggatttcgattctctgttcatgttgatctgctggaagctttggaaaggaagaaacgtaaagatttttataacagaaagggtggtagaacacttggtggcagacatcaggaggtcctctgatctgaagagtggccggaattttttctttcgaggagtagcagcatgtttttggcctccttaaatagttttcctgttctttttcgaggtttcccctcgactctgtaatatcatgtatattgtattaccctctttttttatgtatattgtattaccctctttttatcttaaagaaatttggtttacgttctttttcgaggtttcccctcgactcgacagtgtaatatcatgtatattatattaccctctttttatcttaaagaaatttggttgacgtccttccgccgacccggcaaaaaagttttctttttaggctatggaaatgatatatttgccgaacaagttttctttttaggctatggaaatgatatatcagtatttcgttctaaaaaggtgaaacaatagggatactaagttctaaaaatattttacatgaggcagaggcatgttggatcaatttgatttaagagaggcacgtggataacatattctcttacctttattggattggcaaaactaaggatgtcaatatcttgtactccctcggtttcatatttgactcttaaaactcctttatgtttttttgtttgatcaaatttataaaaaaaatagcaacatatatgataccaaaataatttaattaaatatatcattaaatatattttaatagaatattcattttgtgttaaaaatatcattatatttatctctgaattctatcaaacttcaaaaaaatggggaaaaaatcaaaacgactagggagcacagcatacactgacacggctacatgattacattcatcgatataagtagatccgtagatgcgtacttcaaaaacacatgaaaacgaaagccctttcattgaacagaactacatcaagcatgttaattttacatctgacactttttattccagcacacgcatgtgcacacagcatacacgcgtgcgtacgaacacaagctaacacgatcagcggccgggctgggaccagatcactcgctacactgaaaaaaaacacactagcgatccagatcgatcaagcccgcccatgtccatctaccccaaatctagatgtacgatttgtcggacgccgcgtacgtgccggtgccggtgccggtgccggcggccgggtatgcagggtcgacggcggggccgccgaccggagcgtggtggtggcggttgccgccggccgtaagcggcacgcgcgtgccgtggcggcccgtggtggcgttggcgcggtgctccgccctctcctggtgctcgtcggccttggcctgtgccttgccggccttctcctcctgcttggccatctccttctcgccgtgcgtggccgccgtcgcctggccggccttgccgtgcgccttggccgtcccctccttcaccttctccttggcaccgctcaccatgtcctgcaccttcaccttcgccgtctgcatcttttcttttcttttgctcctacagtacagtagctacgtgcgttgcgtatcagtgtgagcctgtggattgagattcgttgcttgcgttttgtgcttcgacttgcgacgtgttttggacgattgggttgattggagtagagtatatataggccatcgacgatgatgggatggatcatggatgagatcgagcggcggcgttgggtgttcgtgctaggtggcgcgcatgcgggggatgcgggaggaggggatctgcacgtcacggcatgaggtggcgcggagcttttgggcctcggtgggcgcgtggctgcgtggcgcaccgtcgagccgccatgtgcctagatgccggccgtacgtcgtccgtgctcgtgacctgacgggcatcgcattcccatggccaggtacgcaacgcatctactccctccgtctaaaaaaaaccttaacctaagcaaatatgtaacatgtctccccgcaaaaaaaaaaatgtaacatgtcgtagtacaatgaatctggataactctttattcagattcgttgtactagaaaatatcacatttccttttaaatttatttttttttctgaaacggaaggtgtggagggagtatgtgttcagcttttattttttcccttcctcttaatgacacgttggagtctcccggcctattatcgctagactcaaatggccggccctgcagcccatataaggattttgtagtgaaaggagtacatgcacatgggcctgatctagaatgttgaccggatcgattaacgatgcgtccggcctgtactttgatcatctcaaggacagtaccatcacattttcaagttcaactctcttttgttctcgagagaagttcagttgtctccaatgaaagtcaacgctttgctcctctctgaaggtttcgatacagaattttttgtttgaaaaggaggattttctgtattgattccaagtcaatggtactagttttgctcaactaaacaaaagtacaaaacacacgtacatgtcgaattcaaacatgttgctagtggatgaaaaacgccccagcttttacacagttcccgttcttttttccaaaacaaaaagttagacgaagattaagatttttgtagcacgcttttcaaactgtttaaataaacagtacgtttcgtgtaaaaactttctatatgaaagttgctctaaaatatcatattaatatacttttttaagtttgtaataattaaaactcaatcaatcatacgttaataccacattgttttgcgtaaaaagcttaatcttaatcttaatcttcatctttagaaaaaaaacaccacctagattttttttcctatctcctaatgcacttgaattgtttaatttcaaatttctatgaaaatcacgcagaattcatgcgattttagacagcccacacacaaacacagatgcatataccatgctgaatgtcctgctttaatctcctgtattcctacaaaacaatacacatccaatttctcttaatttacaatttacaaatcactttactgatcactctgaaagatgatcagttgagagatttgaggtagtccttgaggtccgtggggaagcaagggtactgcctccagaacgcgccgtgcgctcgcagcatcttcaccgccttgtccttggtcgacggcgagctctccacttgcatcagcgccagcagcttcgccacggcgccgcccaccaccatgtcctccagcaccctctcggcgggggccggggcgcacgccaccagccacagcacgttgacggcgagcctcgtggcgagcccggacacccggagcacggcgcgcgccacggcggccaccgccagcccgtgctcggcgaaggccagccgcccctcggggcacttgcacatgcgcttcaggaggaggagcgaccgctcggcgacgtggcggtcggcgtcgaggaggagctcggcgaggacgcgcacggcgcccagctccacggccttggcgcgccgcgcgccgcgggagtaccgcgccgtgacgtcgaggagcacgtcgagcgcgcgggagctcagcttcgcggaggcgccgtcggagaggagctcgaggagggccttgaccatgtcgtcgacgtcgacctccgcggtccagtcgcggacgctggccctggagatcttggagatcatggacattgcgtgcagcctcgcctcggcgctgccgcgctggaccagcacggacacgggccttatgcactccggcttgagcaggagctccaccgacgcgtcgtccgagagcggcagcgtggcgaggacggcggcggcctcctcgcacgtccggaacgccgagaagtcccccccggcggagctctcctccagcgcctgcgtcatgacccggccgagcacctggatgccgccgcacgccacgaaatcctcccgcgccgcctcgtcgccggccatgcaggacttgaggttcttgagcgcggtcgccttgaacggcgtctcctcaatgccagcgagcaccgacggcaacctctccctctccatcgcgtttgacgacgacgacgacgacgtcgtcgccggcgagccggccgtgctcggcgacgacgacgaggaggcgcggtccagccacgacgagatgacgcgcttgagggtgtggttgggagtgaagtcgaaggaagcaagccgctgcatggtggccgggcacgtcgtcttgccgtacttgaagaaccaccgctcgatgctccggcggtcgtaggtgacgccggtggccaccgtgacggggtcctccattagctccatcgagatggggcacaggaacaggggaggaggctccattgccattgcgatcaaacaaagcagcagctcgatttcttggcttgagtgagaaggttgagggagaccaagctgggatgttggttttatacctgtaatgtcatcatatgcaattaaaaagtcaagctaacccaaagtacagccgcaaaatggctcaaattcaaataactaatgaaatactcccttgtcgaaatataggtatattttgtttcgttaggataaagctttgactaacaattgttatactaatatactagctctatattacattgtaatagatgacgccgttaacttttgggtacacgtttgaccattcgtctagttttttaaaaaaattatgtaattattatttattttattgtgagttttcttatcactaaaaatatctcatatatttacatacaatttttgaataagacaaacggtcaagcatgtatctacaaacaacaacgccatctacaccaccacaccacatttcattatatataagaaaaagtttttgatatgaatctaacaatatcaaccaaaaacatatgttctaatagactaattgttggtgctagaaaatctttgagaaaaatgaagaatctcagacaatttagtgctagaaaattgtaatacctgatgctcgaaaatctcagagcaaaatgaaaaaaaggtaaatcatgatgcacgagaaaaatgaagatgccatccgtctccttttcatctcaatagcaggttaaatatatgaaaaaaaaatgttttcttaataacgatacgaagatatgagaaactatcaaaccaagtcaacaattcttccaaattaaaatcccgtaggggaaatgcttaaaaagtacagcttgcagcattagtacattatctgttatgatttctaacgatctgtattgatgtaaaatactctagtcaagagtcagacgggcagaatagtaagcgatcgatcgatggctacacattaaagtgccactgtgcaatgcatgcaaaataaataatactaagtctatggattggccgtgatctgtattactcaagacttcgtctcttacctagagcttatgttctatggatcaatttattcgagattttgacgaagaactagagactttttttattccttttgttttgctgcgtgcagggagcaattcgatgggcgtcgactggagcaatctgatgggcgatgatgaggtgacagtttcacaagtattaacctaagacttggtgtgatgctacttgtcagaaacgtaatgaagagaacacacttgcttgcttattcctttctgttttcttcttcttcttcttcttcttctttttttgtggagacagaagaagtttaatttttcaaaacggcaaatgcatctttggagttgttaaatggagattggggaggagctggcagaggatgacggtggatcttgaattgttaatctgtccggttctatttcttcttctgtttgttcacttgcatgttctttttcctctgtctgtattaattagttgcgagcggttgagcgtttcatttgaccgtgattgggtcatccatccatccagccgcattctcatattttctttggatgaaattatattatagagataagaaatttgcctgtaatgtcatttagttagaagtttcacacctctcaacatcatattactgacggcggatgattaattaatggtaaaaaaaacaaggtggattgcctcttgtaatcttgtatctatacaccatcttctgtacccaattatattttacctatacaagggcttttagcttgttaatgctgacttccctcccatgtataatgtatttttcagaaatgaaagatcatgtgtgccagattacttgggagtcaaaattatggtttctcttaatgtggtttaggtgatagtttggcatcattacgacatctttctttgtcatgcaccgtctgccaactcctgaaactaaaatggaacagaaaacgagtacaagtgcagttccaactaaatcactgtctgacaaacgagtactgtcttcagttcatcatatctgagctatgaagatctatttcatcacagagaatctgtttctgctccaattaattagcaagtagttttaacaaaaataattaataagtatcttgtggttgtcatgccttaatctgccagcaaaacattttctatatgattaaaatggctatatcaaccgtactgtagtgggaacatggatgatggatcactttgttgctttattttttatatatagtattttgctaacgcaagccaaaaaaaaaaaaaaatggttggccttaagctgtccattagtgcaccgccagttagcggaagatgcaattttcaaaacaaaaataaaaaacttgcacgaaattatgtttacgaatacttgcatatatatatataagcacccactagttaatacccacttgctagttgctacactgacgttccacacgtcctaagatcctatcgtttgctcttgccatcgccatacgactttaagagtttttatttttaagtcttgtactttgacaaaattaggcatatcgtcgaacaaacgctccctgttcgatttgactgtggcgaaatattcttttgaacagacgttgcaatcggcgcagctgctgatgatcatccataaattgataaattcgttgactaatcgatctgaaaacaaaggagcgtcctgacaagaactgtcaccggctggtggggttacaatatttttcagaatttggaactgctcagagttgaattactagtggtaataccgacacgttactcttactaggttcttatcctttctttgtccaacagtaattaactttaaattctgttcctgtgaacagaagcaataataattccactgcggtgacaaaactacattgacaattggcacagagatcttacctgttcgaacttcgagtttcttctcgggaagacttcagatttcttaatttcggttaagcacacagcgtttgacattaatcagttgcttgtttttgcatccatttcagcaggctaacgttttccaaacgtatgactgcagattgtagaaaaaatgatggtcggatgattcataacgttcaccgaattaacaatcgtgcttccacttggagcagctacctgtacctgcatgattcctttcaaacattgttgtttattcctacattgcatcttgctagtgggaattgatcctgacagtttagctttgaccatcacatcaactgttgtttcagcaaattttgtacctgatatctctttccagggaaagacaatcagattgtaaacttcagctctgtttcagacggcccaaatatatattttttcctgtcattgccacaaatggtaacattacaaagtcgttttcactattcatccgtatataatactctatcgcatgcgtgtacatcgaagtcagaagtaacaaaagaaaaggaaaaaacatgaaaatgatggtctattccaagtgttccacggcattgccgacaccgaattggggatcactcaatcctctgatggtacacattaaggacatagctgttcagaaggtcaccaaatgtcttggttgagaacttctgcacaacatggccccttgcttgtttacccatcttaactgctagatcgtgatcgttcacgagcttcagcatggcttttgaaaattcaggggcagagggctcacagagaaaccctgtctcgtcatttatgactgtttccactggaccaccactgttgcatgcaattacaggtttatatgcggccatggcttccagaggaacaataccgaaatgttcatcctgcaaaatgtcagacgcaggtttattatgggaaaattctcatgttgttgagaatcaaaagacatgccagatatttacctttggagtgtataacacacaaaggcagttggagagaagttcgttcctttcagaagttgaacaagatgtcacaaatttgacatgttcagaaaccccttcactcgctgccaatcttttgagctcctcaaggtattcaacattttctctgagacgcttatcatatccaccttaagcataatcttttgtaagtaaacagtagttgccagttggtaattcataatgcagtgacgatgcaacattcaacctgtagtggaaaggaaattacctgctactgttaaggttacttcctgtcgagcatcaccaggtagcatagaagcaacagagcgaagcagagaaaatgctgaaatggcaagaccaagattcttttttctctcaaaccggttaattgagaggaaattcaacctgcgcagaaagatgatggttaaatttggctagacctgaaggtgcagaaggtgagaaaaatgcttacacttcacactatactatttttttttaaataaaatgaaacctaagcgagttacagagagatatacaagcatgcagttacttataagcatgaggttcctgaaactgttcaacagagacagctggatatagaacagcaggctcgactcctctagcatgaaggctgcaaaaggtcctggcaaatgttgttgcagtgaacttgctgtttactagaatcaaatctgccatacctaatacatacaaaaaagggataagcactacagatagaacaaacactagggaatggtaaaaaacatagcaggcaacagttctagatgaacaagaccataccagtagttgtttcttcaatcatgtcaattggcttgcgatacaacctccgaagcatggtagtatgttgagcaagcaacatatcaggaaagtgacaataaaatactatctgaatacacgggaaaaagaagttatcaacatatatctacagtggaaacatactgatcacataaagcaagggatcaataccttggattttgccttcagtttaagcagtggaatcacaaccgaaacctggtctactaatatgatgtcaaatgagggccaccaaagtagcacacacattgcaacaaaaatgcagcgaagatatgcacagatagcgtggaagcggtaaaaaatatggcgaggcaagaaatctccatatactttaacttcaaatggacctgcaggacaatagaaaatcaagtaaagtttccattggcataagaatccctacacactattgagcgatttgagtagggtatccgaggaaacgttttgtgaaattttgtacgtaatcaatcgacaattcacataggaatatatgcatatcctctacaagtccacatcaaatcagtcatagtacatagtaagtctttaacacaaataggtactgcaactaccatagtaagagagttataagcaacattcacctcagatagagtttagatccttaccagaaacagtctcttcaaagcatcggtttttgtcatgatgtgatgtgaaaacatgaacatcatgaccatggaccgcaagctgacaagccgcatcgactatcaatctctcagcaccacctacacaaaaacatatgttttctttgaacaattgagatctagtacaatgctagaaatgctgccacacttagtccattggtcaatgtcctataacctgctgcaatactgctacaacattttttttctcgaaaatgttcttaaaaatctcacctgcatataataaacaagccgcaagtcctacattcaaatgaaaccgtgcaacggcttccccaaaaaataagccaattctagggcatcactactcactacttaactagaagtatcaacacagtatggaagtgaagaagaagaaaaatctttccctaacactcagactaccccgtaattgcagcaagcaactaagcatacgtcgaaccttgagcaaaattgaggaacccaacaaatatcccagctacaagctcaggcagcaacggttcctcaaatctactgatgcttccaccgcgtggactcggaattgctacatatcgaccaatttacaaagtagcacgcaaccaatcgtttcggggactcaaccggatctaccaaaattctgcccacgagagatgagggttcacccaagcatcgacaggagcaacaggaggggggagagagagtagaggcgtacctatcccgagatcggggtggatcacggcgaccttaagctgcttcgtcctcgtccccgacggctcgccggcgactcctcccgccgccgctgccatctccctcgcgtaaccagatgggcttcggccgccgccgccgccgccgccgctgcgggccgtggatctctgctcgctaactcgctctcgctagtcgtgtcgtcacgattccagctgagttgatgtgcgggtggattgggcctcatacagcccagtatctgataacgcgtgcgaatcgcttacggcccagtagcccatatcaatttgatggcatcgagccgtcgagtactcgagttcgagtgctcgcagaatgcagatttccatagcatattatttcggggatggctaattagcgcgtacgtgccctttacctaagtcgcgcgcgcgtagagaagcggtgggcccacttgttttcggcatcacgtacgaagaaaagccaaactcccgttcgtgtttctctctttttttttccggaaaaaaaatcgtcacgggagtgcttaattctcttaaacacttttaacttagatttgaatcttttcaactttgattcgaaaactttcaactctatatttgaaagtttaaatttatatttgaaaattttcaagtcaagcttgaaaacattcaattcagatttaaaaaattttcagctcagatttgaaaactttcaagtccagttgaaaacttttaccttagatttaaaatttttcaaatcaaaatttgaaaactttcaactgaagatttgaaaattttcaactgaagatttaaaatttttcaactcaaattttaaaacttttatcttaaaattcgaaactttcaacttaaatttgaaaatgttcatgttaataatagagctaattactggaaaaaagaaaaaaaaaagtatgagatcatagcgctacgtactcatgttaatcacgttagatatggcgttaatcacacactaattgtatgagttggcacctgcacgtgctttactaatgagcctgcgaacgtccgaaacgcgcgctgagttgacccgttggcgcgtacgcacacaacagcaaatccgtattatttcttgcaccaggatcctgataaaagatgtaggtatacaagtggatcacccgcgaagctttatagattaaattaaataaataggcaacccacggccggttcccgtcgtcaagttggttagtaagtaacccgtggattaattcataggttgcccactaattttgtttaagtgggtacactaattttgtttaagtaattttgtttaagtgggttcacggtcaactcacttcacagattcatcttgacttcaaagtaagacttcaaagtaagaggaaccgtcacatatcatgaaaaatttgcctcacagcagctactgtacatatctgcttcgatctaaactgctcatcgactcatagagtcataatgcagtcgtcctactgctacaccagggcctcaaaagaagaacaagatagtgatccactgcatttgcaaaacagttttcaggtaactgctgtactgattttacacgcgagaagatttcaggccatgatgcatctttcacacataagaagggcagtatcccactgggcagttcatcacaagaccatatacagtcatggcagttattaaggccaagggtcctgatcacagtctcagcatttagcgacacacgctgggacacgatatccacacttggaagtgtaagcagtaacatggtcacacggttaattaagcctaagcagcagcggtgtccttgggagagcacggcgtaggctgggcatcaggcgacaggttggagatggagatgagctttgatctgtacttctctgccccgtcatcgtcgtggtggtggccattcaccatggcgccgctcggtgacttgatgttgacggcttctcctgccgctggaacagaccgggagatcgcaatcagagactgacgggcagcttcctgagtgaactctctcggtgatgcaggtgaggccatcaaacaaacaaaggctgcaattcaagcataacaggaaggtgtaagtatacgatacagcttattagaaggcttggcatataaatggaatgaataactaattaagtagatgctagtcattgagctaaattaggcagcttataattgtactactaccaacactcctaatataaagcaataaaaatagtaatgttgaaaacacaacgtaatggtccacatgaaagctcctaaaatattctgcagtaactgcatgtcagtttcatatgaaaaatgttatacataaagggcgattccatcctccaacctctgcttaagcctgaagtgtgctgccctgattgagtttccgaaaaagtagagttattcaatttaagtggagcatttggtatacatgggacgaacgggttcagtttgtgtagtcgcacaaataattgctgagctatgcacccgttagcacacactgttttagcatgaaagatgctatttttgttgcaaatgatccacccataaatctgttgtggataggatatcaggcagacaggcaccaaacaatcacactgtattcttgctaaaaaaaatgacttgccttttgaatgaagagcattttgatcatgtgactactgaatttagactggaagcatagactgggtacataatctggagtgagattttcatgctgcttgaaacgatttagtacgtttttcagtactaaggttaaacatcaaaagagtggtagatcgcaaaaattaggtaggccatcactcaaacagtccctcatatatagactaaatacaaccggtcgttttggtaggaccagctaaaatagactacttactagaaaagaattactactccatataaggaaagacaacctcaaattgcagattactatttcaaagcgtcgctactatagttacgtaaccttatcctcagcgtgaggtgcacctaccaaaccgaaaggcaccaaagaactcacaagcatttcactagtattacgagcttttcggagttccagtatcagccatgtggactaaatcgttgacgctccgaataccgcgaaacaggggcggatccaacttgggacatgaactgaacccccaaaacttttggggaaacaaacaaactgtttacttgtagtaagttcaaggctctgaaattaagagaagagcttcttccagatctagaagagaagctaggattgacgaacgcaagcaaaatcccagacaacagtactcccggtgggagagagatgaatcagaaagagggtgtggatgctcaccaggatcccctcccctcccctgttcagccgcgacgcgagatggcgcacggagctgaggagacgacgagacgggtgtttttccttttacgccaaagagaaggggagagatactcgagaaatgagtactccaccttatatctctttttttaggatgattggtggcccacatatcagcattactcagaaaataaaaatgcaacaaattcaactgggaattgtgtcgatgtcaaaatttggagtgattctctaattggttcgcttaaggaaaggagtcgattgatggattgaagttaatcgagagatcaaatttatgtaggaatcgtaaatattacgacatgacaaattaattttatctattaattagacaagatttagaaactttcctttttatctttggtaagtttcatctagtgtccgatgacttgtatatttccttttacttttacttttaggaaacttgtgtcgtgtttcgatcacgacttatatcaatctataagggtataaatatatacacttaggatctatagaaaatatttctatatatcaatacaattatttttggcacaccatcatcttttgttccagcgagttcttagttttgagttgggatgtatcggttttgatctccggcgaggatgttccgtcaacttcgcttgtattggcgtggttaagtccgatattctattcaggttgacgcaaaacgttgcctatttgatatattagttctatctttaactgtattgctgtttagagtcgtatcggcttagatatgacttttttaattagattcgatattctgactaagttgatatttctctaatcgtattgttgttttagataaacatattgtattttttataatattgtataataatgagataatttattgaaccttatttataaaatcttacgtccgtcattaccgcgaaaactagaggcatgacaagaaaatgttttcaatactgtaatagcctcctgaaaagaagtactccactacactactaaagaacagttaactaaatctcgagggagatcaaatcaaactagtcaggatgtgttcatcgccataaacaagactctttgctggtgttctttttttctgaaaataaatatgaagatgaagattaagtttttttaaagtaaaacgagatggtattaacgtatgattgattaagttttaattattacgaacttaaaaaataaattaatatgatattttacaataattttcatgtagaaagtttttacacaaaacgcatcatttaacagtttgaaaagcatgccacaaaaatttttatcttcaaccaactcttgttgaagaaatgaacggacctttatcccaacaaatcatgaaatctccccacacggaacggtagacaagaattacttccatggttaaatactcacgtactcgcgactgaaccaaaatcaagtaatcaaccaagcgacgagcggtcaagcaacacaaaccaaccacgatatactgtcagtacacaatccaaccggagggacgcctgaccagctagcaataatccggtgcagaaactaacgcgcttataaatacacgagatgcagagcgagcgcttaccagataatctggcaggacagcgggaggctgcagggacgagcgatgaggctgcagcctgcagggccgaagatgagagaaagctatgggcgatggagagttggagacgattgggggaaggaggccaaccgaggatgacaaggacgacagggtgtgggttcggtttctttacggagtatatgaccgtgcacgttgatcacgacgcgcgggggttgagctggtcggtgagccatcgtggactaccgccgcatccaccgctcgtttgctcggtggatggtggggtatcaggctcggtccatagaccaggttctgggcattatgcctcgcccgtgatgaaacggacaagagctcgagttgtaaaacacttcgagaggtgcacgtgaggtgtcgtatctgcacgaatcgcgaggccatgtgtctctggagaagtcggcgaggtgaggcgcgctcggagctgcgggccccacccgcagatacgtctgtagcctggagcaaggtggggccgggccgtgctggaccgaataggaaggggagcggacacgggctatcatccagcccagtttgttcgtcactattctgttccggcccaaactgctggtgttactgttacgctccaaacctaagaaccatcttctaactgcattgtgtcacatgtaattctgttgcaaaacctcatggcagccattttgttagttgtcgaactactttcatttcattaatgaaatagaagaggatctcctctctttctaaaaaaaaactcatggcagcttatttattcttcgcgttatccaactctgaaatagtttggctttgagagtttcagttattggttggaatagctagcttttctttgcaagctgcacagctattttatcgctcgaatacgaattgtatgaatgtgatagttctggaaatagtagtgatgcatttgtgctcattagatatatgcgttacacttgaagaagaacaaagtgaaaaaacacacatcacatctatatgcagcaagtatcaacggaaccaaacgttcccctcatttattaagcatggattacacttgaaaagcgaactgaaaaacacgatcagagaagcagcgtcgccaactgccgctgccgcccggccggcgaggaagaagctagtcagaaccagcgccgtacggaaaatccgggctcgggctcgccgtccgcgagctgctcggcggcgactccgcagctgccacgggcggtgagcctccactccgaataaccttcgggttgggtcccgtcgacccacccacacggccggctgcaccgtcatacgcaggcactgccggggagccactggacacggccgtcggagaacatggtggtggtggacgaccagtcatgttaccggaaaacgtcggcgacggcggtggtggtggtggacgaccggtcatgttaccggaaaccgtcggcgacggtggttcatctgggctcttgtgcctgccaccggaagctctcggcgtgtcctcctccggcggcgcctgcgttccaccgccggaaactcttggcgtggaaggtggtggcacacgtacactggcgtatgcgtccggcggtgtgtgcttgccaccggaaactctcggtggtgtgtcctgtggtggcggcggcgaacggacactcgtgtttgcgtccgggggcgtgtgcgtgccaccggagatctttggtgtgcgtggcggcggcgatcttacacttgtgtatgcgtccggcggcggcgtgttcgtgccactggaagaagctgtcggatgttccggtggagggagtcgcacgcttgtttcaaccactggcgccggcggcggtggtgttcgacggggaaaggtctttggtgaaccaagggaaaatctgggagcaggcggtggaggagagcgcacgctcgtttcagacatcggtgtctgcggtggaggtgttcgacggggaaaggtcttcggtggaacggacggtggaggagagagctcgctcgtttcagccactggcgccggcggcggaggtgttcgacggggaacggtcttcggtggaccaagggagaatctaggaacgggcggtggaggagagagctcgctcgtttcagccactgctgccggcggcggaggtgttcgacggggaaaggtcttcggtggaccaagggagaatctgggaacgggcggtggaggagggtgctcgctcgtttcagccattggtgccggcggcggaggtgttatacggggaaaagtctttggtggaccaagggagaatctcggagcagacggtggaggagagcgcacgctcgtttcagccactggcgccagcggcggaggtgttcgacggggaaaggtcttcggtggaccaagggagaatctaggaacgggcggtggaggagagagctcgctcgtttcagccactgatgctggcggtggtggtgttggaccaggaaaggtctttggtggactaagggagaatctaggagcgggcggtggagaagagcggatgctcgtttcagccgttggtgttggcggcggcggtgttggactgggaaaggtcttcggtggaccaagggagaatctaggagcgggcggaggaggagattgcacactcgtttcagccattggcgacggtggtggtggtgttggactgggaaaagtcttcggtggaccaagcgagaatctcggagcgggcggtggaggagatcgcacactcatttcagccgttggcgccgacggcggtggtgttggactgggaaatgtctttggtggaccaagggagaatctgggatcggacggtggaggagagcgcacgctcgtttcagctgttggtgcctgcggcggtggtgttggactgggaaccgatggcgcgcacgcgccaccgctgctggtgggaggcctcgggctggcttgagcaccagcggggactgacgacgaccgtggtggcgccctggaggtcgccgcgacgccggcgcaatgccgcagcaggccatgcgggaggagcgaggcgacgaaggtgcgggtgaagggcccgcagtgctcgtcggcctcgcacgccgcgaggcggcacgcgcgcggaatggggcaccccgtgaagaaggcggcgagcaggtcgtgcttgcagcggcccagcgtcagcagagactcccagcagatgcccgagtcggtgtgcgggccgcccgggaagatgctgtcgaacgtgagcgaccgccgcgccggggtcgactgatcggcgccgccgccgtgcgcgacgcacgcggccacgagcgccgcgagcagcaaggccgtcctcatggttggcctcgcaaaaccgcagctctctttggctgcacctgttgtgttttgtgcttcactttggagcaccaaggccgtagtagcgggaaactgtatttatagagtgttgccaagctgttaattgtcccgatcgttttgcttgcacgttgggaggttgcacgtttagattgattaatgctagcgtgttaattgtgcatgtgtaacccaccccgaagatttgttgaatgttcatcgatggtttctcatctatgttctgagttctgacgttttctctagccaatgctgtgaattgccattactcgtagttgttgaccagtaatgtttaattcatgagtaaatagaatgcgagtatgtgaccatgtctgaacggttatccagatggaaaagtagaaatacaagtaaggaattttggacttgaaatgcaaatcagatgagctgaaagtctaaacctgtatgtttgtggagtaatatatttcatattaatctatgttgtcggtttttttcatatttttttttgactatttagatgacatgcaaataacgagaggatgtcctcgagagggatgaaaatccacatctcctataccagattcaacctgtttggcagctgagttttccaatttgtcttcctcgttttccgtgcaaaagcttttaaaactgttaaacgatgtgtttttaataaaaagccttttttatgatagttgtttttaaaaaatcatattaatctattttttttaaaaaatataactaatatttaataaatttcgtgataataagttactccggtttttttttgtatgcgggagattagttcccaactggaaggaacaaaacgcagcccggcctgatgatgaattttttaataatccctaaacatagagtacctattaactttcatattgtcaagttgcaccatttttttttaaaaaaaaaactgaagcgcctgatctcgatgcctacctacatatgaggatatatgacgcgtgtttttttttttctctttgatcattcgacagaatccctccttgtccgataatgaatagaacacacgcactcgaatcggattcaacagagcccccgacttttgttataataagttagcgtatctctcgcgcactaacttcaggcctcatcgatcattcatggcagtcgaggcatgcagcatatgtcgtcgaagaggggcaagagagcacgccggtcgtccgccggccagccgctgccggacgaaatgatgacagaaatcgttctgcgcctgccggcctattccatcgtccgtttccgcgctgtctcccgctcatgggccgctatgctctcttctcctggattccaggacggctacgcggccatggcagatgcccgtcgcatgagcatgagcaagttcgtcttctttgcggcgtcgccggcgtcgcccagaggcgccacggctgtctactcctgcgacgtcggcccagtccggcgcatcacgacgacgacgaccgacttgctcttcaatatcgaccgcctgcgcccgggcttcctcgtcgtctcaagcaggccgtgccacggcctgacgctcctggctgacactcgatccttcgcctactgggtgtgcaattccagcaccggcgtgttcaggccattgccgcggcggcgctgccacgatctgtccagcgccggcctagccttcgacgatcggaccaaggagcacaaggtggtgcatctcttctgccatgtgagccgtggcggcgagagtgagtccatgaccatggttgcgaggtctacacgctctgcaccccaagccgcccgtggaggccagcctccggaggcataccggggcgtctcggtggcgtggtgatctgcgccctcctctacgagggcgcggcaaccaaggtgcccccggtatacgccaatgggttcttgcactggcagctctaccctgacaaatacttgatcaagacctcttccctgacacgacggtatttgagaaccgaaacagcagcgttccagtgctatgcttctctgttgccgacgaggccttcagcctggtcgctgggccggcggtcgacggcatagcggattactgcgctttggacagccactccccggctgttccactccacctggtggagctccatggctctttgtgcatggtccgcgatctccgccatcttccgcatggtgaaagctgcctggagatatgggcgctgagagattacagcgccagcgtatggtcactcgacttccgtgtcgccatgacgccgcaggtggcacgcgacatgcacgatccccggttcatcaccgtccttggatgtctcggcggcgcgcgcggagacgacgtcgggagtgtggagcggatcaagaaaatcctgatcgctacctcgcagcacaaggtgcacgcctacgacccagctacggggagcatcgaaacggtggtcaccgtcccagaggatttcgccggcggccgggaggaggcggtggccggtattcggattggtctgtacgaggacagccttgcccgtgtaggcggcgagagttgtcgacagagggaagccacggcggcgatgactgagatcctactacggttgccgcccaaatcaatcgccatgtgcatgctcgtttgcagacagtggcgcacactgatcgagagcgagcgctttcttacgtcacacatgcttgctaacatggaacggaagaaggtcatggtagtcacgaatggccgtcgacgggagaatttctttaatttcatgccggtggagacctggattgggcctgccgccaaagctcgttcggacgttcttgtcaaccgcaggatcctctgctctaagccatgccatggacttaacctgataagcaccagcagcgacgactacctgtgcaacccttgcactggttctatccggtgtcttggaatccgtggaaagtttcgtgagattgatccaactgtcagtattgatgacgatcgccgccatgtcacgagagttggcaggaacatcgggctaggattcgaccggttgtcacaagagcatgtagtggttgagatgagccgcttcaaaggcgacctgcagctgtgcatgatcaagacgagctgcgtggattactggagctgcgctggcaagccgccgaggccggtgaccgacatgccaccggcacatgttgacgggacgctctactggatcagcgagccacagccgacggcccgagaccgtgtcattgtggcatttgacatctcctcccgggagttctccgtcttgccatgccagccatgctgcagcgagagggacggcggtgattatccgttgctcgtcgagctggaaggatcgctgtcgctcgtcgtcgcaaacgcggaggagaacaatctgcagatatggacgatgcaggaggctgacggcacatggcacaaaagttacagcatcttactggacgagaggtacccggacttctcactaaaaacgggcgtggtggtagtgccactggacgccgtcgccgatagcaatggcggcggcaggatcttgctcgacacagggcgagcattgggctactacgatctcgagacgagaagcatcgacaccttgtactcgctcgaccagctaaagcttccccagtgccagatggcattccccatgctgtacggggatagcttggtgcccatccaggacgacgaaccgcccgactacgtcgcgccgactcttcgcgacgacgacggcgggcggcgctgctactaccagccgcaacacgtggagatcagcggcggcgagcagcctgcggctgcctcctgcgtattccggccatgcgaggcggccggcggcggctgcaggggcatgggctgcgtgtacgcgggtagctgctgcaggagggtgctgtgccgggagtgcagcctcccgtgcgtcgagcacaccgacggcttccacaccgcgatactgcccttcctgccgcggcgctccgcgacggcgaccgagatggccgaggatttgctgctgggtttgcctctcgagcacccgtgcgtgccggggcccgagtactgctactactactcggagggggacgaggtggaggaaggcgtggggcggcacgtgttcgtgtcgctcagggatctcgcgcgcaccaggcagccgcgccgtctcatcgagtgtgggtacaggatggatatgatttacattttggtccttttaaaaaacttatttcgcaaatagacccctggaaaaacttatcccaaaaatggtcctttttggggcgccagagtggctggcgccgtcgtccaactgcagcctctctggcgccgtccccctgccgacgtggcggggcaatgctgaggtggctagggggagcgcgccagagtggctggcgccccccccccccaaaaaatttttttttaatttttttttatttttttgatatttttttcacgcttagggacatagaagaaccaaccatagaaaaaatgaactcaaatggacgtaatatgtgacatgtagaatttttcctctcctctcctctctctccgaactagtgcagaggagagagatgtgcaactttttttatttttatttttatttttttgatatttttttcacgcttaggaactcacaagaaccaaaaatataaaaaataaactcaaacggacgaaacatgtggcctgtggaattttccaaagctctaccgaaaaacttctctcatcgaaaacacaatcttgcaagcggaatttggaggttttaatatcgccgaacacaatcttgcaagcggaatttggaattttgaattagattaagtaatttcataaagtggtagagtgcattatgtttaacatgctgatcaaagggtagatcaaagtggtagattagtgaaggtgcaaagtagactaagtggtagttcaagtttaattttttttttggttggttgtatcgtgatcctgagagtgaaaaaacatccgagaaataaaacaaaaatgacactgttgcaactccatacagagaagcaggaatggaggcgagggtttgggaggggggggggccggcgccagccatgctggcgccctcctcctgggggcggcgccagccatactggcgccctcctcctgccacgttggttcgcgtgtgccacggtggcaggaggacggcgccagagaggccggcgccgtcccgttggatgacggcgccagccactctggcgcctcaaaaaggaccatttctgggataagtttttttaggggtctatttgcaaaataagtttttcaaaaggaccaaaatgtgaaaaatctagacaggatggacgggaaggttattagggagacgtgggtgcgcagataccgcgctgtgtcttttaatagagaaattttacggtactttaaagaaagtatctaaattttacactgaaaattttgatatatgaaaatatcaaattttacattataaaatatggtactatgcacagagaactagagaagtcaagtactttcttaaggatggtaaaatttatctatttagatatgatgcaccatatgcacagagaactagagctttgcagaaatagctcgggacaatgcccgacagtttatatcaaagagttgatgaccgtcattgcgagcagtccggattccataacacgagcattgcgataaactaaaatggagtttttcacgaactaaactagtagtgttcaactctttgaactgtatatcatgaagtaattatgatttctctacacagatctgtcggactgtcaaccatacaacactgtctaggtgaagttcatttcctgtggatggtagcgaagtgaaagcccatgggttctcgaaattcaccggttccatggcaacggtggcagtaatctaacccgctaccaccacatatacggcacctggaaaatggaagtcatgccggagaagcatgtttctcagtaccagcagcataagtatggcagacagcttttgagtatgaggctatgagctcctcaccattgtggccattcgcccttcgggagcatgacaagatcggcatgattggttctccctgtaaatcccaggttccatggtcatgagagaactggtttgtaggatcatgatactagcaagagaagagaacatggagtacaagagatacctcgaccaaaacagttgcggcaatctattttgcctgtgcctctgcagatggtgcatggaggatcaggcctttttggtctctccctcctaatatttgactgcatcatacttgcagtgaagatatcaggattggtgtataaacatgtcaaaagttaacaaatgacaattcttaatgtacaatatggtctgagatggtcttgttccatctgtctggcaagttgaaggactcctaactcagtgacaaacagagagggtatcagttggcacagaaaggaaaatagcatgccctttctcaaccccattccccttttcccctgccatgtttccctcgcaatgaatctatgataaatctcatgtactatcacaatttttttcagataatggataacccgaccgctacatcaaaaaacacataaatctgcaaggccaaccttggtatgtttggagttaagaaatcactacaggctagagcaaacacacagtaagcattgctggctgtaaaaacgttggaacaagatctaagtcatgaagtgaatggcaagtaaattttgcttataaagtgttcagtggattgcatatttgcatggtgctaagcttcaggtattcaataaaaaagaagtggaatcaattgctacaaagttctgatacacatgacgaccttaacattctgtaagatggtttgaaatatattcaggtggggaacgcccccctccggcgacttggtcagaaaaaaacaattccgtaaatgtaatgccgaaacaatttctaccaaccatggcctaatttcctcatttttggtactcaattgccgattcctcatgattcttcccatcgcgctagcttctgctgcaggcagcacaatcttacccgctaccctaacccatccccacacctcctctccatgtcccgctgccgaggaaaaacctaccggtcgattcaactacgcttcctgtctacgaagtgttcgacgaatcgcaggcacgagaacaaaaggggagaggtgcagggaaggattgagctcacctcgctgcggacgatccatgaaggtctcgatatgagcacgctaggaggggcctcgtgaaatccggggagcgagctcgaaggagcctgccccgccggcgacgccacgccgttggggccggccgccggcgtcgaagccatcagcggctacaggttgcggtaggggcggtcgggcggatactggaaaggcacggtcgcacagagagaccgacctgttttcatcagttcaggctgcgttatccgcccacgattgggcctctttgggttctccttaactgggctaggctgggctgggctctattctaacgaaacaatgaataagttcactttaggtccctcagtttgctatcgagttcagagtccctagatcacaaaactggataaaacgcatccccaacttacaaaaccgtacaaacgaggtccctcggcagtatagcatctgattttaactgacgtggcatctacgtggcttatttgactaggtcttcgtcccacgtggcatttgatgtgccgtttacgtggcaattcgatccaaaaaaaataaagcctatagggcccacatgtcagttacacaccaattatttaaacatggtgagggccatgtaggccacatgtcagcctcattactccatttatctcactatcctctctctcctctgcatggggtcggagaggagcggccggcgcaaccctagccacagccgccgccgccaccgcgacggaggaagatggggcaaccacggggtcttccatggcgaaactggggaggtcacagcctcacggcatcagatcgaggggagctagggttttgggaggctaagaggaggagaaatgagctagagaggaaagaagccgctctaggttttctagttgggggaggagacgcgatggcatgggtgacgggtggggtggagcggctagccggccggtggagcagggcgggcgacggaacgaggcggcagcagagcagggggggtggagcggccgcggactgtgggcggagcaggccggcggagcgggcggcggaacagggtggcggcggagcagagggacgggcggagtggccgtggaccgcgagcagagcagaggggtggatgggcggagcagagggataggtggagcagcggcggagcagagggacgggcggagcggctgcggaccgcgggcagagcagagggatgggcgggcggagcggcgggacggagcagaggagataatggccgtgcctcctcctcctccggcggtgacgacggcggaggtggcgagctccacctcatcaagaagccgttcctttcccccctccgccaatgaggatgaagtgaggctgagacggagcctgctctaccgctatccccggaggaggcgctcgctcgcaccgttactgaagttcttccacctttctcccttctccccactggtcgcgtcgctgctgtgcacctctccatccgcccgtcgctgtcgagcccctacctgtggtgccctaccaacatcggcctccctgcctctggcctccccacccgtctcgctgacctccctgccttatccctctgcggctctgcacgctctcgccggtggagaagtggagaaaggagatagaggtagagaggattaggtggaggaggtgggacccactgacatgcatgtgaggcccactatttttattgactgacatataggtcccacatattttgttttaatttttaatgttgcttcgtttatttttttcaaatcaaactgccatgtcagcgccatggcaccgccacgcaggacgaggactaagttaaaccagccacgtaggcatcacatcagccaaaactgccatccaaactgccgagggacatcgtttgcaccggttttgtaagttggaggacgtattgtatctggtttttgagttgagggacgaaaatcgaatttggtgccaagttaagagaactctaatgaacttattccatgaattgatgattttttaaactatttataaaaaagttatataaaatattcaaaattttatatttctacaccactatatatggctgtgttcttaagttcaagttcccaaccttattctctcgtttaccgcgcgcatacttcccaaactgctaaacggtgtatgttttgcaaaaattttctatagaaaagttgctttaaaaaatcatattaatctatttttgaagttttttaggctaataattaattaatcacgtactaatccattgctccgttttccgtgtccaacccttacctaagaacagaaccttaatgtttttttatgacgtggcacacggccatgtggagggatgccagtcattttgcaggcaacccctgccaccctcctaaaagactataaaagggccgtcaatgtcattttacaaccggccccttagaggctacaactctctccagaggctacaactctctccagatgcttagaaatgtcctaggctgccattttataggtgagcccctttgcaggcgataaggtgactgcttgtaaaatggtgtcttcctccatgtgacattgtagatttgtgaagggcaacataggtgtagatttataaaactttaaaaagaatatgttttaaatattttaataaataaaattaaaaataaaaattcgaaaacaacaatacactctttagtggaattgaagggaattttaaaggaattgcaaggaactttggaatgtaggattttgaaaacataaagcatgaaaagcacaagattggaatatatcttgccttgcaaattcctaaagaattagatgcactcaaatgctccaaaataatcattcgggtggtacataggaataggaatgataaaataatagtggacacaataatagaacaccacgggataagaccttaattgtatttccacataaaattttaagcatcaaccctttgttctaaaggacttgataggaattttgccataagtattcaaatcctctaaaattcattcactttacttttttttccaaaagagcctaaaggttttgattcctaagaaaaatttcaccatgtaaccgtttagatcaaaggaaattaaaacaaatgaaagtttccctcaagttaaaaaaaaagaaataaaaagtttcctgttgtaaagaatcctgcatcctgatctgcaacatgtctatatttcttcttttttttttcagttctccgggtaaattgctcatgctatgcttagcacaaatcctatttctttcccaaacacaaaacattcctttttttgtccattcttctagaggcgctccgatcaaatcatccggattattttggggttgtttggttcggtctcaaactttgccaaaaattgacacacctcatgttagacacatttgaccaagttaactcatcgtttggtttatggtcacacttatggtaatattctctttcatttctcatggtcccacgtgtcatcaactaaaaaatgtgtgccacactctttttttctagctaaagtgtggcttacattttgttggccataactaagataaagtgtggcacacaagtatggtaaatgattgttgtatagcatgcaaacagcccctttattttgcaatatagtttgtttattttttttggtttgttaatattagctctttttctagagacatgtggggaccgatgtatatattgacatttgacacgtttctctagaggtgcatgatgtgttgtttgttcggttttttttttggaagccattggtttcatcggagaaacatgggtggaaggcgtgcgggtggtgcgaggagggcatagaaggaggatgatttcggttttacaatagtaggaatatagatagttcgatttttctggggcggttaatattggtatttttaagacgtgttgggatgcataccgtcattttaatgaaacgcagtatatattgatctatttttctcaggatgcaagatgtgctgtatgttttgcttttttggaagtcgctggctttttgggagaaacttgggggtgataggcgtgccgagtggtgggaggaggaattgcaagacaacaacttctttttatgttactaaagatattttccagttgtactcctttttttctactaagattttagtcttatattttgttttagtgtaccgcgatatatatttacactttttactgtgcatgatgtgtcgcgtgtttttttttaaagccgccgctttttcctaagaaacttgggtgttaggtgtggggcggtaggaggaggaatcgcaagatgataggtccgcttttatagtagcagacttgttttctagtcatactcctatattttttctcttttctactaattttttattcctatatgttgtttttcagcattcccagggtcctactgtacataaaacccctgcagcacaaggaagcctaggagagagagcagagagtagaggatgacattcccctcacaacatgagggaatgccaacatgagggaatgccatctcgaacccctgaagttgtagctggtcgagctagtagaggatgtcatcatgtcaatgtcctccctatgtcgggcaagatcatgctgccattgacagcagcgtccagtggcagtgtggcactaccatgcgatgcgccggtctttactgagaagttaggctgcctctcgtatagaaaaatgtcgtaagttttcaagcacatcgccattactgcaagtccagtaaaatgtaaaaaaaaagtctttagtacaattcaagggaatttcaaaggaattgcagggaactttggaatgtaggattttgaaaacatagaagcctgaaaagaatataattagaatatcttgccaagcaaattcctaaagaattagacacactcaaatgttccaaaataatagtttggatggtacataggaataggaaagataaaataatagtggacacaagaatagaacaccacgagaggaaaccttaattggatttccacataaacttttaagcatcaaccctttgttatgaatgacttgataggaattttactgtaagtattcaaatcctgtaaaaattcattcacttttcttttttttccccagaagtgcctagtggttatgattactaagaaaagcttcactatgtaaccgttttgatcaaaggaaattaaaacaaatgaaagtttccctcaagtcaaaaacgatattgaaagtttccctttccaaccatggcaaacgatcgttccctactttaaggattcatgcatcctgaacagcaagatgtctatatttcgtgttcttttcagttctcctggtaaattgctcatgctatgctcatatcaaattctattatttgccaaacacaaatcatccattttttggccagtttttctagaggagtactgatcaaatcgtctatattactttgccaaaagattgccacacctcatattaggcaagtttgaccaagttaactcattgtttggttcatggccacacttgtggtattccctttcatttctcatggtctcacacgtcattaactcaaaaatgtgtggcacactctttatttgctagctaaagtgtggcttacattttattggccataacttagctaaagtgtggcacaaaagtatgacaaatgattgttgtatagcatgcaaacaacccctttatttcgcaatatagattgcttaattttttgggtctgttaatgttggctcttcttctagagacgcatggggaccaatgtatatattgacacatttttctagaggtgcatgatgtgttgtgtgttcgattttttctagaagccattggtttctctggagaaatgtgggtggaaggcatgcgggtggtggaggatggcatagaaggaggatgattttacttttacagtagtagatatatagatatctcgatttttctaatattgatattttgtaagatgtgttgggatgcatacaatcattttaatgaaccatagtatatgttgacctgttttttccaagacgcaagatgtgttttttttttgagaaacttggggtgataggggtgtgccgcagtggggagaaggaattgctagatcttaaagatattttccagctgtactccaatatttttctgctaatatttttattcctatattttgtttcaatggaccatggtatatatttacacgtttttttttaaaaaaggtgcatgatgtgttgcgtgtttgggatttttttggaagccgtcattttttccggagaaacttgggtggtttcgcgatctttgtttccttgtgccgcgcgcgcggcgtgcccaggtggtccgcgttctttgaacctgatcaaggaggagttcgtgatgggcgaccacgcgcggctcatgtccttcttgtggttcgccatggagcttgccatgtcatcgccgcttttcgcgaagctctccgcgctcttctcctccgatgccgcgtgcctcgagggcctggagcgcgtccgtgggcgtggccacgagcggctccgtgtcgtggcgtataggctcggcggcttgcggtacagctgggcgccacggttccgcctcgccgtgctgctcctcctacgggacaagtttcccgagctggttggcgccatcgaggtggttgatcccaccgtggccccagtggagcgccgggccatggaggagctgggctgcattgtcaccacatctcctgcgctatgcctggtggtagaagaaccaactctgatctttatgccatacgcggaccgtgtcttctttgagaatttgctcatcttgaactggagcccggacaagctcgggaagatcgtcgtgctcgggcacagtttcagcaccatggtgaagatgcttgagctcagcatttcaaagcaagagaagtgtggtgtcaatgagcagagggagaaggtgaagagggtactggcaattccgagctatgttcaggaattagagctttgtgcagagatatctggcttattcgataaccctctcttgggagatgagtatccttatgaattgaaccagtacgactacaataattcaccagagcagtgtacatgcatgcactgcgttgcgcgtatggaaagcggtgctttgatttgtgctcttcccagcaccttttcaattcatttctttcacctcgatgctgaaatcgatatggaatatttgataccaggttcttttgcagctcatttccttttttttcaaagcttaagagtgtgtgtgtgtgtgtgggtgggtgggtctgcgcgcgcgcgccaatatggattgtggcattatggtcttctgacttgttgcctctttcttcgatgcaggtaattgcgctacaagggtcgggagcaatgtcaatgtccaaatgggctatgatgctcagttagaagggtaaggctacatactgccaaacgaatcatttggattagttttccatgcttatttgtttgcctagttctatgaattttaagctaaatgaaagtataatttggtttcaaaaataaaagaaaggatgatgcaaacaagatatgtttgctaaaagaaagggtttcttgtgtaaaaggggttctctgtttgagtgagatttgctttgtactattgctgcagtgcaggttattgttttgcttcggcgattaactcaaatttgtcctgaacagagaaataaaaacaacatatttttgtaaaacatgtttgttgttttactgcagtcattaactttaacaattggtttgttgcgatatgtcacatgtgaagcacatgccttaatttttgtggtatatttttgttgttcactattgatgacttcaaaactaactagctgggtggcccgcgcaattgcgcggctagcacccaaacaaaatcatatattttttatgatattacttaaaatttataaaatagatatctcattgtcttaagactttgaaagactaaaccttatcatcctcgtgtttctaattatatagttttttaaagtcacaccagttgctaccccttatgtcatcttcttctttatttgcttgctcgatctaccactatttctattcattcttcttggaacctttaaaaattggattttatagtttttagagtttattgtcacgttgtgtttcatttttataatttctagatgtcccgtcaaacgttgccattatactcctctacggcccgtccactgtctcttttctttattgtcattgagattttaaaaatcgaacataattatcttttgggttcatttttactttctagaagtcccgccaaaccgtcagcggctttgtcattgtactcctcggcggctcacccactggctcccttctttattgtcattgagattttaaaatcgaacatgattatcattgttttttttactttctagaagttccgaacctttaaaaattagacttgtagtttcattttttataatttttagaagtcccatcaaacgatgccactatgcccctctatagcccgtccgccgccgactctttattgtcattgtgattctaaaaatcgaacataactattgttggaattcatttttttattttctagaagtcccgtcaaccgttggcggctctgcaactatactgttatacaccccgcctactgcttttattgtcattgagattttaaaaatcgaatatgattatcaatgaggtttgtttttttttactttatagaagtcccggcaaccgccttactcatttgcttcacagcctgcctgacgtccctccctttaatcgtcatttaggattctatttggtgttttattaacaatttttgtatggcgtattaataccgttttgtgttcttttaatgcttttattttttattttcaatttcagttgttttaaaattgtattcctactttaactctctttttatttttctattttagatattattttattttttattctaaattttaattaatctcgtattgggttcttatatggatttttctttcaatattgtttatttttaattccaaatttcagctaattttaaattgtattcctacttgaactcttcttttattttcttttgctaatttcggatttatttatttttttctgatgtttaattaatctcgtattgggttcttatatggactcttcttttaatattccttatttttaattccgaatttcagctattcttaaattgtattcctacttggactctcatttccttttctaattttggattttattttatttttatttcgaattttgattaatctcgtattgggtccttatatggaaatttctttcaatattgcttatttttaattccgaatttcagctatttttaaattgtatttctacctggactctctttttcttttctaattttgaattttattttatttttatttttatttttgattaatatcgtattgggttcttatatggaaacttctttcaatattgcttatttttaattccgaatttcagcattttttaaattgtactcctacttggactcttcttttcttttttttctttttctccgattaatgtgggaatttctagcccccacagcgaacgtggtgccttcttttcgagctgtcttaataatataatagattcctttccaaatgaatcaattcaccatgtggcatttaaatcctagtgatgcatacattgaggacagacacttatatgaagctgaaagcatagttaaagaaatgcgtgaaactatttctgatgttaggaattctacgctatcacaaagtttgttgatcacatgaagaaagatcagagcatttgttctcacatctcaagcatgttgggagctcatgaatgcattcaattggttgtttatggcattgggagctttgaatttgatgtgaagtcccaatatcagattgcttttgctctactactaaaggaagacaatatattcccaattagtgatatcgaaatctatgatccatcactacctcctgctgatgtgaaagcatgcttcgacttggatctacgggtgctcttggttaatgaacaatgccaaagaagtgttgacaagccgataattttctttgttccaggactggcatttgttggaaacctcattgagtcaaatttctctcctgagcaattaaacaatattattctaatttcctatggggtcaagaatatcggggatagaatttctgccgaacttgaaaattggaacaatggatttaccagtttgaagggttccccagaattggaaagagagaggtttatttgggcaagcataaattatattaatgaagtcattgtgatggaaaattttaatgcccacttctggggagtctctgatatgagatttgagttccttgatgttgctgctgatgtggacatgaactcaaatttgccaagtatgtgtttttgcttccgaacatcttcgatttataccaatttacctcatttttttttgttttcattacttttgtttgatggtggagctgactttgcaaggccgactcttaaggaaaagtttttacttaacttcaaattggagctggaatataattctttctttgcttttgagtacgccttcttgagacttatgggcaatatcttgttacttagtagcattcattgtctagtgttgttacatgctgaatcatgtactgttattgtctctgtattttcagccatgtgtcttattttcgtatgtgcttggaagaaagaatgtcgcgtccatttcaagacgatcaagacgattgcaaggatggtaaacctcaagactgggcacatgaattcctgcaccgaatcccagcaatgcatcggaagacttggtctcctcctcccaaaggttggatcaagttcaatttccacggcattggtggttccaaagatcgttctgctggcatgggtggtgtatttcacaatgaggatggtgtgctctccttctttattggttcattaggtaacgtggatcaaaccgtggctagtattggagcaattgaacttgggctaaaggtcatgcttgagtaccatgaaccagttaaaaagctgatcgttgagggggacgatctcacggtgatacgttggttcaacagagtctctcacccgcctgcaagagcgcatgattcattcctacgtagttacttgcacttgacttcgatgccattgccatgtgagggggctgccgtgcctgctgagatatccaaagaccctgaccatgagaatggtagttcttcacatgatgcatcacctactaagccaccgaatgacggtaacatcgagaatggtaaagatagagaatcatagttctttacaatattctttatctgctattaagctatctgaagtctgtaacagtaggaatggttctttgcagatgcttcacctgctaagcaatttgaaagggagtacatagcttggcgggtcgatgaagaggctaatcaggtcgcaattggattggcacgtctaggcagtatgctacctgaccatcagaatcgggtaaaggtacacagctcaacccagtgtgactgtgaaatccaaagagaaatgaggaatggcaggctaccagacatcacagttggtgagaacctctccattttgccgatccattatgtagccacaagtccacaagtgctatttttgtgcattattaacgatcaccatatgctacaggtttgcctgttgaggagccaagctaataaggagtggagggccttgtcgtgtggaaccagcactctgatgctaaaacagttttgcctgtgtctggcattccaaatattctcaaatctgaatgtatgtttgaatggtccgatgaaaaatttaaattatgtgttctttggggaaatttttatgtgccttttgatagttcatttgcagattcaattgtagtttttggtatatcttttttttttaaaaaaaatctttctaccaggccagctgaagaattggctgaccaaattgtattaagagttgaagaatttacagtatgggaacattacaatatcgaaatgaaaatgtgaagacccagcgttcaggcgaaaaacctgaactccggaggagaaaatcagcccgtacggttatctcaaaacaactcggcctccttccaaacaacaatctcaaaatagcttcgaaaagttgcactaccgttcgtgatcattgatcgaaaatcgagcattgtgttcctttcacaccaaccagcctttatacaaagataatttgttctacgtatgcctctagctcgtccgaaaacacagtcttgtgctcagtcaccaacctgctagcttttaggctccagttcgctctcgcctggcagcagaaagcacacaattgtccatccttcgagcatcctccacactcgattggacggacacgctacaaacaggtgatggcactcttcctgcattgctcggcattcctgaaattagtgcgaaaaatgtaaacatatatagcggtcggaaacacatcgtttataaaaaatgattatcggtcgatctggaatttccatattttattagtttaactatttagtggcaaatgcagtatggtgctagaagaaattaaaaatagctaaatataatatgtggttaaaagtgaaaatgattagaaactatactatttttacataaacgatactcggtgagtcaagaatttcgctagcgtttttatccccaagtaggcgaaatgctgcagctgaagttgtaccatgtgccaacagtcagcatcatattatatccaagttaatgagggggtgtttgggaactagggtccctcttacaaaagtataagtccctatgatagggacttatgtttttgtgagagggactaaagtttagccccactttagtccctccaaccaaacaccacctgaatatctccaaaaataaaactcccataagaaaatcattactctcgctccaaccaaaaatatttaaatatttggtgcttggaacaaagttcgatccaacttttaaaattttgattatcaattttttttatagatatttagtttaaaaacaaaataaataatatacttggatttgcctaaaaaaatactaccataataccataaacttaatattaaaatgtactttttacggtaaagagatagctttattgataactgaacgaagggattagattcctgattcaaccaattcaaaatccgtgcaagcacacataatctcccctcctagcaagatcttgaattcgtcgtcgtttgattaagagtatgtactaccctcttagcttcttttcctattttgtgcacttgcactctttgaaagcattgcatcgcacctttcgtttcatggaccgtcgttgccccagccgatctcgagggattcttgttctcgagggattcttgttcgattaggacgcaacaacttcagcattgtcagttttcaagattagcggcgtatcatatgaatccatcccattgccacccgaagtcaaaatttacaaacacattctaatataaaattgatttttggaactataaaagcatgagcaaatctttatctaaacatcaaatatttaaaagggagcactacatttaagtatttaacggcaccctatctgtaacttggtgatggactaataagcacaaccataataataagggtatcaatcagatcataattttctttttcgttttatcttcaactaccgctcatctcatttaatgataaacaccaaagttatttccccccaactttattctctgctacacaaataaaaatgagatgagcgtggatcaaaggcagtactcgcttgccataatcgcgtgattcgagacatgctttcagcgttcagcctccaagcaaatcaaatctgtgtgattcatacacaaatcctttttcccttttcctttttgccgcaaggaagcaacaaaatatctctgacacactctgaaactgtgacagacttgacagtcaatggaactgaaaacgcaacccccgtgccaagaccattttcttcccacagtccactgcgcgagacgggagagacggccgcgacacaaaggaagcccaggagagacgcagacgcccgcccacaaagcccactttgcccatggcaacttccgcttcactgcctcctcctcctcctcctcgcagtagtagtaaccgcctcatcgcctcctcctcctcttcgctgcatactgcatactactgatcagctcttccgttctcgcggctccagatctctgcagggtgacgggggagatggcggagacggaagaacctggccaagatcgacgagtactccctcctgctccacatggtgagggttttaccttctcctctccaacttttttgatttgctgcggcttctttctcttcacgcggcggtcccgtggccaggcctgatcatggaggagttcgtgatgggcgaccacgcgcggctcttgtccttcctgcggctcgccacggagctcgccgtgacgtcgccgctcttcgcgaagctctccgcgtgcctctcctccgacgccgcgtgcctcgacggcctggcgcgcgtccgcggccgcggccgcggacgcgagcggctccgcgtcgtggcgtacaggctcggcggcatgcggtacagctgggcgccgcggttccgcctcgccttgctgctcctcctgcgggacaagttccccgagctggtcggcgccgtcgaggtggtggatcccaccgtggccccggtggagcgccgggccatggaggagctgggctgcgttgtcaccgcgtcgcctgcgctctgccttgtggtcgaacagccaactctgatcttcatgccctacgcggatcgcgtcttctttgagaatttgctcaccttgaactggaccccagatcagctcggcaagatcgtcgttctcgggcacagtttcagtgccatggtgaagatgcttgagctcagcatttcgaagcaagagaagtgtggtgtcactgagcagagggagaaggtgaggagggtactggcaattcagagctatgttcaggaattagagctttgtgctgagatatctggtttgttcgataaccctctcttgggagatgagtatcctgatgaattgaaccggtctgtctacaatcattcatcagagaagtgtatatgcatgcactgcattgcgcatattgagagggctgccatgatttatgctcttcccagcatcttttcagttcatttctttcagtttgatcctgaagttgatattgaacacttgataccaggttcttttgcagcccatttccctttttgtaaaagcttaacgtggtgcctacatggactatgttgtctgatgacttgttgctgctttgtttgatgcagataattgtgctacaaaggtctggagttatgtcaatgtccaaatgaattgtgatgctcagttagaagggtaagactgcatactgacaaaacaattaatttggaccagtttcccatgattatttgcttgctgaattctgtgaattttaagtaaacaaaatgatgctttggtttaaagaaatatttaatgaaggataactcaagcaaagatgattacaccattttaggcagctttcttgcgtgtaccctaaaaaaagggtttcttatgtaaaatgggctattttaccgtttaagtgagatttgcattaattatagtattgctacaatgcatgttcttcttttacttcagtgattatagtattggcagattgctgcagcctgcagcacctgtttgttgttttatcaatcatcgactatgtttctaggccatctgttttatgatttttcacgtgcgctaataattttgtgggatgtattttgtcgttcgctattgttgacttcacaaattaattccttttctaaatgaattaatcgaccaggtggcatttaaatcctagtgatgcatacattgaggacaagcacttacaggaagctaaaagcatagttaaagaaatgcatgaaactatttctgatgttaggagttctgcactgtacacaaagtttattgatcatgtgaagaaagatgagagcgtttcttctcacatttcaagcatgttgggagctcatgaatgcatccaattggttatttatggccttgggagctttgaatttgatgtgaagtctcaatatcagcttgccttcgctcttcttctaaaggcagataatatattcccaattggtgacattgaaatatatgatccagcactctctcctgctgatgtcaaagcatgcttcgacttgggtctatgagtgcttttggtgaatgagcaatgccaaagaagtgttaacaagcctacacttttctttgttccaggattgaaattcgttggaaatctcattgagtcaaatttcactgctaagcaattaaataagatcattctagtttcctatgggttcaagaatagtgggaaaagtatttctgctgcacttgaaaacaggagctgtggatttactggtatcaagggttccttagctttggaaagagacaggtttctttgggcaagtattaattatattgatgaagtaattgttttggaaaactttgatgaggaattctggggagtctctgaactgagggttgagtttcttgatgttgccgctgatgtggacatgaactcaaatgtgccaagtatgtgtgtttttcttctgaactcattttttttttcggtactcttgtttgatggtggagctaactttgcagggttgtctcttaaggaaaagtttttccttaactttgaattggaactggaatataattccttctttgcttttgagtaagacctcttgagacttaagggcaatatcttgctacttaacattcttcatttgattagtgtttgtacatgctgaatcaaaatttaggtcaataagactaattatgtaatgttcttgtgtttgtgttttcagtcgtgtcttatttccatatgcacctgaaagaaagaatgttgcgtccatttaaacaagatcaaggcgactgcaaggatgatgaacctcaattctggggacaggagttccagcaccgaatcccagcaatccatcggaatacttggtcccctccacccaagggttggatcaagctcaacttccatggcactggctgctccaaaaatcgttctgctggcatgggtggtgtattccacaatgatgaaggtgcactctcctacttcatcggttccttaggtaacgtggatcagactgtggctagtattcaagcacttgaacatgggctagaaatcatgcttgagcatcatgaaccagttaaaaagctgatcgttgagggggacgatctcacggtgatacgttggtgcaacaaaatctcttgcccacctgcaagagctcatgattcattcttacatagctactggtacatggatttgatgccgtgtgagggggctggtgtgcttgctgggtcatccaaagagactaacaatgagagtgatagttcttcacaagacgcatcacctgttaagccactcaatgactgtagcagtgagaatgataaagatgagtatgacggttctttgcaggatgcatcacctagtgaaccaccgaatgacagtaactgcgagagtggtaaatatgagaacagtgactctctacaagatgcttcacccgctgagctatctgaagtctgttacaatggaaatggttctttacaggatgcttcgcctgctgagctatctgaagtcagtaacaatggaaatggttctttacaagatgcttcgtcttctgagctatctgaagtctgtaacaatggaaatggtcaggatgaggacggatgttcttcatcttctgagtttgtgatccctcctggatgggctcaaagggagtacatagcttggcgggtcgaagaggaggcaaatcagaccgcaattggtttggcgcgtctaggcactgcgctacctgaccatgggataatggtacacctctcaaccaagtgtgactgtgaacatggaagagaaatgaagaaaggcagaccagacatcacatggtgagaagctcttcatatagttgattcattctgtagccacaattgcttttcttttctgcagtattaacgatcaccatatgttacaggtttgatcattagagagggccgttgtttgaggagcaaagcttgggctaacagagagtggagagcctttctcatgtggaacctgtcgctgatgctgttagaatttcaatggttactctcattgagaagaggatggcactcgagatggggcaattttctggttttcttcatttactaaacacaaaagccatgtcctcccaaagaggattggatacatatttatagctgcttgtagcagccatgcagccatgcaagtctaagagggtgctgtcctagagcatcccaacaaactgtcctagagcagagcatcccaacaaactgtcctagagcagagcaacccaacaaactgtcctagagcatctcaacaaactgctgtcctaactgtcctagagcatccaaactgaaagtagagatgctgtcctagaaagttgaaaagcaggaaaaggcaccacaagaccaagaccaaccagccaagacttattcctacattctccccctaagtcttgtgcgccgtcttgtgggaaagttgagccatcccgatccgggagcaaagctcaaggaacttgatcctcccaaggggtttggtgagcaaatccgcaagctggtccttggtgttgatgtagctcgccttgatgctcccttcctccaggtagcttcggatgaaatggtacctcacccggatgtgcttgctccgttcgtgaaaaacggggttctttgccagggccagagcggacttgctatccaccctgagctccaccgctccagtatctctgccaaggagatcactaagcagtcgagcaagccagagcgcctgggtcgaagcggcggatgccgccatgtactcggcctcgcagcgggacagggccaccacctgctgcttgattgactgccagctaacgaggcactcgccgaggaagaagagaatcccgctcgtgctcttgctggtgtcaatgtcgccggcgtggtcgctgtcgctgtacccgacgaagtgtgccttgtcaggacacctcgggtagtagagaccgtggtcgagagtccccgcaacgtagcggatgatcctcttcacagcctgctggtgctccgtcgtcggtcgctgcatgaaccgactgacgtagctgacggagaaggccaagtccggccgtgtgtgggtgaggtagcgaaggctccccacaagacgccggtactgtgtagcatccacttcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccgggaatcacaaatcccggcggctggtgcacgtagacctcctccttcaagtcgccgtttaggaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaaccccaccgggctgcgctcaacacgagctggcgtcggagtagacgtgcccggaggagtggctgttgatgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctcccttgaagtggacgtactcgatggtgaagtcgtcgtacgtcggagtcgaaccatcatccaccgccttgtcccatacccaccctcgcccttcgtcgaacacaacatcgcgcgcaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcggcgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgcagcagcctgcgcatgcctgatggcgtccgcagcctctcccttgatgccgaggaccatcacccacatgtagcgggagaggtcgtcgacgagcagcaggaagtaacgtcgtcctcctggtgtggccggtgtcactgggccacacaagtccccgtgcacgagctgagccgctccttggctcggaagctcgtctgctggggaaaggggagccgccgctgcttcgtcaccacgcagacgtcgcagagctgctccatgtggtcgaggcacggcatgcctcgcaccatctccttggcactgagctgcctcagggcctcgaagtggaggtgcccgaagcgctcgtgccactgccacgcctcgtcgtcccgacgagcggcgaggcaaactggttgtgcgacctgcgcgctgaggatgtagagtcgattagtgcctctggttaccttggcaagaaggcgacggcggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggttcatcaaggtggaggaaagccgctgcggccggtgccgctggaggtagctcgatgcttgcgtgagctaggagcagagccggctcttcctcctccacccatgcgacgtgggcctggccgcgtcgtggctgtcgacagtctttggcctaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtaagatggagcttcccgccgatggtgatgggccccgagagaggctgtggctcatcaccatcaacgaccttgaggcgacctaacgcctcctcgatcgacatcgtggagaggtccagcagagattcgatcgagcgagcgatctgtctgtacttctcagggacgcagcggaagaacttctcgacagctctctcctcgtcgtaggtgtcgtcgccgtactgcaccatcttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtagtcgacgtcgccgtatcggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgccggtcaggggagagagagccgtgccgcctgcgagggccgcgtgcgggctccgggctgccgccggcacgcccgcgcccgtctgggttcccgtcggcgggcgcgcggtcccttgggccgccgccgccgccgccgtggaggtgggctgctgcccaccgctctgctcgctcccgtgcccttcctcttgccagctcctcaagctccctgtcggcggtgatgtcaccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagtggtctgagccgttgctcgcctgcgctcttctgctgcggcgagctcggcgtcctgctgacgccgagtgctcaaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggagcaattttctggttttcttcatttactaaacacaaaagccatgtcctcccaaagaggattggatacatatttatagctgcttgtagcagccatgcagccatgcaagtctaagagggtgctgtcgtagagcatccaaactgaaagtagagatgctgtcctagaaaattgaaaagcaggaaaaggcaccacaagaccaagaccaaccagccaagacttattcctacagatgcaagaagtggtggcgcaatccttttgtaatattttgcagattatagtatgtctatgttagcatgttacctgccatggattcataacgatgagaaagaaccaatgatgctaatacaacagatccaggattgacatctgtttttttttagtcacctgtgcgtgagtatctccttgtgtatttgcagcttgtgtgacttgttaatataaacatgctacaacatcttggtttttttatttcagatgaacagtgggtttaaactttttactcctttgctagtagaaagtggctttgattctgcgcggactagctgcagcctgcaggttataaccctgacgtcacgctatgttgagctcccaatgggcctaacataacggcatagtgggccgttaacgggcctcgtacctgtacggccgaaacggatcggagtagcaaaccaaaggaaaaagtacacccagggtctctcaacttgtcattgggttacaaaatcatccttgagctgcaaaacccgatatacgatatacgacgtcctttaacttacaaaaccgttcactttagtgcatagacggttttgatcccgggctgagtcaacgtggaacccacgcgggccccatatgtcagtataccacgtcatcgccctctctccttcccctcctctccatttctctctcttctctgtcttctcgcaggccggccggcaggtacggaggaagccggtggggcgaagcgggagaggaagagagcgacggcggccggcgacgacgcgggagagtccacagccgccgtacagcgagggggcggggcggcgggagaaggcgaggtgggggcgaccgcgacgcagagaacgaggcgagctcggaggtgcggaaggaacgccagtagacggctcgggcaccggcgatgctcgcgaccagttgaatgggatggtgccgcagccagctgtgggcgccgcggtcgacggcggtgcgcactgctctccgtcagggtcgacggcgcagcgcggcattgggggcgccgtggccaacggcggtagcgcgcggctctccgtcggggccgatggcgcggagcggcatgggggccgccctcaggaatgacgccgccccggatccagcagtcggcggcggcaaatgtggcgagggacagcagcaagaagatggatgagatggggaagaaaagatggatgagatgggaaagagaaagagggacgacgccgccctggatccagccttctccgctcgccgccgcctcgctggcttcgcgcgccgccgctccgcctcatcgtcgccccacttcgcccgccgccgccgccgccgccccgctccatcccaccagctccgtgcgccggcgctccgctgctcggcttctcccatgggaagatgaagagggacggcgccgccctggatccagccttcttcgcccgccgccacctcgccggctgcgtgcgccgccgctccgcctcgccgtcgccccgctccatctcgccagctcagtgcgttgccgctccacttgctcagctgctcccatgggagagagccgatagacacacagaagagaaggaagggggaagaagaggctaacacgtggggcccacgtgggtcccaagctatgtcaggtgccaagtcagataaaaccagagtgaaaaccaccggggatgtgttgtatctggttttgtgtggttcaaggacgattttgtaactggatgccaagttgagggaccttcggtgtactttttccgaaaccaaaaccaaacctccaaattttctcaaaaaaaaaaaaagaaaaggaaaaagacaaacaacctccggggcttctgctctcgcccctcgccatgccaaacacggcggccctcgctggcgtgcgcggaacacgaacctgaggccctgagctctagcgcggcgccacgcgcgtctgcgtggtgtttcgcactcccatctccgaaatccgcagctgcgcacggccttgcgcgcggttgcaggccaccgcccgccgctaccaccctgcttgaccagatgcaagctccatcttcccagtgttcaaatccgtaagcactgctcaccaaatctcagtatcaagtctcaagcattcgttaaaatcagtgtgcattcgtagacccagaagtctgggattaccagtctgtgctggtcaggggacgcgaaacagctgttcgacggaatgcctcaaccagcaggatgttttcttatctgggaatcacaagctaaggtagtgccatttttctgtaaattaatcatttacgctgttttgctattcataggttttacatgcaacatttagaaaattttacttggactacgaagcaattccctgccccttgctgagttgctgtggcgcggatacttcaggtgtgtcgtggggaatatagccatgtagaatgtagtatgtcttcaggaaaattagtagctacccatcctgtgcattgccgttgaagacttgaagtgctgcgattgttgtgagtactctttggttagcttagagaatgtagagtcctctctctggagcagtttggtgggggtgtcgtattctaaaatactacctgcatagagatatcagatttaaagagtgacgtagctgtgcaacatgatattctgaggttgttttagtattgtagtggtatacctaccttcaccaagaacaagaataaggtcactatcaataacagtgttcatcctatgggcaattgcaagcactgtgcaatctttgaattcttgacgaattatctcttgaataatccggtctgtagcagagtcaactgaagcagttgcctcatcaaggactagtatcttgctcttcctcaggagaattctgcctaaacaaaatagttgtcgctgtcccatgctccagttgtccccattttcaattactgcgaatgaaatataaattcatagtagcataagtatttcagaaaaactacatattaacatgttcttttcctaaaggactcattgcagtttttttgtcttccttcaaaagtttaatgctgagcagtacctatttcatccagctttttctcagtcgagcgcaccacattgccaagctgacacttgtctactacctgacatgggtagttcattacttcagaatgaaaactactgttgatctaccctaaaattacttctagtttgtatgcttgcttttgaggtcttattcatttactggtggataggggtcgcaatctgtaccatcttcacttcatattgttgtcgtctattcacgcttacccattttttttgctttatatgatttgtgctatttatggaaccattgtctatacaaatagaaaagctttgtcatatattctagttaggatgtaacatgtaagttttctgcacttacctcccatatcctactatctgggtactcgttcatgggatcaagatttcctctgattgtaccatcgaacatcaccggatcctgtgggagaatacatattctcgatctcagatcatgaagtccaattttgcagatgtcgatgctgtcaatcttgatggtcccttctcttggctcaacaatccgaaaaagtacttgtactaaggttgacttcccactacctgtgcgtccaacaatacctactgttttctcagctggaatcacacaagttatgttttttaatactgaagggagatgttctgcatatctgacctgtatgattaaatgtgcaatatcattactgggccaactaaagggtgtacacctctgatacttagtatgaaataaaattattatgatcttctttctaatcatttagaaccatacctctaagttgcttatgcttatcatgccaaactctggccatgccattggtggcttgctaccctcggttatggttggggcttcacttggaagctttgtgtactgtaatattctttcaactgatatcatgtttgcttctgcacgacttatattccgggtggcttctgataattgtgtattcaaattccatgcatacatcactaccagcccaccaatgcctgttttgcagcaagagaacatcaacccttataccagaaaaaagatatttatccttcaagtttgaatgacggtagaacagcatgagtttacgttcaattaaattcatgggtccgaacaagtcaaaacttacttggattaacaaaaccttgtggaagacgcacaagcaaaaccaacgagaacccaaagacaaagttgcataacaaattcattctgaaagagagccattctactgcagccatcaagtgaaaccatggtcttgaatgattgtcaagtagactcagatttgatctgtagaaccggtcttcttggcgaaatgctcgaattattgcagctccatagaaagtttccccaaaatgatgaagaattggagccttttgaattcctgataggcgagctaattctgttgctgttagactgtaatatctctgcaggatattatgggagatatgattcattctcaataggcatattgtgtgtactgatactattttgaatctgactaagttacagttaactcttacctgatacctgatgcaaatcaatattgatggaataaaaataatgagaactggccaggaaacatatgatatgattagtattgttcctagaaactgcatcactgaaaatgtgctctcacttaatgttgacgctgtctccaaatctagcacactttgatcaatcgaagcctacatgaacaatgcaaaaatcatgtattagcaactcaggtaaagcgacatacacattacactttcctgtgtaatgcagtatatgtttacttattttacatagaatttctttaggatttattttacatagtttacacttctgagacaggagaatggactgaccctgtttaagattcgccctgtaggtgtcgagtcaaagaaagacataggagcatgaaagatgcaatgcatcatgctcttgaacaatttttctgatgtgaggaggccggttacagctacaagaactgctcgaatcaagatacacaaggcgctgccaactgatataaatacatataccatgaactgggtggattccatttttgatttgcttccagttcgtggatggcaagctgatgccatccaatagttgcttcccacttcaaatatctgaaagaagcattgtgctgcaattatcataggaatgaaaagaccacctcgagcagctgtgaggtatgaccaatacacttgcttgctaatgtatccattctctctttcttcaccctgcagcaatttcccttcttcagtgttatctctaaatacttcttgtctgcaatttatcatatttgtgttttgccatttgctgctgatttccttttctgcatcggactcattgatgcttggtaccttttctgattctgcatgatgctttgacaaatatatgcttgtgccttttgcgttacaaacttgttcgacggcacaaaagtgagccccaaagataactccaaaagccatgttctgttggagttcttgaaatttccctgcttgtgctatccttccattttgcatcacctgcaatattgcttcaaccagtcaagttaaacatactagtttcttttctgggatccttatgagttattgagaggtagtagtatctcctagtgtggatcatgagaactgataggtgtagctactgaaagttatacaaaactaacactaggagatacctctacacctcaagcctgcaaagggctgtaaattctctaaaaggattcccatatgcacagcatgtttttagcagtcatcattatttatcctaatgttcagtacaatcatgtctttagtttttttttcaggggcttaccataataaggtctgcatcaactagaaattcaacttggtgcgtgacgtataacacagttttatcccttaggacccccatcaggcatttctgcaaaaaatgtatagagccaatgttaatggttatgtaacagggcttctccttgccagtaaaaatatagatatgagcaatttattttagcgagagaaataaatatcaataataatatggacaagattattgaataatcacaagatctcaaatatacgatgcccattgtttgtcctagagaacatgatgacttcttttaactatggaaaatttgaaaccatcaaagcattatatttttgtgaccctggtgttattttcttttgttggctcttaaggggaaaaggaccttgtatagatgcctcccagtttgagggtctacagcactgaaaggatcatcaaacaggtagacatcagcatccttgtaaactgctcttgctatttgaatccgttgcttttgtcccccactcatagtcgttccccgttctcctatatctgtcatatcaccatccgagaaaactccgatgtctttaaccaaggcacatgcttcaattgtccgctcatacctatcagtttcaaatgggctcccaaagagaatgttttctctaatagtcccagaaagtatccatgacgactgtggaacatatgctttggttccaaagaccttaaccgttccttgcacttttggcatctctccaagtacacatgacaacaggctagattttccactcccaacagctccacatactgccactttcatccctttgtgtatctttacatgtatatcttgaagtgttgggatttttgcatcagttttccaactgaatgctccctgatcaatctctgcagaaaattcattttcgtctattgctacttcctcaattgcatcagatcttatttcttcttcttggagatatgacactattctgtcagctgagatcttcccctgtgcaaaggcagtaagcaattctggtagactaaagataggctccttcagtatattcacagttgctagtgtggacaacactcttccagctgttagagggattcccatcagaatgcatgaagcaaatgtcatgattgatatgacagcgggtgctccccagaacataaatgctagtagtgcttttagtcttagaaattcccacaaccacaaatgttctcctttcctcaaatattccaatttcctaaggtattggatatcccaagcttgaagttttaagatcttcatgcttcttataacttcagatgtcatgtccattctgtcatcttttgctttcataattcctgcgtgcaatcttttctggattcttgtaaaaggaatattgcaaagcattattatggctgttgttgctattccagctaaagaacccagaccaagatttttccaaagaatataagttgctagtgtaatctgtataggcatcatgaagaccatgttcacataccatgcaacattaacaatcctctcgatgtcaacactcacatagttaattatctcccctgaggtatg

SEQ ID NO: 75063 - DNA, 5479 bp, Oryza sativa
catgcaagcttgtgaaagagcaactgctgtctgatttggaacaaatatggctgacattattctgatcagccacaaaatatagtcatcagagagcgcaccatgtaattccatccagagaaaaagtgcctgtcatttggacagccacgaagtcggatgagattcaacttttttgcatgcaataacctttggattcggttgaccgagggtttttggcaattttctcaatagccaccacccaaaggaagaaggtcaattttatttgctcaatttatcttattacctgatttatgtgatcaattaagctggaagcattacactgttttacacaattggttgcgagggtgttctaaccccgataatgctggtgtttaagattatattgagcaaggaaataagtggaatgtgtagaagtgagagaaaagggaaccgaattttttgatgtgttcctttcagtagttgaatgccatctctactagctgatagcctgataccagctcctgtcgaatttgttttgttctgcatgtattccatgtctccaaggatgagctaaagatatagagaaaacagtttttggcgatctttgcttttcagttttgcccttgttatactgagcgatgtgcacttttttgaatctctctttaaggaactttgctagacattaacccctgcttcttgtgtcttcagctgtataacatgttgcataaacccgggccgttctacgttttgttcaaacttgaaatttagttaatacagagttggaaaaaaatcaagacaaagttaggagaacctggacctaatcaatttctcttggttataccttcgcgaaagttcaaattaggtcggaatcgataaagcttaatacgaaattagatcggaatcaactattaacaaggaatcctaatgtgggaaggtttgatacgaaatgaatttctagctgatacaaagaatcctaatgtgggaaggtttgatacgaaatgaatttctagctgatacaagtaggaaggatttgttcattctctctctcgcactggaagatcagtgaaaacacaagggcagtatgtaaactctgtatgaacaaccaggtcatgtagcaagaacaaaatcattcagaggctcaagccacttttcagtatggagtggacataatcacatacttcctccgtcccaaaataaagctatttttgaggttggcacgggtattaagaaagtatgtgagaatgattggaggaagtgtgtgattagttgaaaagagaaagtaggtgaagaagaatagttgtgattggttgagaggaggaggtaggtgaagaaatagcttcattttgagataagacactgtgctagaaatagttacattttgggacggagagagtactgtactagcagtagtagtatgtcgtttaacttggaagaggtaagggcgtggccaacttgcccatccctgagcagctttacagatgagcaagaatctctaaacaattaatgaggtcccaagatccagatctagctagtcattctgtgagactctgatctgagtatcgtacgcctgcttttgctgataagaagctcacagatttggagttttggatagagagaacctgaacctgaaccatgcagcttcagttcagcaaacagcactggcacaacggattcttgccatgagcggacacaagaaggcttgaccacttgagctacaccacatgttgccaggacgaagcttgatactcaccattagctgcaacttgcaaagaagctagtagttgatgtcttgttacgtgatggttcacccatcgccatccttagcttaacttgcacattccaccgaccgaacgaagacgcgaagagcgaggcatctgcctatctgccttctgcaactgcaactgatcaacacgccgacccttttctgacactgaaaggaacacactgcagagcatgcacgctaagtctttgctttccatctagctaatcttcgctggccagcaactaaactataactaaaatgtggtctaaacctgtcggcttcatgctccaggccctgcatgtcagtgaaacactccttgtcgcctctatgttctgctcccctaatctcacccaactagcaaggctagattaaaggaagagttaatgacagatcataaacacatactttctacttgcttttagatagtttaattacgtagggctgcataatctgcatttctttttttttatagatatgcatttgtgtaatgtcccttgtgtgcacgcaacagtgaagtccagtctcacttgcttatgttgcatgataatgacaccaacagtagtggcattgttcacctctctgaaacttctcgcattgatgcatttcagtgaacttgtcttctctctagtgatgtcttcagatcaggcagttgtctatgccgctttgcatcattgtcagataagggcttgtccgtatctccgtatgttgtcattcagagatctctcttatttatgtttgattggatatggggcacccgacaccagatacattgatatatacaacattcgtttcatactataagccgttttgactttttttttaagtcaaccttatttagctttggccaaattttataaaaaaaatataataatttttcaacataaaacaaagaagctattaaaatatatttaatggtagatttaataaaactaatttaatgttataaatgttactgtatttttctataaacctagtaaaacttcttaacttagttaatttttttaaaaaaatcaaaacgacttataatattaaacagagggagtagacgagtagtgtatattgataagtgatgagtccagcctacctgaataattcttttgagttaatatggaatgaattatgtaggaggtatccatttggacaccacttcagagttcaagttgatgtcaagtgctccattaagcacactgatgtagtcccttttctgtagtaagaaaaaggcaataagctagataaccttccattgcaattgtaatgctactcatagctaatgctgtagggacactttgatggtccaccaaatcagaaatattacaatgacaaactttgtctggtcaataacgccctggttcttaaatggcaggccatccgtttgttttgcagtagctattcgtcatgttggctacaaaaagcaggaaagcaaaggttggcaatggttgttcttcccatccgtttcgagctgcaatagaaattgaaacgtccagagtgagtaatgctattctgtctatgagaaattccaatgatctgtggctgaagctgaaaacatgccctgttgttgttagtaactgacaggccgttctgcgacttgatgatagccttcaatttcagtttaccagcataaaccacgcattgaattcgttccaacaaaattttcatgcgttgagaacttgagataacagctcaagatgaggtcactagttcgtttgtcaattctcctcgaaattgtcgatcatctttgcaggccttccaagttaaggtaccctgagctatcacgctgtcacgcggacgacgtgcgtaatacttctccgtgtaaaacgctgatccgtttgctacgaacttggtacaagataaatcgtaaaacgttaggacttgattaacgctgaaaaacacgcgtgttagagtccaaaccgattcattctccatgagaccatgacaaattgacaccaacacaaacgtttcgggcagttattattgaacaaactaccaccacaaattatctactatgtattatagaaattatcgggactggtgagagccggcgatgcacggaatttttgaaacgctctacttcactaaggaagatatgtttcacttttccgatcggaatttgaactctggctggttcaggttacagtcagaggaaataagaagtatggtaagatgaatgaaaggcagaaatacaggacatacgctttatcgcagaacatctatttgctttctattcgacaagaaggacaatgaaaagataatggatatggaacacaggtcctggcactattggaaaatgaagctctctcagttcaaacatatgagattacttacccggtttctaagggcggaacaggaaagtaccaaggtgcactaggtgagaagaacttttttcgcttttttatcggaatttgactcattttagtatagaaaaacaccattctatctgacctagtaggaaaagttactattttgcattccttagggaaagtggcattttcaagggtcatttttgaaaagcatttgtcccaaccatgtgcaaaagtaaagaaaattgcttctccctcgtaaatggctccaaaatctactccatttttgaaaacttgatagccagcatggggcaatttggtagttttttcattttgcttgtaaatcggctctttttggcatcccagttctgaactttttcatctcgcctagtggaacttgagactttttccagtatctttatccagcagcaggactttcactactttcccaagtaaagctagtgttaagagactggattgtagaagtgttgactgacttgactggaaatataatatggaaagactgatggactgactaaagtggctattgacttaagtggctatttcctgattccgatatggcgtcctgaatccaatattgcttgattgtctgttgatgcccagccgaagaagtgacttgcttaacgtagcaatttctgttttcttgtgctctccacctccgcttgacactatcgtagtagatcataagagaagtattctttcaagaaattcgtatagaaagatggactagctcgagaacaagcaacggattgagcgcactagcgcaaaagcgttagcacgcgcatccgttttcttgctccttggcttcaaacaatcgattgaatctggattcctttgcttatccttcctggctatagtctctcttgtgccttcggcagttcagttaaagatttctgtatcaacagtttgtttccccatttgctcaaagaacgcataaaacctgttccctcatcgtatcaaaagatcaagcggaagagtcctcttcttcaagaagagtttttcatttcactcttccgcagcaatgcccgggcaagaaaacaatatgagcaaatccgcaaaacaatatcatagcaaacggtatgtgctggttggatagagcaatcagtagttgacgttcgaaccaatcttctctctagtagactttagattcagtcgtccgtttgttttgttttgaattgacatagagaaattttcccactacgtaattaaggaataggtggcgaaggcccttggcggactatatataaaggaaaggggttatttttcctttacggcaataagagctgattcccttgcttgtagtttttgatcgatggagtgtatttaacatatttaagagtggttaggagagagaatcaatgtttagtagtaggcccggttcaccaggttctaccactgttcggcccaatcatagtcaaaatct

SEQ ID NO: 75064 - DNA, 2079 bp, Oryza sativa
aaagaaggcgccccggcaggaattctgtaagcttgacttgcgcgcagcgtttgggaatcaaagataaaaaataactctatgggacttacggaactggaaaaaaggtagcacctaggcgtaagaaagaaagtaaatagagacagcacctactacgctatctattgaagcttactatataatatataaaagaaaaaaaaaggccatataagtgagatcctagccagagaagagcaacaggagctataaaaaaggaacttatggacttgaatcagagattgggttgacatccgaaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaacagaggtcaggagctaccggcagggcgctgcttttaatctgactgatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcacagaggaacctcactgacgcattcagggctctgcagttgaagcgttcctaccatccatatatagggaatccataccgtcagcttgtcgatccgggatcgcccaggatcgggtggaaggtcagagaagccagtcttcagtggtgcttccatggcagttggatagtagatcagagaggcaggccagtagaatatggagttgtttttgttctcttgttattcttttatggctataagtctttctgtcttggattcgtaatgtttggccattaggtttgaatttccttctctttctgtcttccatttgaattctgtgacttatcctgcaatttggagagtagttgatatggtctttcttggctttggctttcaaagtccccttcttttagtattaggtagtagagggcatcgccactcagagattctacgataacccgcatattctaccttttgttccccttcctctggccccagaactctgtttgtccctagtagcactcccgtcttcttccaaggatgaagcctcaatgccattccctctttctcgggcattagattttgcttgcttgtactagaagttaacatcttcattactcgatggtgaaacctactctggtggggtccgagaacatagctagcccagaaagattgaagtgagagatttgcctggaaaagaaaggtttagtgctgcctgggttgagccattcctaacaactcatccagctcgactagcttgcattaagagtagttcatttcctataaagtgtagcgagttttctcccttttcacataaccaagaaaaaaggaaaagttaccctactacatgtattagctagttttgtctagtcaacatctaacgctcatttcactatgggatttatttactccgattgcttctactctcttacaactgggtgcgcctataaggaagacttttcatagattgactttgggcaggcaagttgaactatccggcttcactaacacaagtaagaacaagtataaaactccatattaagggttccttttgacctagtgattagcacaaaggaggagagaaaaaaggattgaataagcaagcaccagcattgactttcttgctttaactaacctgacaccaggcccttttgctctaggctctactccttgtcattgatttctagctagctttcccactcgcataaaaggaatgaatcgagggtatttacttgcatttctttgtcctacttgggctttaagaagagaggatttattagcacgacgagcaacgcatgctaacctagggattgaataggatatcataga

SEQ ID NO: 75065 - DNA, 14549 bp, Oryza sativa
  unsure (1)..(14549): unsure at all n locations
gaatccaattctttccaaagcgatttagccaaagattccaagggagaaagggtagaggagatcccgaggatcatttcccctctatcaattcggccggagaaggaaaggaacgtccggatttggaaggagacggcggcggcggcgcgcttagggttcgggccgggccgaaacggcggcttcggggaagacgaacctgacaggtgggacccacctgtcagcgaccgaacgcgcgcgcggcgcggctgtggactgggccggactgggccgaggagagagaagagaggttttgggccgactttcggtccaaagccaaaagaagactttttaaaacctttttcaatttaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagatcttctctccaagactttttaaaattatttctaaaaattccaattaaacaacaatttatatattttgaattttcagggtgtgacagatttgcacctcctctgcttcttagtttcaatacgaagtttgtgatcttaatgtagtcttctctactgcggtttttgttggctctttgccttaagccttaccctttggcgttgtacaggggcttgtctccttgatctgttgctttaatatatgtttaagtttaaaaaaaagatggaggagaggcatgcacaccactgagctcgtcggaaagagagagaaagaggatcgggccagcgccggcgacggtggcgcagccaccgcggaagaggaccgggccgacgccggcaatggcgacgctgccaccgcggacgaggaccggaaagggtgaagaaggggggagggggagacgggagctcgaggtcgatcagcgccgccgcttgggccatgccgctgccgcggtcgttgggggtggaagagagggcgccggcgaagataggagaggggagagggggagtagctcgaggtcgaggctgcgttctcggtcgatccgcggtgccggaggaggaggaggaggaggaggaggaggaggaggaggaggggaggcacggcggaggtggtgctccgacccagacggccgccggctgacctcgccgtccaacagtactacgccgcggagcttatgttaagggagggggaggaggaggaaaggtgntnttnnancnngtgctnggccacnccaccggtcccgttcggcttggttggcccggcgccgtcttccgcccggctttctgtggtggggaaaatttgaaaagaaagaggggataaagagggaaggtgaaaagtgaaaagaaaagtagtactggtgggaaccactataaggaacttgtactgtggaacatgtgactaacattgttcttggtctaggtggcatgtgaagcccaccaaaactttgtgacatgctatgaaagcccttaggactttgctatgtgtaaaagatagttttattagcaagttttaaatagtttttctctgaaattactcatccaatcttcaatctacttacaccaccaaactcattgtaattaaatctccacaacaagatcttacatgattatattctgaccaaaagaatatatgtttcagttggaatccaactacgttgcacattttaactttatatgttctaatgaatttttatcaaatgttgcatgtggtgtgttacgtggatgtgacttagtccaatgttttattgattcatttgaaaatgttgcacattgtattatatgaatgtttctgtaaaattacgtaatgtttcaaccatcgcacctcgatgttttatatagtatataaaagtattttacttaaaaatataatcatttttactcataatatgatcatgcgggatctttttataaggatttaattataataaatataatggtataatcggattgtaaattagatcaataatttaggagaaatatcatttaaaaattgataaaagatattgcatggatgtgcgtcaaacctacgcatgacagagaagacaggagagacagaggagagaacaaggagtgcagcatgcaagcatgcagagatggctacaccaaatagatattgcagcatggagaagggcgctcgactttttcaattttatcaggcacccgacccatagtcttgtcggtacatttatgcgtgtatttgggtatcatattgtaggatgagtttttgacatttataaatatggtgtattaaccaggcaacacctaccacacttcaaaagtatttgtccacaattattttttatcagtattgtttctataattttctaacatattactttgctttatagtatgtcgtacttaattcatccttatagactttaattatttgtaatctttttccccgcaaaaaatatatttataatcttttcatcatctaaaaaggggtaaaataattttgtttaaaaagcattttatattagtagtggcagaggcctttcaagccctaaaacaggaactcattccagctcctgaactagctatgccctaagccttatttttctcaggttgtttgtggttgagacaaatgcatcccatcaagatattgtggctgtgctgatgcaaaacgaccatcttatcgcttttctgagtcacgcactgggtccacgacatcagggtttgtgtctacttatgaaaataagagcttagctatcatgttggtgattgaacattaccgtctgtatctccagcatgatgagtctatgagccagaatgcatcgagaaggtccaggaggagtacgtttgttgatttttagatcggcaataacagaaggggtagcacagagataatgagttagagtattcggagcaagtgtgtgccctcaacttcactgtcgagcacatagaggcctcccaacgcgtgccacttccccaaacgaacgactcctctgtctcggcgtcgcacacggtgcaagatggctgcccactgcccgaggacaatgacacgcacttccacagttataccttcctggcacatcccactggcgcattggaattcccgacgtacgacggcaagggtgattcgctcccgtgccgctgcgacaggttcttccatggccaacaaacaatagagaatcgcaaggtttgatatgtgtttttgtatctaaccggggatgcctagttgtggtattgcaggcttgagctcaacgccggcgccccatcctggcggcgatttgtccaattggtgcacacccgttttggcccaacaatgatagatggccccctcagcgaactcatggcgttgtggcgcactggcatggtggaggattacatcaatagcttccttgcgctggtgtactgcgacgctatgctctcggagaatcaacacgttcaacttttcacggcaggcctcgtgaacccgctcaagacagatgtcacgctctgtcggtttcgctccctggattacgccatcatgctagcctgggactacgaacaacgcgtccacacttatcccattcccacacgggcgggccgcgcaccacgcttgcactccctacggcgcccgtggctgtgcctgtggcgatcgcgccaggcgacgcatcgtcctctgccgacgttggcaagcaacccctggtgactgccctccctcataagcatctctccctagcagggatggcccagtgccgctctaagggcctctactacaattgcaacaagaagtacgtcgccagacttcgctgctagaagtccttcgtcattgagttcatcacgttgggtgaatcgagcatatcgttgcatgccttgactggtgtgcactcgcccaagttcaacacaatcaagttccttgctcgcactggtgcgacggatctcgtcgccctcctggacttcagctccacccacaacttcataagcaacaccacggcatgacgggcgaacgttccgctccacccctatctcggcctcagtgtcgccatggtgaatggagaccacgtgacgtcgcccggtcggtgtccgcccagcgcgtcaaaattaacaattgtcctgggtgcaccttcgacatcgatttctacgtgctgccactgggggctatgacaacgtcctgggtgcacaatggttcggtacactcgggtcatcttgtgggattctcctgctaattgctcgcctttagcccagtcgataaccgcgtcacataggtgaggatcgacactctgccaccacccgtccactccatggccatcgacggcacctctggcgaactcatgaacaaactactcaatgacttcatcaacatcttcgccgaaccacaaggcctaacatcagaacaacacatgtgccatagcatccgcctagagcacatggagttcgccgtcgtcgtgcaccctgtcgaaacatgatttcggcaataataaaacggggtaacgcacgagacctaaaagtggatggatgcagagacaaaggatttagacaggttcaggccctctcaatgagaggtaataccctactcctgtttggggatttgaatccgccgagtgtgtattgatctgacgatcaggttgtgtcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatcttctctcgaactagattactctaaagccgagtgcttcaatcatcttcgccatggtctcccgagtacttttaccaaatctgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttgataattatagtcaaccaagtgacttgataccaatatatagcatatgcggtgtgaatccccgaataatatgatccaagtgatataccgactgcttggcaaaatatgatgcgtacaacctaaagttgacaacatctttgaaagttcacatagcaaaataattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacattcgagtaagtaaactcataaaggatttaccaaccgcctgaaaaatgaccataatatataatcagcctaagccataatattggtcaataaaaatgcacacatacgtggcaaaaagcaatgatattgtatccaatcaattgcttgataaacccaaacagcgccatgactatataaaaaagtcagcgggacagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccgaagcaagtccaaattgaagatataatacttgtatttgagctagtaagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaagtaatgaagtcgcatagccatggaggcgaagaaaccagtcggcggcagacagatcaactatcaatgaagatgaaagcgcccggcgataaagttgtgtagccatgacagcgaaataatcagtcggtgacagacgaggcaaatcaaaggcgatgacgaaatccaccaatcatgaagatgaagaaaatagtcggcgacgacaaatgcaactgacatgatgaagatgacgatgtcggtgatccagtcaatagcagtgtcgcaaccaatgataatgacgaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgctgaagtagagtgtctgccccgaagcaaagatgaagataatgactcctggagttgactcgttggctgattaattgatttcttcagcgtgacataaaatttgttaaattttgagccttgtatttgtgtagcccccgactctttgattagttgggaaacaactgaacatagagtcgagaactgtagcatcttgtcatcgaatagttattgcttgattgaagatatgtgttgaagatgtccaagtagaaatcatgaatgttggagagccacttgttgtagtaaaataacacggcatcgcatgccgagatgtcgagattcacaatgtcgcgaccgggaaaattgccttttcccgaacgctagtgtattaatccccgtcccaggaaaagccggggtacaccatacaaacatgatataaaagacacatctttattatatcggtaatatttacattattacaaaggcacttaaggcctgacaaacaaaaataaacagcagcggactagcggcctacggctccatcttcacaggcgctcaactggggtataagccaggactccacctaagacatcttctccaaagtttctcttactgaagggggaaaagattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacaatcctagagctacacagtattattaaacaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgcaaacacgtgccacataccaccacggtatacggacggaagacgtgacatagttcccaacccatcctagccataaacaagagtaccgacccaatcccacctacggccgggatacccgggacaggtaggcagaactgagcccctagcagcagggcaccaaccctctgccgtatgacatctcgactaccgggccgcagcccgtgtagccttcatttgccctggagaatgtccatcgacacccgacttcatccatctccaatccgtgtacttttgtttaagactagactgagccacaaactaagccttacccattagacatgtggaagtacggtagtgctttgcaacagaggcccgagcttaatccttatagtggccggggtgctacttcccacaactggcatgcacccaaaccccaccaaaaacaggttttaggggttttgaaagaggacgagaggtgtgtgtccaattccaacataagccaaccattccatagtgtccaaatgatatgagaattcccaaagtctaaagttgtaaaaccacctaaggttgcctaattaatcagcgaagcatctacctaaattcatactagtggaaccaggaatagagtacccactagttggggttttgtttattctagggtgaacaaggtaataataacaataacaataatagtaaggtcataacaaaggtaaataggcatggctaaataaaacagtgataacgcgggaatttaaataaagcgataatgcattaatttaaattaaaataattttgtaaactgggatttcaatatgctcaaggatgatgtgacttgccttgctcgctttcccaaacgacggcttcgacttccacgaagagcggatcttccgaagctgcagcgtctacacggccaacggaaaagaaaaggcttttactctaataaactccatacaacaagcaggaacaaagcacaaaaatgggttctttacatcttaaggaaaaattagagacttgaacggtccaattccgagttcaaatggccaagataaggccatttgaagtttatatgctctttaaatggatatttgcgaatttcttcatttaaattttaatttaaaaacgaattattgcgtcagccgaggggagagggcgcgcggaccgggtccatgggggtgggggcccacgcgtcagcctctcggtccacggtggaccgggagcacgcggctggcggcggtcggcgccgtgggtcccacgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggtgcggcggagcggcgcccgagagagcggagagaagggggaaagcgaacggcggtcttcggctcaccccgggacaacgacgacgacgagaacggcggccggagcggaagaaggcggcggcgcggttcgggatgacgatgacggcggcgctccgacggtcggcgagcgaaacggaggcgcggacgaggtcgacggcgatgcggcgatgccgagggaggtggcgccgagccgggaggaagaccggagcgacggcggcggcgaaccggagcggaggaaggcgacggcgcggttcgggatgccgagggcgacggtgctccggcagtcggcgggcgaagcggagcggcggacggggtcggcaaccactcggcgaagccgatggaggtggcgccgagtcgggcggaggaccggagcgacgtcggcggcgaaccggaggtcggcggcgacggcggagagagaggagcacggcgcgagcacggatccgacggcgagagcgagcggcgagcggcggaaacggaagagcggagctcggggagcaattatataacaccgagagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgcggggagtaattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagcggcgggcgggcccgcctgtcagcggcgcgcgcacgggggaggagccgatgggccggggggaaagagagagagagagggagggaatgggccgagccggcccaagaagggaggaggagggggaaaagacttctttttagggttttctttttataaaacctttttaactttgtttatttcttttcaattattatttgtgctctgaaaattccactaaaatttgagggctccttttagaccaaggagaatttaacaaaaattctccgggccatatttgaatttttcttggacgtattttagtgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagttcagtgatgcttccgttccagaacttctcatgcttcatatcttcggagtcaacctcagacaagttaccacttcacgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttcccaaatagttttactgctggatttgttattgtctgatcgtgatcctgccagatctgaagcttcgttgttagaggtgatcttaatctgacctctgtagactatcttcgaacatatcacttggttcataactgggaatggctctcacgaacaagcagctcggattcactttctttacattcagtttacttcccattattatcttcaggttgtcctcagttagcattcaacgtattcctttacacttttaaccttgatgtgttctttcccattggatcatctcccaagacttggcattacctggtaaccggtgcttgcacttttcacttcgtgtagcatctgataccgagttgaagatttcactccttgccttcatagaaacatttttacctaggtcatcttgcttacttaatgacaaggtggctgttgtggggcaattacaattaggggtcttccttgagcgatgcagagcatgtttctgtttatcaatcacctttcggcctacttctttcatgctagagaacatctttgtcaatctctttttatcaatcatctttcggcttatctctaacaggtggtattctttaatgtggattgcggacgcttctggggacgatgaggtcctttggcttgctgcctttcagtgaaaccttgatgtggtgcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttatctgttggcaggtatatccgatcttatcaatgtagaggtatggcgggtacccttcggggtttcctccaacaatccttatcttgatctgtaaaaggcgtatccaaactcctatcctcaactactgtctcgttggctttttaacccaacacagtttaattgtttttcttttccatccacaggttggctattaactcgaggttagaatatagttcctctgacacgagaccctaggtctcctttgtcagtaaacaattatacacatgatcacatatccgcatctttcaaacgaatcctcatggaacttgtctgtattacacatttctccctcattacatgaatacggggcactgccttaaacaaaaagggacggtgcttaacatcggtacattgtatctactatgggttagaattaacatgaggcctcacaggtacggcgtttgctccagtgaccacaaggcgagtgacttgtcttcttcttgcataatggccggagtgatggcgcaggttacgcttcggctgtggacaatctctagagaaatgtcctggtcctttgcagttgtaacaaatcaacgtcttctttactgagctgtccatctggggacgatcattttgacttggagttggaattggtggttgggaatccttgctaacattggcatcagtggtaccattattgctatcaccattggagtccttcccagagtcaaaattgctagggttgtcattctgggtgccttcattgatactatcgtcgatatcttggtgaatgatgttgacattgcacgcttgatctaagtggtcatgaatggggcaagaaccatggttgttggtggtatcatcagcattagtattgctattgttgttgcctgcattgcgttcatcttcttggggcaggaactcttgatacacaacagaagatccggtgatctgaagtggctcagtgcgctgtctttggttaccacctggaaatactgggttgttaaccatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatattgagccaaacgatagaactcgtgcaggtactctgtgacggtcaaatctccttgcttcaggtagcggaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgttggttgcccctgctgggttgttccgattctgtaatagttgaaaggcggttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtaggggttgagagaggaagcatacaaggaaagaatataccagagctagggacaggaccttaaaggaactaactctttttattgatgtgttgtttgttatgcttattctgcaagttgattaaacaaacaacctaacatggtcacatcacaacccaccgatgcaaaccacgcactacacacacaagcaaggaacacacgactaacaacactaccctatagggcggcttaggttctgcgacgggttttccaagatcttcactcctgcttcacagctggcttcactgcttcctttgctacgctagcggatcctgcagtcttccggagcttcggcaaacaactgacgatatctttttcttcacaaatctgaccaactagtactaattgaaatttgaagaaggaagaaaagagtaaaccttttgcaaatagcattaggggaagaagaaaagaggaactttcgcaaatagttttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcggtaatatttacattattacaaaggcacttaaggcctgacaaacaaaaataaacagcagcggactagcggcctacggctccatcttcacaggcgctcaactggggtataagccaggactccacctaagacatcttctccaaagtttctcttactgaagggggaaaagattgagcaagaatgagtacaaccacagtactcagcaagccacaccggagatgcataattaatgcaagggaggtacaagggaataataatataggg

SEQ ID NO: 75066 - DNA, 17298 bp, Oryza sativa
  unsure (1)..(17298): unsure at all n locations
cgggatgaatccggacgaatccgaggaagagagagagggaaaagaggggaatcggaagagggaaacgcggggagtatttcccctctctttaatgcgcgtgggaacggcgggatgcggcgcaatccgcggcggcggcggcgttagggcacgggcgcggcggcgggcccggcgggagaaaggcgatgacaggtgggccccacccgtcagcgagagcggcgggcgggcccgcctgtcagcggcgcgcgcacgggggaggagccgatgggccggggggaaagagagagagagagggagggaatgggccgagccggcccaagaagggaggaggagggggaaaagacttctttttagggttttctttttataaaacctttttaactttgtttatttcttttcaattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggataaatttatcaggacgtgacacacaacaacgttgtggttggtgaagtagtaaaacttgcgaagtagcaacaatagagtttgccggtgccgaagataataaagatgaagtcgctccaccatgatgacaaagttgtattgctgtaatgaagtgaacacaagtcggcggcaacagaagcaaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggtagcttgtgttgaagatactgatgcctattagtagtgacagcgatgtagccagccgtgaagaagatagcatcagttggcgtcataacaggccagccgtgcaggcggtgacaccagtcggcggcggatgaggcggccggtcggtgaagacgtagacgcccaacaacggcggcataataggccagccgtgcaggcggaaacaccagtcggcggcggcgaaggcaagccggccggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgccctacaacggcggcataatagaccagcgagcaggcggaaacaccagtcggcggcggacgaggcagccggtcggtgaagacgtagacgcccaacaacggcggcataaaggccagccgtgcaggcggaaacaccagtcggcggcggcgaaggcaagccggtcggtgtcacgtcctgataaattcattccaaaataaaattcattttctaaaaggaataatagaattaattaaaattcgaaaagaaattggcaaacactaaaatacgtataagaaaaattcgaatgtggcccggagaatttttgttaaattctccttggtctaaaaagagccctcaaactttacttgaattttcagagcaccggaaataattattaagcaacaaaaacaattaacaaagtttattaaaaagaaaaacctaaaaaaaaataatcctcttcctccttttcttttgggccaattttggcccaaagtctcccctctctctctttcggcccgcggccgaagtctccccctcctccctctctttccctcctctcccgggcctcccctccccctcccggcccagctccctcccctcccctctctctcccgggcctcctctccctcctctccgcctgggcctgcctcggcccagcagcccggcccagccgccccagcctcccgagccgccccccccctcacgcgcgccgcacgcgcgttgcacgcgcgcctggccgcgtgggtcccacccccgggtcatcttcttcctcccgctcggcctcctctctctcccgtgaaaaccctagttcgttcctccctcgaatccgcgcgatttaagcgttggattccaaaattaattgggggaaattaatcccctttcctccctctcccttttccccctaatctcccctttaatcgtgcactattttgaccggaacggctgcgtcattcatggccgccttccatggccgccgggcgccttttccgccgccgttccccgctcctcccgtggctggctccctccccacgcctataaaatggaatccccattcttcgttctatcgttttagccccttcccgagcctccccgtggtcgtaccacccctccccgccttctccttctctctcttcgacgccggccggcctccagccgcctctccctcctcgccggagcgtcgtccggtcgcgccgtcacctcctccagcgtcgccgccacctcctccaccccggcctgccctccgtttcccgcggagacccccggaggcgcgttcccgccgtcgcccttctttttcctccgcgccggccgcctccagccgcctctaactccctgcctgagcgccggtcaacgtcgccaccaccttcctcggctccacgacgccgctctcatccccggcatcacatcctcctcgcccgaacttcgccggaacaccggcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaatctctccatccgcctcgccggagttgttcggccgcccgtccctcctcgcccgtgcaccggtcgaccacaccactaccacctccggcatcgcagcggcaaggttgtcctcggcatcgtttcccctccatccaaacccctccgcggtccatcatcgtcgtctccgatcgttctcgtcgtcgacgtcccgtcggtcgcccggctcatcgtctcgcggcgccgcctccgtcatcatcatcgctgcggcgtgttccacgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcgcctccgcgtcatcaagcctagtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcgcccgtgcccgttgtgcggttgtcggccccggtacccgtgtaccggtgtcggtagtcgttcacgcgtgcgagtggtgaccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacctgttttataattgcaaagcctaattacaaaaatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggtttgtagctttgcttgtgtgtgtcgcgtcccaaatcgactctaaaattcatcctcaaaattgtgcaaaagaataagtaaaattcatgtgaaagcctccaacaattaaaatgtgcaaagataaaagtcaaatgaggcttgtaggatttttgtatatttcctaaaagcctaaaatgcttaaataaattttagtggaattttcagagcacaaataataagtgaaaagaaataaacaaagttaaaaaggttttataaaaagaaaatcctaaaagaagttctttttcccccccccttccctcttgggccggctcggcccattccctccctctctctctctctcccccggcccatcggctccccgcgcgcgcgcgcgccgctgacaggcgggcccgcccgccgctctctctgacgggtggggcccacctgtcatctccctgctggtgccgagccgacgcccgcccgtgccctagcgccgccgccgccgcggattccgccgcatcccgtcgtctccgcgcgcattaaagagaggggaatcactccccgtgattccctctcccgtttccccctcttttccctctctctctccctcggattcgttcgaatcgtgcccgcattcgtcgccggcgcaatcaatggcggccgaaatctccgcgacggattcctccctctccggccgctctttccttcccccggcgctatttaaacgttgcccgagctccgctctttcgtttccgccgctcgccgctcactctcgccgtcgaaatcgtgctcgcgccgtgctcctccctctccgccatcgccgccgagctccgttccgccgccgccgccgctccggacttcctccttactcggcgacacctccgtccgcttcgccgtgttgccgccgaccccgtccgccgctccgcttcgcccgccgaccgccggagcaccgtcgtcatcgtcatcccgagccgcgccgccgtcttcctccgctccgtccgccgtttccaccgccttcgccgtcttggggtgagccgtggaccgctccgttcgtttcccccttccctcctctctctcgggtgccgctccgccgcgccgttggtcgccggcggcgaccatcggggcgcgggcgcgccgctcccgtcgccagtgccggagaggccgccttcgggcgcgccctcgcggctgccaagtgggcccggccgtcagccgcccgcgcccgcggatgcggctgacgcgcgggacccacggcgccgaccgccgccagccgcgtgcgcccggtccaccgtggaccgagcggctgacgcgtgggccccacttcccgtggacccggtccgcgcgcccgccccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtgaagttatttagtgttaaagcctttttcttttccgttggtcgtgtagacgctgcagcttcggaagatccgctcttcgtggaagtcgaagccatcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttataattattaccttgttcaccctagatcaaacaaaaccccaactagtggacactctactcatgacaccactagtttaattctaggtagatgcttcgcaatttaattaggtaacattaggaggttttacaactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagtgcctgtggtcgtcgccctagtcttccgctgttttttttgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatcccaagccttagctatattttcaaaaataaaaatcctttgttatttgtgaaaacccgctattctctcttgtcttgctgcttcatttatcgtcaaaatctggcctttaaaatgttgtttctctttttgtttttgtttgtagatggccggcagcgttacccgtcgtggtttgcacatgactggcttcgtcttggagctgcgaggcatgtgcgtggtcttggggtatccacacggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgtttttctctcgtttgtcttgttgagttgtgtggggcatggttatgccggtgtgtggcataactatgtcggagcctgtctttatttgtttgcctaagcaacttgaaccttaatgaaccaatttaatagcagtgataaatttaagaataatagtagtcgtgggtggttagttttaatcgtcagctctccttctctgtttgctggttctgtgtggggttttcagatggtgacgaccaggagaaatgttaacaccggtgaaggcaaccaacccgagggcagcaaccccaaccaccaaggcaatccacctccaccaccaccaccagacaccaacgccattctcacccaaatcctcgcccagcaagccaacatgatgaatgctttcctccaccacctccaaaatccgccacaacagaatgctccaccaccacccccacaacactctaaactcgccgagttcctccgcatccgcccacctaccttctccagctccaacaaccccgtggatgctttggattggttgcatgccgtggggaagaagctagacacggtgcagtgcagtgatgaggagaaagtcaccttcgccgcccatcagctgcaggggcccgcatctctatggtgggaccatttccaggccacgcagccagaagggcaacctattacttggactcgcttcaccgccgctttccggagaacccatgtgcccgctggagtcgtggctcttaagaaaagggaatttcgggagttgaagcaaggcaaccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcagcagcagcagcagcaacctcgctccgcgcctcgacctcaattcgtggtgcgcgtcccacagcagcaacagcagcagaatcagcaagggactcgtgcgccacgtcctcctacgccaactgtgcagcctgttcaaggtcgcagggacgcttcaggtccgcagcgtctgtgcttcaactgcttcgagcccgggcactttgcggataaatgcccaaagccaaggcgtcagcaaggccaagcgcctccccgctccaacaacggtggcaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagtaatcagttgggggtagaaaggcttagaaaccctctgcttatcaccacccctggaggggttatgacagcaaagtattatagccctgccgttcctatagaaattcaggggattccttttccctcggatctgattctgctagacaccaagaatttggatgtgatccttgggatgaattggttggcccaattccaaggggtagtggattgcgcgaggcgcactgtcactctgtaccgagggccagaacaaccggttgttttctttgcacctccaacctctgtcagaagttcagaacttcatcagataggactgtcagaaatccccatagtcagagagttcggagacgtgtttccggaagagcggagcggcgcccgagagagcggagaagagaggaaagcgaaaggggcggtccacggctcaccccgggacgacgaggatggcggaaacgacgaccggagtggaggaaagcggcggcgcggttcgggacggcgaggacgacggtgctccggcggtcggcgggtgaaacggaggcgcggacgaggtcgacgacgacgcggcgaagccgaagggagcgatgccgaagcgggagacggtccggagcgacgacggcggctgaccggagctcggcggcgacggcggagagaaggtgcgacggtgcgggcttgattccgacggggagagcgagcggcgagcggcggaaacggaggagagaggcacggngaacaattatatagcgccgggggagagagagaggggccggagggggaggaatcggccgcggaaatctcggccgccatcaaagacgccggcgaagattgcgggagcgattccaaacggatccgagggagagagagagagaaaagagggggaaaagagagagggaatcacggggagtgattccccccactttaatgcgcgcggggacggcgggaggcggcggaaacggaggcggcggcggcgctagggcatgggcgggcggcgggagcggcgggaggaaggcgatgacaggtgggccccacccgtcagcgagggtggcgggcgggcccgcctgtcagcggcgcgcgcgcgggggagggccgatgggccgcgggggagaggagagagagggagggagagttgggccgagccggcccaagaagggaaaagggggggggaaagaagacttttagggtttttctttttataaaacctttttaactttgtttatttcttctcatttattatttgtgctctgaaaattccactaaaatttgagggctccttttagaccaaggagaatttaacaaaaattctccgggtcacatttgaatttttcttgtacgtatttttagtgtttgccaatttcttttcgaattttaattaattctattattccttttagagaatgatttttaattcgggatgaatttatcaggacgtgacaaatccaccccccttacaagaatctcgtccccgagattcgaggaggctagcaagaagataggttgggcggtcttctcttcttgtctgacttcttccgctctgtcttctataacaaacttgtctaactaaacttctccactctggactgcttggctcgatctcctgttgcagatggaatcttctcttcacccgacttgtccctggttgaacctttagctgacttcgactgggttgcggcacttgaagatggggcttcagttccagtactttgcgtagttcatatctttggagtcaaactcatacaagttacccacttcatgtcatgcgtcgagatcagctcgtcattactaagataccatgcttgtcatttgcttctaactcgccaccaactgcctcatactagctttcctggtctccgggtgatagctacttctgctatttgatgcaagggtcgataactttgcctttgaattatgtttcccaagagaaccaacttatcccacttgacatactttgacgtcttcccaattggctttactgctggatttgttgttgcctaatcattatcctgccaaatctgaggcttcgttgttagatgcgattttaatctgacctctgtagattatcttcgaacatatcacttggttcataactgggaatagctctcacgaacaagcaactcggattcactttctttacatttggttcacttcccactattctcttcatgttgtcatcatttagcattcaacatattcctttgcaccttccgccttgatgtgttctttctcgatggattgattgctaggaaagtgcgttgagcgatactagtgcaggtgcttttattctagtagcatctgatacaaagcccaaggttgaaccgagctttaggttccactgttcaggttttacttcttgacttcttggtcatgtcaccaaagtttccatccttgtccccatagaagtacttctacctgtggtcatctctcttactcgtgaattcacctactttaatgacagggcaactgttgtagggttgtttgctatcgggagtcttcctcgagtgacacaaatcatggttctcgttatcctttatcaatcacctttcgacctacttcttttcccagtaaccaaacatcttttccgatctcttccattaatcacctttcgacctttctcaaccaggtactcttcgctccgggtgttgaggatgcttctggggcaatgaggtgcttgggcgtgcggtctttcagagaaaccttgaagtagtgcgtcaaaagctagactgacgattgttgcctttgatccgaagagacacatctgaaactcttagtccgaacaaatgcctctttggttgatcacttgattttcttcgccatcaatcgctaggctatttgattcctaacagattatgggtttacggaaatgagaccctaggtctccctaatcaacaacaaaatgtgcaccactcacagcacttgcactcttaacatgggtccttcataagcttatcaaactcattcattatctcatgtttctctgttattacatgattgacggggaacaactataaaacaaaagtatttgaacactgatataagagtattatggttgcttctgactagcgctaggcttatcaggtactgcatttgctccagtgaccacttggcgattggcatgtctgcttccttaacaggtactacagtttgtaacagacaataactttcttacgctcgggttcttcatcttgtacttgatttctttggctgctgtgctggaacatccaaaggtacaatgccgatactggcctctgtcttgtcaactgatgactggggctgaaattgagcattgacaccttgtggtaatgcactcgctggagttggagctgttgcaacgcggtctataggactgcttcgggatgcatggatgacaattcgctgaggagcaagcttctgattgcaaggagttgcgtggactgacgtgctggcagctatgtttctcggtctggggcacttgtcggcgaaatgacccattccttgacaattgaagcaacagatatcttcccggacttggcattttcttttctattatcaggttggttattaactcgaggttcgaacatagttcctctgaaatgagaccctaggtctcctttgacagtaaacaattatacacataattccatatcagcatcttccaaaataaccctcctagaacttgcttttattacacaggtctcccttattacatgaatacaaggccctgccttaaacaaaaagggaaggtgcttaacatcggtacattgtatcctcaacaggaatcatccataaatatagcaagctcactgtttatagtcatgactatatttatttattacatgattgctgcaaactttctattacacaatgataagtagcgaactgaaaaccacaaacggggctgctcattttgattcaggagagatatagctggcattgtcctagtgactgcatccttgattggttctgtgatgatgtggtaggactgcgtattgctatcattcacaggagaagcttccttctgattgctgtttgaagcggatgacggttttctgcttggtatcgccctcttgaggttgattgccctttgcttggcctggagtaggtcggggagagacacaacttcttccatcgacgacaattctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatggtttgtaccttcgcacacaaaacatgtgaccttgcgggtgggacactcccctggtggatggtcttcttcacaataagcgcagagtgtgagacacatgctagcaacgtgtccaatttctccacaacgggtgcatgcttttgattccatctcttcctcaccgagatgtcggggagactcatcttcatcatccgaggagacttgatctgacccttcactatcagatactctgccaccatggcttagaaggtgctgggtcaactgtcgtgcacctcggaaggtatttcctctttgacgtctaggaatagttatccctgcggaaggccattcggtgctgctaatagccatcttacgtacttcttcttcagttcgcatcggcgcttttctcttctgattcttactcttcttgcctttggcttgcttagtacgtgaccccacgtggtacgaaaggctaggaggaaagcaattcccgggattccatggattctctccattgggctctctactttgcacactaggctgcaagcttgtcttggtgtgaggaggctggtttagtgatgtctgccctgctaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaagcaaacaacctagcatggttacatcacaacccaccgatgcaaaccacgcgctacacacacaagcaaggaaacacacgacaaacgaaacactagagggtggcttaggttctgcgacgggttctccaagatcttcactccttcacagctggcttcactgcttccttcgcttcactagcggatcctgcagccttctggagcttcggcagacaattgacgacatctttttcttcacaaatctgaccaactagtactaattgaaatttgaagaaggaagaaaagagtaaaccttttgcaaatagcattaggggaaggagaaaaagaggaactttcgcaaatagttttatttataaaatatgtccttaggttttatccacttggcttatcctacagtcgagatggctctgataccaccttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccagagatgcataattaatgcaagggagtacaaggggataataatataggggttaagttttgcagtaaacagcatttaaaagtcacttagttgcccaaagccgttttataaagacgatcctagagctacacagtattattaatcaaggtcgtgaacccacacgaacttgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagttcccaacccatcctagccataaacaagagtaccgacccaaccccacctacggccggaacccccgggacaggcaggcaggattgagccccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgagcttaatccttatagtggccggggtgctacttcccataactggcatgcacccaaacctcaccgaaaacaggttttaggggttttgaaagaggaagagaggtgtatgtccaattccaccataaaccaacaattccatagtgtccaaatgatatgagaattcccaaagtctaacgttataaaaccacctaatgttgcctaattaatcagcgaagcatctacctaaatttatactagtggaaccacgaatagagtacccactagttggggttttgtttattctagggtgaacaaggtaataataacaatagcaataataaggtcataacaaaggtaattaggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacttcccgaagagcggatcttccgaagctgcagcgtctacacgaccaacggaaaagaaaagggcttttactctactaaactccacataacagcagaaacaaagcacaaaaatgggttcttgacttcttaagaaaaaattagagacttgaacggtccaattccgagttcaaatggtcaagatatgg

SEQ ID NO: 75067 - DNA, 7553 bp, Oryza sativa
tttcgtgattagtctcacacttctcaccatagtaaatgatgcttaaattggtaataatttgattagctcctggtttggaatggtacattcctggtttggagatagacctgtgcagccgggatggttgttcagaatggatgggcctatataacagggtatgttgtatagcgttggattaatattgcttaattaatacttaactgttttattaaattctcaaatgtttgctaaatgctgcttttgcaaatggatccctattacgccatcctttgttatcctgtgcacttgcatatttgctgcgtgacttgctgagtatgtgatatactcaccttgcaatcattcatcggaggaagagttctacaatgaggctgatgctgtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgcctcggctgattcctggacgagggttcacacacatgtaagcgtttggaattttggatagaaattccgggcgtgacaaaatcgacgaggagctgcggcaatgctgcgacgattgcaaccttcggtctcctttggcgtgcagactgcttgacaaacctgtaatccccttcggtcacctccacagaaactgcacaaattggagatttgatattgagccgtagattttggtgtaggcttcaccgggctcaaccagaattcaccatggagttcgtcgttgtatctgaggagcttgagctcaatccgaacaacaaactgtggagattatggataccccatatctacacggcggttatatttagactggtaataggataccgaatatagatataatatctttatttgtatctcgggtttgtttcttaacttgtacgtcaaggaaataccctgaggtttagtcggttacgattgtattttatctgtattctcgtattctgttaggggtatgagttataccttataatacggactccttcctctatataaggaggggtccgagtccttcctgggacatcaattttctaggagatcttacattcaataatacactcggtggtttcatccccggacaggagtagggtattacttcttgaataagaaggcctgaacctgtataaatcctttgtctccaaacccatccacttttccagcttgatagccacccccttttagtattgccgaaatcttgtttcgacagttggcgcgccaggtaggggttgcgtcaagcttttcgccgatcagtgcaatgggttccgtctccggcatcgacgacctcgtcttcccacccgggcaggcgtttcggttcggcagcctcgagttcatcaccaatgacttcggcaagatctctctcctcgattcggaattggaccagtcgggagagagccggatctcggtcccgtttggagttcctaacgcggctgaaatatactccaagtccatctcaatcgagtcggcttcaaaccactcggacgagatcgcatcttctccaacgtcatcagatcgagatgatggggcttacccaccgattctaatgaagctccccgacgatttggcggccgtcttcaccaccatgacgtccccatcccgtaggcctaggcggaggtcggcttcaacaccgatatcgcatagctccagggaagttggcgtcatcttccagccactcggctcagtttcgacggaccagctggatggctactggagctctcccgccgtcgactcgcgtccgaccgagatcgtggactacaatgagttcggctttcacaacaacgacccagatctcgacgacttcgatgaaagcttagaagacaactacacccctctctatttcggcgtctttatggccgataacgagacggaggagcaacgccaagcccgggaaaccgaagcacgacgcgaggccgagcggcgccgactggaggaggaacgtgaagcacaagaacaagaacggctacggcgtgagcaacaggagcgtgagcgggccgcaaaggaggctgaagaccggcggctacgagccttggaagcagggcaccgagcgcgagatcttatcggccaacaagacgttgaggggacaccggttttccgcaccccacaacagaatgctgttgccgcgatcaccctcctcgacaccctcctcaagagaacgagctcaatcagtctgaccacgtcgtcaacatcttgaaccagaccaagaccatgattgcggcttcggtcccagttaactccggaagcgtccgcacgtcgagtggcagctgagtcccccatcttcgatctcacgactaccaccagccaagccttagcatcactggcgcaggatctaatcgcaggagcaggggtcacgacgagtgatctgtccactcgcctcccgaccatcatagggagcgccgagtggaatgacctcgttcgccacctcgtcgtcgccccgtcgatctttgcgacacgatcatacagcgccgggcagcccgaggccatcatcattcgctagatcgccacgacgacgacctagacggagttgccgctttcaccaacgacctgcgtcgagtggattggccagccggctttaagccgactggaatagagaagtatgacggttccaccaacccggaatcatggcttaccgtctacggtctcgcaatccgcgcagcaggaggagatagcaaggccttggcgaactatttaccagtggctttagcagattccgcccggtcctggctccatggattgccccgtggtacaatcggatcttgggccgaattacgcgaccacttcatcgccaacttccaaggcactttcgagcgccccggcacacaattcgatctttacaatgttattcagaagtccggagaatctcttcgagattacatccggcgattttctgaacaatgcaacaagatctctgacatcaccgacgatgttatcatcgccgcattcaccaaaggaattcgccacgaagaattggtcggcaagttcgggcgtaagcctcccaaaacagtcaaacttatgtttgaaaaagccaacgagtacgccaaggctgaagacgccgtcatcgcatcaaagcagtcgggctccagttggaagccaaaaaaggatacaccggctacgggagggggtggaagatcatcaaagcgttcgcgcgtcaacacgttcgacaagatcatgaactcccaatgcccgcatcatcctaagtccaaccacgcggccaaagattgtttcgtctacaagcagttcgcggaacaatacaccaagactacacggaagaactccgacgaaaaacaaagcacgtcgaagaagaaggacgatggcgaccccccggcaggtttctaagaccaccgcaaggagcttaaccacatcttcggcggccccttggcttatgaatctaaaagaaagcaaaagttgactgaacgggagattaacgctgttcagcccaacataccccaatatcttcgatggtcagagacagcaatcaagtttgaccgctcggatcatcccgaccgagtggtccacccggggcgataccccctggtactagacccagtggtccgtaatgtcaagcttcgcagaaccctcatcgacggtggcagtgcactaaatatcctcttcgccaaaaccctggatgatatgcagattcctcgctccgagttaagaccaagcaatgcgccttttcacggagtcatcccagggttatctgcaactccactcggccagatcacccttccggtcacctttggcactcgggaaaacttccgcacggagaatatctgcttcgaagtcgccgatttcgagacagcataccacgccatactcggacgtctggcgttagccaagttcatggccgtcccgcactacacttacatgatgatgaagatgcccggtccccgaggagtcctatccctacggagcgacatcaagcaagccgtcacatgcgataaggaaagttgcgagatggcccagactcgcgagatggcgtctgcccgagaagatatccgactggctgcgaccacggcaggcgaaggagaagtgcctgcgaccaaggtctcgaagagcggagaaagcgatgctaagactaaaaagattcccctagatccttctgatcccactaaaactgctgtaataggcgccgagttagattgtaaataggaaagcgcgctcgtcacctttcttcaaaataataaagatatctttgcgtggaaaccatctgatatgcctgatattcctagagaggtgattgagcactccttgcacgtcaaagaagacgctaaacctattaaacaacgactccgccgcttcgcacaagacaagaaggatgcgatcaaggaggtattaaccaagctgttagcagcaggcttcattaaagaagtcctttatcccgactggctggctaacccggtcctagttcggaagaaaactgggcaatgacgtatgtgtgtcgattataccgacctcaacaagtcttgccctaaagatccttttgggttgcctcgcattgaccaggtagtcgattcgaccgccggctgcgagctactcagttttttggattgctactcggggtatcatcagatccgactgaaggaatccgactgcttgaagacttcattcatcacgcccttcggggcctattgctacatcaccatgccattcggactaaaaaatgcaggagcaacttatcaacgcatgattcagagatgcttctcgacgcaaattggccgcaatgtcgaagcttacgtggatgatgtagttgtcaagactaagcagaaggatgatttaatctcggacctagaagaaaccttcgcaagcatccgcgctttcaggatgaaactaaaccctgaaaagtgcaccttcggagtaccgtcagggaagctgcttggttttatggtgtctcatagaggcatacaagccaacccggagaaagtcaacgctatcctcaacatgaaaccgccaagctcccagaaagacgtccagaagctgactggatgcatggcggcgctcagccgattcgtttcacgacttggcgagcgggggatgcccttcttcaagatattaaagaaaacagacaatttccagtggggacccgaagcacagaaggctttcgaagacttcaagaaactcctcaccgagccaccagtcttagcctcgccacacctacaggagccgttgctactatacgtatcagccacctcccaggttgtgagtacagtcttggtcgtcgaacgtgaggaagaagcccatgtccaaaaagtccagcgaccgatctactttgtcagcgaggtcctagccgactccaaaacgagatatcctcaggttcagaagctgttatacggtattctgattactaccaggaaattatcccactacttccacggtcactcggtaacggtggttacatcgtttccgctcggcgatatactgcacaaccgcgaagcaaacggacggattgctaaatgggatttggagttgatgtctttggacatatccttcaagccccgaacctcaatcaagtcccaagcattagccgacttcgtcgccgaatggaccgagtgccaggaggatattcccgcagaaaagatggagcactggaccatgcattttgacggatcaaaaaggctttcgggcactagagcgggagtggttctaatttccccaaccgaagaaagattaagttatgtgctttggatacatttttccacatcccacaacgtcgcagagtatgaggtgctcctccatggactacggatcgtgatttccctagggatcaagcgtctaatagttcgaggggattcacagctagtcgtcaaccaagttatgaaagagtggtcctgcattgacgacaacatgacagcatatcgacaagaggtacgcaaattggaagacaagttcgatggactcgagcttagtcacgttctccgacacaataacgaagccgccgatagacttgccaactttggatccaagcgcgaggtggccccctccgatgtattcgtcgaacacctttatgagccgaccgtacctcagaaagaaacaactcaagttgcggacactcaagacatagccatgattgaagccgactggagagagcccctcatacgatttttaacttctcaagaactccctcaagataaagatgaagccgagcggatttcaaggcgaagtaggctttatgttattcatgaaaccgagttatacaagaaaagaccttcaggaattctgcaacgctgcgtatctctagaggaagggagacaattgttgaaagacatacattctggaatatgcggaaaccatgccgccgcacgcaccattgtcggcaaagcttaccggcagggttttttctggcctactgcagtatccgacaccgacaaaattgtgcacacgtgcgaaggttgccaatttttcgccagacaaatccatctaccatctcaagagttccaaacaatcccactgtcttggccgtttgcggtttgggggctcgacatggttggcccgttcaaaaaggcagtcggcggttacacgcatctctttgtggccattgacaaattctccaagtggattgaagctaaacgggttgtcacaatcacagcagataaagctcgagatttcttcatcaacattgtgcataggtttggagtgcctaatcggattatcaccgataatggcacacaattcactcgcggagtttttaacgacttttgcgaagacttcggaattaaaatttgctatgcctcagtagcgcacccgatgagcaacggacaggtcgaacgagccaacggcatgatacttcaagggataaaagcgcgagtttttgaccggctaaaaccctatgctggaaaatgggtggaacagctgccatcagtactttggtctttgcgtactacacctagtcgggccacaggccagtcaccttttttccttgtctacggggcagaagcaatattgcctagtgaagttgaattcgaatctttgcgctttcacaattttcgcgaagaacgctacgaagaggaccgagtgaatgatctgcaccgattggaagaaatccgcgaagcagctttaattcagtcggcccgatatttacaagggttgcgacgctatcataatcgcaacgttcgatcacgagcttttctagtcggcgacctggttttgaggaaaatctgtcacgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatctccacaggcgctcaactggggtataagccaggactccacctaagacatcttctccaaagcttctcttactgaagaggggaaagattgagcaagaatgagtacaacc

SEQ ID NO: 75068 - DNA, 1321 bp, Oryza sativa
gactttttagggtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgtcaatttcttttcgaattttaattaattctattattccttttagcgaatgatttttaattcgggatgaatttatcaggacgtgacattaacccaacgctatacaacataccctgttgcataggcccaaccattctgaacaaccatcccggctgcacagttctatctccaaaccaggaatataccattccaaaccatcccggttggcacggttaatgtttcacagccgaaactcgtgaaccggtccttaattgtcatgagcacgaccatcaaaaccatgtgctcacaacccaccattatcaggttttagttggcaaattaattaattaaccaatcacgattgaccatcgtgagctatcattaagacatcattaaataatagtgaattataagttatcccaatagtgtgctaatgtttctaagcatggctaagcaatcatatctaatatctagctgaaccaatatataaagcccaactagtcaagttataataacccaaggtatcaaggaataaagtaatcaagaacaaaagggctataacaaacaataggttaatttcacccaatgacattcgaaaataaatgcaatagttgaatagaaacaatagctttaaacgggatcaacatgctcaaagggttgtttgggatctgtgtgacttgccttgctgtcacgcctagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccagaagaggaggtatgatgcaagatatatccaaggggggctaaaggttcttttgcataaagccggcatttcaaagcagtagttgaaagcagtaaaacagttgtagtaattaatccatattaaccaatcactgtccaacgttaca

SEQ ID NO: 75069 - DNA, 652 bp, Oryza sativa
ctttttattttaatcgattgaggcattgggcgatagaattgtgttaggtttatttctagctttgccgtactatcaagaggggtaataactttggtaaagaagtgatcaaaatgacacattatgtcatttgcatgatggcttggtttgatagttttatttatctatctttctgtctagggctggtcagatcggagtgtcctggcaagtttgaccgagccaagctcggtctgaccgggcggcggatgagtccattgcacggcctcggcttcgcgatccatagccaccagagccgacatcggtgttaccaggtcgagacgggtctgactggagctgctagcgttctaactatccgagccacggtggtctgaccaacaagtgttcggccacgcattaaatgcaatcaacggctagttttttagccattgcccatttgccctaaggctggtctgaccgaccaccccttggtggtctaaccgacaggtatccgagggttggggttttgggcccaacggcttgttttggtgggtagggatataaacactccctcaccagcaacaagggttctctcttggcgcattattcactcgcatacaccccttgcattcactctcacaccaatagagctctagttcattcattgtggttgtttgaa

SEQ ID NO: 75070 - DNA, 787 bp, Oryza sativa
  unsure (1)..(787): unsure at all n locations
caaccatctccatctagcaaagagctaaacctagatgggttttgacaaataaaccggctagcggagccaatttaagataactacccgtctcgtgggcaaaacggaaggttttcaggacaaacctacaaagagatgtcacactctcgcagcggcggcagacggtttacgacgcaaaccgacaaagatggacaaactaagagaaaactaaaagcaatatgaaaaaacgattcaattgattgattgtagattggatttttacgatgaanaaanccccccccgccatgtcccttatataggggttggtcttgccctctacaggccctcctccacgtccaactcggggtagaaactaaaggaaacccgaaacatgccttcacgagcaaggaaacctcgaaacccgacgaaacacagtcagacttggacctgccggttagaccggccacacaccgcaggtctgaccggccctcaatcggcggtctgaccgcccaacacacggcggtcagactggcccactcaaagaaaaccggtggacttccaaattttggcaacctttcctattttaatcctaggtgccaaatttgggtgtaaacacatgccccctgcctttttgatgaacaacgtgaatctaaaagcatagaacatgttttggtcttagggcgataatctaattaccgggcatagtacctcctaagcgtcttgccacacactcgggaagtatttcttcaagtatttcccattgattgctcgctgaaaacgctcccttgaagtgtctccaaaaaatatgcgt

SEQ ID NO: 75071 - DNA, 8654 bp, Oryza sativa
cagcacacccatgctgcacaggcccaaccatcctgaacaaccatacccggctgtacagatctatctccaaaccaggaatgtaccattccaaaccaggagctaatcaaattattaccagttatagcatcacttattatggtgagaagtgtgagactaatcatgaaagacattgttagacccgcccataaccgcgggcacggctattcgaatagttttactctggccagaggtgtaccactgtacccacaatacacaactccacaatatgtcaccatatcatcatgtgcccatgctgaacatgtcaccatttgtgtagttgtgacaagatccctcgcataactcaacccaaagcagtgcaccgttcctggatcgtagtcaccccctcaaaaccagaggcatggactcctcagcgacctccgtgggcttatctcctccacttctcagtctggtgctccacaatgagccttgctatacaaagtgtccagccgttgcccattctggcttgtggttggcacggttaatgtttcacaaccgaaactcgtgaaccggtccttaattgtcatgagcacgaccatcaaaaccatgtgctcacaacccaccattatcaagttttagttggcacattaattaattaaccaatcacgattagccattatcatgtccatcattaagtagtagtgaagcattagttatcccaatagtgtgctaatgtttctaagcatggctaagcaattatgtctaatatctagctgaaccaatatataaagctcaactagtcaaattataataacccaaggtatcaaggaatagagtaaacaatgcaaacaggccataacaaaggaataagttcacaccacctggtgacattcgaaaataaatgcacagttgaaataaatagagaatttaaatataggaccaacatgctcaaaggaactgtgtttgggatatgtgtgacttgccttgcaataacgggtcttcaattaatcttcttgaacacttccgatgcacttacgatcattcgaaacgacggaaacgacaagctaacacgcaaaacgggaaaaaagactaataaaaaccaaataaacaatacatataaagtaaacaaacatgtaggtcataattttagatgaattatgagacttgaacggcctcattctgacttcatatgaattaattatgaattttacaagattaattccaattaaagcctattaaagaaaagactatttcaaattaattaaacaatttacaaaagatttttaactgagacaaaatattaaagcaacctccggaaatagattagattatatttggtagatgacatatattaaaaaggaataatatgccactgaaaagagagaacggatttatatcgattttggacggctgagattaatcttgaccgagagttgaccaagatcggatggcttggattgatctggcaagcgagcctcacgagataccgactcaacaagtcaattctacgtgacacgagatcacctaaatgatcaactgaaaccggcgaacggaaccggcggctctgaacggctctaaactaaagaacgactccacacggacgaacgaacaaagcatggggacacctcgttcgaacgaacgagcgaacaactcaacaacggctgcgactaaaccggtgggctagacacgattcacggtaaagccccggtacggtaaacgataggccggtaggaatttagggttgcaccttaggctttgcaagtcagctacgtggcaacggcagcgaacaaaccacaacaacgacaacgcgggatagcggcggctaggtttaagcgacgcacggctgcgacatggtatagcagcaacggcacggcacggcacaacacagcacggcgaccagtggctcggtggttgcagtagcgggacggcaacaacttggcacacacgagcagcagccaaacagcagatagcggcaagcggtaacgcacagcaggagcaacatgattgtggcagggagggcacaacggcggctaggcgactagcgcagcagcgacggcaagcaacaacggcacaaccggtagcgacggtgcacgggctagggcagcagcgcggcgaacaacaacgcaacgggcacggctgcggctgcgacgaagcggcttggcaagcgtggccgatgggttgaaatctaaaccaaggagacaaggatagacgtctcaccgatccaaaacgatcggagagggagggatgatgacaacgttccgatagcaacacacggagacgacaacgctagacaaaccacggattagattatattggattaagaccctagggaaaaacctacaccggcgaacggcatgggagcggcggttgccggcgaaccacggcacaataatgcaaacggagggcaccgggaggaagagcgtgagacgacggtccttaccaacacttacgcgacgacggacggcgacggaagatggccggcgacgagcttcgaagggcggcgaggtactgtccatggtggcgatggctttccggcgacgagagacgacaaccgaggggtggacggtcttcactgtttttggaaggggatcggtggcactgtgcacagcatgggagacagtcggttggagaagaaagatgaagtactgtagcacggggaaggcaaaacagactttcggccgggctgaaagaaaggaagggaaaaaaatgggttgaattcggcccaagactagaaagaatgattttattgcttttccaaataaattaaccaatgagatgatctttcaattgttaaaaatacttccaatgcacaaataagttcggaaattactagtgaatttctgggcgtgacaatctggtaatgcaagaactggtgctccactgagagcttgattcacagcttcaaaggcttgtttctgagcatcactcccagattacttgagttccttttcagcaatgtagtgagaggttttgtcatcacaccatatacttggatgaacttgccgtagtaaccagccaaacccaaaaaatctttgagttgcttcaagtttctaggtacctgccattattgcactactttcaccttttcaagatctattgctactccattggtgccaatgatatggtcgaagtatttcaattcctgttgggcaaaggaacacttgctttctttcacaaaaagctgatgttgttgcaatagagtgagcaccattcttaaatgttttacatggtgttaacaaccaaatttggtaatatcggcatcgggaaagaagtttagatcgaagcggagtccgaggcggagatcgagttcggaaacagagcaggaatcggctggagtccagatcggctatgattaggatcggctggatttgagtcgaactaggtaagctgatgcagccgattccgatagtgcaacttgatgtatgatatcgggttgaattgaggcgcttcaaggtgattgccgcacatggatagagtcctgagaaggcaattgtatctattaattaggatgttttatgtaatttccttagagatacgcattgggcaaaagtctgccgcaaagacttatggtatcttagagtttgttagagatggtagtcgtgtccgttatggacatatcttgtaattctcgggtataaatagacccgagccctatgtaacttttaacacacatattcaatacaatttcagcacatcgccacccttttgctttagttttgtttcgacgagttcttgctttcgagttgagctgcatcggtttcgatcttcaacaagaggtaaaacttgttatgacggcttgtattctcgggattagtgcttccatctttatgatactctaatcttgtttatgtaattcgtcgagttatcatatattttacataatctctggcaatatcgctatctgtcacgcccggaaattcactagtaatttccgaactaatttgtgcataaaatcctcatccaggaatcagccgaggtacacaaactgacaatttaatatacaaatccatcttaataataacgttacatacttacaaaagaaaagaaaacagcagcggaattaacgatctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcaaaagcagcatttaacaaagatttaagaatagtaaaatagtagagtaattaatcatcaattttaatcaacactgaacagcacacccatgctgctcaggcccaaccaaacctgaacaaccaaccccggtcgtacagatcaaacctccaaaccaggaattatccattcaaaaccaggagtcaaattaattaccacattattaccattaatgagtagtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatctccccctcaaaaccagaggcaatggactccccagcgacccccacggacttctcgccgcttcacagtctggtgccccgcaatgaatcaggctatacaaaagataaagccgttgtccacgctggcttgtggttggtacggttaatgtctcacaacagtagctcgcgaaccggtccttaattgccatgagcacaaccatcaaaaccatatgctcacaacccaccttaaccaggttttaattatcaattaattaacaccacacaatttaccatcgtgtgcgaccattaaatataaccataattaataataataataatataatttatatttaacccctttagttagcttatgtttctaagcatggctaagcaaaatacatataacatttagctgaaccaatccaatatataaggttcatgctaatcaaattataacccataggaaaataaagtcatcttcggccattatttaattgggaaaggttcaccacccgatgacattcgaaaataatgcataagttgaaataaaacattagctttaaatgggttcaacatgctcaaagggttgtttgggatctgtgtgacttgccttgagcttccgcaaacacttccgaaccttcctcaacgaaaacgctctcctccagaacgtcggaaactaaagcgaaaaaacaaaattcaacaaaacagtacaaaaacaagcataaacagtacatgtggatatttttaacatgtagatcttgattttagaaaaatttagcaacttgaaccacctgaaacggatctacggttatttagttatgattttcagaagatttaatctattagaaaaacgggaaaaaggaaaaaaccgatgatgacatgatgacatcatcaatggtggccggctaggatggcaagctcgccggagattggatgatcggctgcgaatttggaggacatgtacgcgtagaggacgacgagacgaacccaccggtactcaccctcgagccaaacgacgaccgacgacgaccggcgacgaaggggcggcgacggcggttcggcttacacggggacggcgggctacggcggccggcggcttcggggaaggggcggccgagcttctcctcgctcccacgcacctaaacgcggcggcggcaagcggcgacgacgacggaggtggcggcgctacctcgccggagatggccggcggcaaccggtgagctaggcggcggtggcggcaaggctacgggacacgggagaccacgggacagggggaaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacgatttgctccgattcttggggaacagaatagaggaggataagaggaatatttcccctcaactaattttgcaaacggagctcgggatgtggcggatttaacgaggaagcggtggctgcacagggcacagcacgggcggctcggctctgtccaagcttgaagatgaacagtgccagggaggcaaactagactttcggctgggcttctacttccaaggactgattaaaggagggacacaaagcagacttcgggaaagagaggaaaagggctgcaggctgagaggagactgggccgagagtgagaggacttttcctaattcggcccgaaaaggaaaaggtgaactttaattacttttccaattaaattaatcactgaaatgatctttgaattgttaaaaatacttctaatgctcaaataatttcaagaaaaaaaacctgaaaatacttggacactcaaagtacttaaaaaaattacaatcagaccatttaatgattaatttaatatttaaataattgctgaacttctctttgtatgattaaaattaggaattgagctccgaaaaatccgagaaagttccagagagtataattaaccatggagaatttaataaaaattaaatccatccatgctttatatttaggaaattttatttcccacatttaacttcacttgtaaattaatgaacatttaatataaattctgataataatttattaaataatttataaatcctgaaacgaaaatcagggtgtgacactatctaacttacaatcggctaacatctatcgaatagagcaaccgattaggttagattttgacgttgattcagattatataagatatctaccactctatgaaacttctagcggcttgattgtctagatattgttcttcttttcatacttaatgctgcatcagttgagtttgatctattaagtcgtgtttagaatgtcaatctctagcatgccttctggttgccaattagggtagcatcggagtttcagccgatcttatctaatttaactatatttgctctatatgcttcattgacatgttaaatctgccctttatgtcaaggtattgctgtatctaagtatattaggccttatgtttgatatattatacctgttttaatatcctgatatagagtagtatcggagtattagccgatacatgctagatctatctgatcggctatgctataaacatatatagtcctattattaatatatattttgatctaagtgatttatactgtctcgacatgacgaccgatctatcccaatcacttgattcaagtatatatcgatataagaactatatattggaaatatctatagccgatcgaatagatttagttctttattgtctatttacaactgccgatcgattcacatatgacatcggctcaaagataaatgatatgtcatcggcatctagccgatcggctatcatttatagatttaactgcggtttctttgcttttatttcttgttgattacaggatcaaatcaactggcacgctagcacacccgaatgcgagctttggacctgcactggaattaagcagatctcccaggcctcgtgttttctgtcaacacatggtcatccagggtcttgttgtatgttaatatatcatccacaaatacaagcacaaactttttgacagtattcatgaggccttgaaaggtggctggtgcattggtgagcccgaagggtatcaccctgaactcatacaaactttggtgggttctgcaagctctcttgtgttcatcatgctcattaattagccttatctgatggtacccagaccgcagatcttgtttagtgagcgaatttgcttcagctagttcatccaacaattcatctaccacatgtatgggatacttatttttcacagtgatgtcattgagcccctgtaatctacacagaatctccaagaccatccttctttttaaccaagagtacaggtgatgcaaaaggacttgtactagtgtatataattctctatttcagcattttgcaccacttgctgttctatctcatcctttcggcgtggggaatatctgtatgtcttcttagtgactgtcttagcaaaaggaagtagaggtatgtgaaggtcaaattgccaatttggaggtaactctgtacgttcctggaatctgtcttgaaactcccttatcacttgttccactgattatattaaatcagaaattcagatttgctttcttttaggctacataaataaaatgtgaacgtttcatgttcccaggaataacggataaaaccaatctttcaactttaaccgcatccttgagtagcaaaaatgttgtatcctctatttttgtgcaaataagctttctatgccagaagtaaaataagaatggtttgttataataagggagattgaaccaaaagaggcaaagaattagaaccagtgcacgctcttgcctagcacccgtctcgccagcaggggcggagctagaataaaatgaagggggttccacttgcttgctttactctggtttgaatcaaatttagcttgggtgcctaagtttaaactgatgggggtat

SEQ ID NO: 75072 - DNA, 3074 bp, Oryza sativa
  unsure (1)..(3074): unsure at all n locations
caaggcctacgatgattcagaccgaagtgccaaccggaccctgggtcccagctcgtcccaagccaacccaggccaaccattccacatttttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagatatgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtatccaaatgatatgagaattcccaacgtctaaagttgtaaaaccacctaatattgcctaattaatcagcgaagcatctacctaaattcatactagtggaaccatgaatagagtacccactagttggggttttgtttatcctagggtgaacaaggtaataataacaatagcaataataatgccttaacaaaggtaaataggcatggctaaataaaacagtgataacgcgggaatttaaataaagcgataatgcattaatttaaataaaaataattttataaactgggattcaatatgctcaaggatgatgtgacttgccttgctcagagggaacggccttccgaaccttcggcgacgaccacgaaccacgcttcgggaacctccgggacgacgaaagttacgcgaagcacacaagcaaagctacaagcctacaaagaagcaataacaatacataaaaagaaagcacagggttctttaggttataacaaacattaggagacttgaacgggtcgattcggagttcgtatgaccaagatatgatcatccgaagtttaatgctgttatatggggatttgcggattattataattaagctttgccactataaaatatgtgtaagcgctagcctggaaaagacaggaaggctgcgccgtagacatgcagacctccactatttgctttatctnatnataaccccactctaaggaccgcggtagaccgggtacacagagacggtccacgggtcgatggaagtggaccccgtgtgtcaaccgaggcgagtggccgacaaacggactccactagacaccacacggcctgcacacgtggaaaccacgcggctaccgagcggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgtggggacgacaacgacgaacgggcgcggcggagacagctcggggacgacggaggcgaaccgcgagggaacgacttcggcggcgatccttggacgaaggcgagacgcggctggcacaaggcttgacgacgcggagctgaggacgaagacgaggacggggctgccgcggcttgcttgactgatgcggacgacggatgagaacggctcgacggagggacgaacgccacgacgaccaggaatgacgagaggacgacgacgacgacgaccggggccggcgaggaggcgacgagggcagccggcagcggctgcacgaatgcgaggatggcgtggaacacgccgcagcgatgacgatgacggaggcggcgccgcgagacgacgagccggcgaggatgaacgggcggccgaagggacgtcggcgacgatgaggatggagaggccagcacgggcgacggtgttccggcgaaacagaggagcagctggaggagaggacaacgcggcgacgtcgatcgggtccgcgacgtacaggagccggccggaggcggggaggtactggacgccgacgtggaggccactccggcgagcttcgagcgaggaggaggtgatgccggggatgagggcggcgtcgcggagccgagggaggtggtggcgacgtcggccggcgcacgggaaacgcgacagtggcggccggaggtggaacagtggcggcaacgccactgttttgccggcgaggacgcgtctccggtgctttcccgcgaaacggagggctgaccgagggagaggaggtggctgcgaggccgagggagaagacggcgcggccggacggcgctccggcgaggagggagaggcggctggaggcggccggcgcggaggaaagagaagggcgatggcgggaacgcgcctccggcggtcaccgtgcgaaacggagggcaggccggggtggaggaggtggcggcgacgctggaggaggcgacggcgcgaccggccggtgcacggtcgaggcggcacaggcggctggaggcggccggcggcgtgggagagagaggagggcggcggggagagggctagggaccacggggaggctcgggatggggttaaaacgatagaacggagtgaggggatcccattttatagggtgggggcgggagccgggctcgggagagggcagaacggccacgggaataacggccgacggccatggaaagcggccggacttggcgcgtccgttcccggggattgaaggcacaaatcaagggggaatttgggggcaattgaagaggattcaatggggattaaaaccccccaattaattttggaattggccaattgaatcaagcgg

SEQ ID NO: 75073 - DNA, 4366 bp, Oryza sativa
gacctgcaggcatgcaagcttgccccatgtgctgcacaatgggtggacctcatgttggagccatggacaaagtccagaacgttagaaagatatactcctatctagaaaaaaaaaacacttttgtactttcttttttcttggtcctagacgtatggatgatcttatgctgccgccatatctatataccttgcccatatgataggagcactcgagcaatatgcatgtctcacttaaataattagggcactaaactatgttgtttaacttaagaggggtcaataaacctatcataatattttaagggactctgtttggttagttgtctcactttatcacgccacacttgagttatgtttagatatgtgtttgcttcttatcacaattgagtcatgccactttttttagccttagaaaccacatgtcttttaaatttaaagccaaccatatcacaattgtgcctatctatttcttagccacacttttggcttaagttataatttgtcaaagtttagttctcaccaatcaccatccaagcttagtttggctccagttctttcagcttactggtagattactaataaatatattcaggctagtttaatctccattatgaaaagaacaccaaatctacttaggaccatgagttcctactattagaagaacaaatatgcatacctatctgttatagcactttgacttgtttgatcagagtaaaagggaaaatggacggtggtgatcatctgggtgtgtatcgagtattgtgccccactagcaagtgggcctccactacccctgtatatgtgaaaggagaaggcccactttctgtcatggaaagagaggggccacaagctgtcaaaacagagatggcccgttggccattggtggacagtgcctgacaaaacaagctgcaaagcctgtttgaactttgaagtgaggtgtgaggaaaaaaatgctgggtcccaaggcacagcaactgggatacgatacccagatgtgattgtgttgtctccaaaattcatagggacagtactccactccgttctaaaatatactccctccgtcctaaaaaaagacaaaccctggtttccgtgtccattatttgaccgtccgtcttatttgaaaaaaatatgaaaaaaattaaaaagacaagtcacgcataaaatattaatcatgttttatcatctaacaacaatgaaaatacgaattataaaaaatttcatataagacggacagtcaaagttggacacggaaacccagggtttgccttttttgggacggagggagtaaatgattttgagatgtgacatattctagtattatatctgtccagattcattataccaggatacgtcacattcacccaaaatcctttatattttagaaaggagagagtagcaacaatgcggcaaaagcaatatatgttaccatcctaatattatttcagagtacctcgacactataaaaagaaatgataaattaatattataaaatatccggtgattgcaatttcagaacaaaatttctaaatttttggtaatttgaccaccaacaggcaaacacaatatcgacagaaattatcggtttttccatattttttgaaatttgatcaaagtttattcaaaaatcaaaattttttaaattttcaaataattttggtcaaaagttaaagtagcaaaattctcgaaatttcggttgccacttaaattgtaaaattttggctgaaaatgaaagtgtaaaccctggatatatcatggtgtcactttctaggattagcaaaactcaagtgtgaatcatagtaggtacgatatagtataggtggattggcatattgtacagtactggcgttgagcttgaggagagggaggagagtagacagaattcccagctataccactgtcgagataaaagcatagatgaacagggagagagaggtaaagattgcctatggaaatgacaatgacaatgtcgccgagatccatggcaagacaaccctccgcgcgtggctatcatctctcacggcggttgaaggttgaggtgattgtccttggcgatctaaatgcctgttatctcccatagttctccttgcccgcccactcttgtcgtgccgctctcgcttggcttgttcaattcggtgctcggagatagcgtcctcacttgcaattgcttaccttacctatgaagctcgaggtcatcagtgtggaggagctcgagctggagcatgagatcgaggccatggcgactagatctagctaggaaaaaaaaactcaagctcaagaggcagtgcagtggctggtacaatgtggatgaatcatgaacccagttggaagcgccgagatcgacacacaagcttgcctggcaacgcttgatgcgggaaatagagagggtggcatagagttatttgctgatgaccagaacgatggagggagggaacctaatggggaattgatggtattttattttaatgcaataatgtgaaatgttagggctcaataatatagccatgtaccatgtacatgcttaatctatctgtgagagagctgcaaagatgatttaaacaaaattggagcgattggaattaattatagctacttcacattttaatcttataatttcaagataacagtcaacataggggttaaacaaaaacaaatactccatttcacttcatgttaggctttaattttgcggtcaccgacgaagattctttttcacgatgaaaatgccatcgttgagtgttaccaataggtgagaaacatggcatgatcatcgaggaaaaccaacttgttggtgggtcatggctcatgtgacagatgttgctagaagaagaggggctcctttcacattttagacaacaactttatgcgaacaatccgcataaatgtgatttatcaaaataaacagaaattgcaagattatttcacaggtgagatagtgtcctacaaagaattagagatatcttaaaatgcatcttataacctatatacatacaattaattgccccgaaaaaaataatttgtgaaactatataaaactattttggacaggtagagtaaactttactccactatacatacaaaacattgatttaggttgaaatatacgaatagacaacaaagagttttccaagaaactttttaagccacccgctacttgtataattcgaaatgatttcaacgttgggggtgtgtttcagaattttagagattagtgaactgagttgcatattggagtattaagagcccactaaattttggtatctggtgaataaaactttatagtcttgtaaaatgattttatttagttttgaacataatttgttttcggcaattaggcaaaatttgagttgcaaattttgtacataattctcttcccatgccacaataatcaatggtgcaatgcaacttaaatgccacgcctagcaaagtggtgtaactcaaaggttttgctttagaactaaggttttgcagagtaattttaagattatcaaaggaggtttaaataaaaaattggtacctcgcaaaaaataatgccacgcatgcctcacttctcttaggttttattgccatcacaacgaaatgaaaatttcacaattaataatttataaccacactggttcgcaatgaatttttagtatgcagagataatattttaccattaaaactattggttataaatagttcatagtgaaatgggcatatttatttacgagtgaaatacatgatcggttcttaaactttgataggccaaatgctacttaggtatgtgaaatcttgcagttcatacgtttagatatgtaatcatggcttaattatcaccttaggttcaaagtgtgtttgacagatctcatgaacccgacttggctgtccacgctttgcatttggccccctcaccgtgacaaaaataatgcatatagcccctcattcctaccgtggacatccaaatatccattcagggtggtcgtccctccttccactccaattcaccacttcgacaatatttttgtcacactgaatttcaaaaggggttgaatgtaaaattttggcccatatggacagccacgtcggtgtccgatcgagattggtgaaatgtgacttggacttgttatgataaattaaactactattataggtctaaatgtgtgatatacaacatcacatatctaagtgatatatgatccaagtttaaataccaaccatgtatttcaccctttatttatttcaaacaatttactaattaaaaagtcaaacagtgtttcaacctaggtcacatacctattcaaaaagctgaaaacacgacccgaaacaatgtccagtctgaagttcaagacttttcaaggttttgtttcataaaagaccacagttgtaaa

SEQ ID NO: 75074 - DNA, 22334 bp, Oryza sativa
ctaagctaattataatcgccccactaatcacccctactaatcaaaaccaagccttaatttatttatgtaatgactagctgctgcttacgtaggcgtaattaagcttagcactaatgacacgattaagccgttggtggcgatcgaatggtggcgcgcatgtgccgcccaggaggcacgggagctagcatgcaccttcacccacgacgacggcggcgagtcggcgacgccgctacatgcagaaggggatcatgtggtagggcagcgccggggacaccagcggcgcgtgcccgccgccgccgctgcagttgctctccggcgaggacgacgtggccgacgccgaggagaaggagttgttgtcggcgtcggcggccttggtcgggttgaacggcgggatgtcggccggcgcgggcggcggcgggtggcgccaccgggggagcgggccggcgaggaggagtgtctggagcagcggccccgccgacacaacggcctccactagccggcccttctccggcagccgccgcgccagcgccatttccagtccggcttagtcgcggggggtttccggaagcgccgccagctcgtccgccacggccgggacggcgacgacgtgcgcggcggggaggctgctgacctgcggcgtcggcgtcggcggcgcggcgggctggctctggtggtgcagcaggagcaggagggagtggcagtgccgccggagctcgtcgcgctcggcggcggcggacgcgacgagcgcggcgaggcgcgccgcctcggactccatccgccggagctccgcctggtgcgccgcgcgcgccgcgtccagctcggccagcgcccggagcagcgcctgccggagctccaacgccgtggagaaggccacctggtcgccggcgccggcgacgtggtcgaacggcgcgagctgtgggtcccacgtgtaagcgagggtgggctgctggaggtggtgaagaagagggtggccttccatggtcgatcttgttgggtttttggcctttttttgtggttgggtttagaagaaagatggaggaaattaaagagattgatgtgttgttgatatgatatgagtgtgaactgtgtgagtgtgtgtggatcttggttgtgttgtgtggtagggtatatatagaggatctttttctgggtttcttattgatttctttcttggatgctggtggttttattggttcatgttgtgattagaacaaagtgttgtggggtatgtgtaattatcagatatttttgtggtgctctcacgtttcatacaccataaataagtaaacaaattgttatttggaaatatggttgttcattaggcaagtactagtgaaataatctcacatgctatattataaattttggttagaatataaaaataattttggtgaaaaatattatctattactagtaagtttcagatgtagtataatccaaggtcaaatattggagaatatcacaaattattttccaatttgatattttaatgtatatattcagacaaattaaagaaaacatctttgttttttacttacataatgaaataatcttgaattaagtctggacatatgaatccatttacttggtgtctatttagatattagattcaaatcacaatctttttgccaaaaaaaaatcaaaatacaaccagcaagaaaatcctatttatgacagatagttttggaagggtaattactttgtccattggttctttccttttcatgcaacaatttattggttggcaaggacacaatatctttttagcaaacaacggagggcggaagagtatcgaagtagttgggccacccttcaatagtatttgttatgatgttttttaaatagctaaactgtatgttttatgcaagaaaatatactgttttaaaaatttaaagaaacttatttttaaagtttttaataacaaatactcgattagttatatgctaatcatgcttattgttttacgtgggactaatcagcacggccataactcaaagtggaaattctttgggtgaaatagaagagacgacattggtcaggttttgtgaagggacgagaaaagcggctccaattttcagtccctcgaagttggactattcattttaataatcaataggccacataatcccatatatttttcgtagacactttacgccatttcctcaccatgtatacttttatatattttttagtaatttttgctgctgatacacaaaattgcaaagtgggtataatttaatacacgaccttataaaatgttcattcttgtacataaacgtacttgtgttatccatgcgaatcaagaccaacacgatatatcataaacttgtgttatccatacgaatcaaggaccaacacagtatttcatagctaattttgcagggttctaactagaatgttacataggaacatacgtgaggaggatggcacgcagtggcggagacaaatttctcaagcctagggctcaattaattagttttcatatgcttgtgtttcctcttctaattttttaatttttggagtgttagttcaatggagatttagggctaggagtagggctctagctcatagctaccctactcatagttccacccccgatggcatgtatatgcctacatgccatcctcctcaggtatgtgcgtatgtaacattctagctagttagaacctaatgtatatgtatatgcctacgtgccatcctcctcatgtatgtgcctacataacattctagtcagacccctacaaaattagccatgatatatcgtttttatcttgatccggcaaccgcgagcttctctcccaagccgcatgtctctcctcctcaagtcgtgccggatctggtcacatgtccaaatggtggatctctagatctagtgatgactgatgtggccacaatggttacgatgatggcgctagactcttgaattttgtggagttttgttagggatcttgtatttttggaattctttttggaacttctttttttttggcaaaaaatcttttgaagttgataatcaaaacatactccattttcccaaagacattgtttttgaaagtcaaaaacatatgaagaaagaggttacaaaactattatgcccactaaatgcagagaaaaaataatgagggggagaagaagagaggaagggagtaataatgtttggatagctaaaatgagaagaaaataatgaagtggtattaagaggtccagtggaccccatagctagacaagtctgaaagattaaaaaaaaacactctttttggacgaagggagaacctgcctatgagccgcttgcgaaaatcaattttcgcatgccgtagtacgcccgtacatgaaaatcatgaattttcacatacgcatgcatccaggaaggtggctccaccacctgtgaaaaatgagttttagctgtacgtgagggaagttttagctgtatgtgaaaattgtttcggtagtagttaattccatttttcaaggaggtttaccatctgactttggtgatatgtgtcttagtttacttgttttgatatcactaatactactggttgggaaccccttatatttgccaatttcctacatggtaccaattttgatgaacttttacccattattataggtgctagttatatggatagaacgacacctatgatattcgaaaataataaaaaaacaattgtattataggttggatctaattcctaaccccatttgcaatttccccatccacattacagatcaacaagaacataagagcatatgtacacatcaacaagaaagaaggcacatcacagaccaagtagacaagaataagtacattacagataagaacaattcaccgatatatgttccaccatgtccaaccattacatgttcaatattttggactcacggtccaaatggattagccaccgccatcatcgattcctcgagccaccgccgctgctatcatctccttctaggccttgagcacgtgcgcgtttaggtcagatgtggctagatctagtgagccccgacttagaagagcctagatcgtgtggccccccaacctccatgcagccagatccgacggttgaatctgatgcttctgggaatggcatggaggagagggcgtcaccaaggagaggaggaggaggatgaggcaaacggagaggtaggaggaggggcgacgaacggggagggaggaggaggcaaggcgtgggcggcggacggagtgacggcaaagttgtgtgagagagagaggaggtgggagagagagagatagagatagagatagagatagagaggaggaggaggagaggataagacacacttctctcctcactaaaaatatattgctcccaacctactggctcggctctactagatttttatggtaccagtacctataatatattctaagtgtcggttttttaattaatcaatacatatagtattggtatcggtttttttctctagaacaggcatctatagtgctcaaaagtgttgattctatatttttcatcgcagggaggtgagaaacggttcataggtaccggttttaaataaaccggtacctatgagtcactagtgttggttgtcttcaaaaatcggtatgcactttccctttttcatatgagccatctaaaatatcatagttgtgaaaatcaatatattttgatgttctggaataaatgatttttaaaaaataaaatacatatttgcgccaacctgtttgaagtaaacaaacatgagttcgcattgccttctgaggacggtatagttaatatatactacttgcttgtgttgctcttctttccttagatcatagttaattaacaacgatagcaacttgtttttataatacctgaatgttgctcgtaatcgtcgatcgtacagcggaaagtttgacaaaatgaacttgtataatgtcataggtgtacggtgcttactcatatataagaactaagatatgaatgatgaactcatcatcagctatatatttactatataatgtatagtacgtaaaagtctttgttcaagtatactgtaaattgtccacccggtttaagcttttgatttgaactgattggttcatttgaatctatataataccagaactagtggagcagagtataactgtttgtttacacgataaaaacatataacccccttttttttaacctaaaggactgttaattacaagtgaattgctggtccttctgattaaacttttgtgtttgcatataactcaatatggacttttgcacatggttgctgcttgtcaccctcagacactgatctcatctatgtggtgatgaccagtcatctgccgaagcttctcatgataattaacaactaaaagtatgcaaatgaactcactctgacctgtcacttagcttgagccatccaaatcacaagtgaagtcaacaacggaatagagacctgttgcaccagaaacatctaattcagcatgtttcatatttactgaagacgtatgaaaaacggtagactgcagtataatccttttatatatcctttgagagcgtttaattatctatatgtgcaaatttgcttcagttagtttaattagttcaacgagcgtaagcttgatgttacttgataattaaccaatacaccatttggcatgctatttgagttgttgattaagctcatgaggcttgaaactaggttcaaaaccaatatgcttgtttgtgacttgtgagcacacacatgatacatatatatgtgcaaattactaaagagaacagagttgtccaatttactgtgatttgtatgacaacattgctttcatttcaccttttctttttttcctttttgtgcatgagtcctttgttttgcccaacaagggaatccaagataggaactaccataccatcactcaaagccctagccaataatgcatcttggtcctaggttctgccttctgtccctatctctccctaatcatcatcactgcatggcaagtcatctttcattcttgcccaactttagcttgcataaataaatatatactgtatctacaaaaaaaaatagttgtttttacctgtttggtatctagggaaggcagagctttgcaagtggctcaaatgtgaactttgaaacctgtagcaactagaaaggggctatccctgggcatgtttccattgattacatcctcatatcattttcacaggtaccagcttgacagagaaaaagatatgccaaactaaagctgcattcatgtcaccctgcatagtagtatagtacaggccacttacacacacagatattatacagtctctgactagaagaatgtccttacctgcatgtgtagttgtgagttggtagcttgcaagggtacttgtcatgctgagcttcagatgtccattggcacatgcatgttgacactaaagtccccttgtctaacatggacatggtcagattatgtagatcctagagcttcaaccttggaaaaatggtggtggttttgttgacaatatagcgcatccattcggtttatttcacgctttcgtagctgtttatgttgtgcttatttagcagggcaaagaaaatttctgctagggccctggactcatgtgagactcgttcagaactcagttgatcaggtcagcatgatcatgttgtgcacttgacaatgaccataatctaacagcttacaaacctatgactcatcactgacatgtggtcatcatcagtaaattatttcgttgttaatagagattatttgtgctgtagttaagcttctgttctgaatcagataaagatagaggcagtagcagaaatagcatgcttaaagattgcaggttgtgtgctcacactggaattcctacgacatgagacagcaaagcaccattgcaaatcctgcaaaattcatgcaagaatccaaaacatttgttaggtacaactgacctaaaagaggctggaaggtgtgcaccaccatcatccatccatacagcatttttccatctggacagctgtttcaacatgtattctagcattgctatacatctagcagcagtgtgcttgtgtactcccattagagaatcatgaaaggactagtttttgtaatttagtgttcatgaagcatataagaacatccatgctaattagcttgtacctccactaacattataatcaccaaaatgcataaaccatcttcctcagatcatttaccatgtgtttgttggattatcttgatgattcaactgcaatcaagctaaaaaatgcaagcatctttactgtgtttctcaaaaaaaaaaaatgcaagcatattccactcctatactaggtgcaatagctagccagctttaatattagaggagtccagttaataatcaagctgctatatatgaacatgtgtaaaagtatttatacgtggcatatctttgtgctgcatgcaattgcaagcttactgatgaactcttcacaatcttttgtttctaatcacccagctcatcccagcaggatatgatcgatgcagctccctcttaatttaatttctcacgtcttgttcatcaggaaaaagaaaaaggagagtgcaagaaaagtgaggcctccttctgcatgatccaagtacgtattccccatctcaccagtatgatggataatgacaccttggatccccattattacttggaataaattagggttcttcctaccatgatgtacatgcattctagaggtagaccccttgacttttgagaggattagtgcgtgttgatgtgattaatttgtgccaaatttagaacagtaggaggatccaacttgagtaatataaaggccgttgtagcaaaataattagagggtcgatctcgagctaaatttaaaattatcagagtattggaccaaagctgcaggaatgctgcacctgagcccaatcaataatgcatcatgaagataaaaaatcaaccaagatgcatgaaatgttaggtttaagaaagaatcgtattattacatatataaataaattaatggtaagggagtaggttcagttgtcaccactgatagggttgctttagaaaaaaaaatactagaggataaattaattgctgcaagcatacatataattgtttgtgagagaaatggacgtagaaaggtggataaactgtttaattagcactagagctaggagaaaaaattgtcagaaagaagagcacacaaatcattagatctgttatttttgttttaagtgaatatggacgcacataaatcacacccacactagcagccagctattagcctgtccatgtcattttagtctgatatgtaagagacagaaattggaaagagactgaagtgggcacttaatcaagcatcgacgtgcatatgtgcctaggcttcttctggatgatgaactagtagtagtaagacagcaggggttcaccaaattagatctccgatcagtgtatcatcaaataagattgttggaccatgatgaacataaaactgccttttaaactcaccagggtcattattgtagatcgtaaagggcctttcccaccccaaaagctagccattgaggtgaggggctctcccacatgtaacttaggtccttagattctttgtccttctacaactaatgtgggactattcaacaattttgaattcaaggtgatgccttttgggctaaagaatgccgtagctatatacattcgagggttaataaatatcatttttgctcacttgatcaggaattgtgtgctagtctctgtggatgatattttgttctatagcaagaacttggaggagcatctgagccatctaagggaagtgttcaaaatagtagcacatcatcagctttttgtcaaagaaagtaaatggtcctttgctcagcagcatcggcatgtgattggaacaacagggggtggcccctgatcctaacaaggttctagcggtaaaggattggccgatgactagaaatctcaggcaacttgtaaggtattatagaaagttcattaaaaaaacttcatgtaaattaaaaaagttcaacaaaaactcatcgttttgcttatgcaacactactcggttggtccattgaaatcgaaaacaatccataagcagcaacagctgcaggaataagtccactttaactccttcaatatagctcaaatctaactcgtaaccctaaaccacaataccagatattttgacctctcaactattaaaaccggtgtaatttgattctctaagcggttttagatctaagcggttttagagtacggttttgctgacatggggctttgacccagttcaacaggctgactcagcatgtgggacccacatcttaaaaaaagaagtcaaattacatcgattttaatagttggggggtctaaatatccagtattgcgattcagggatatacatattaaagatgagctatattttgagggagccaaagtggacttattccacagcagcacaagggccaactcatgggccgttttttctggcccttacactctgtgctgcctctgcctgtaccaatcctctttttgattttcttttaacgagttgtctttttcgacgcacagtcgtattaatacaccaactgaaatacgagtacaatttctgtacaatacatacgtacatacatacacgtattctttagaagtacatacatatacgaagcctttcagtttcaggtgggacccaccccgcacaccacgacaccgtctcgatccccccctcctctcctcctctcgccggcgacccctccgccgcttccttcgccggaatcgatcgatcccatcctgcccaagccgccgccgatttcacctcaccttggtcgtaagtactactatctctgatccggtcccgatccagatcggaattcttccgaccccctaccctaatcgcacgcgatttcttgatttcttcctctctgatcccaagctaggaggtcgccatggcggggaggcccagcatcccgaccaacagctctgcgctcatcgccatcatcgccgacgaggtagttacagccaccccccacctcctcccctttccgccttgctctttgcctttgcttggcttggctgattgtgccgcctctaccgctgctcttttgctacatctagtagttaccggtgttctaacatgctcttgttgattgaggataaatacccaattatgtcataagcctactgatgattcagcgaattgtgttctaacatgctcttgttatttgcttttattggttcgtttttatctttccgcgatgtttgctttcttatttgaactacactcatgtggagtgctagtttgtaataatgggctgtagctccacttgagcaaaggccgggatgttatattccattatctaaaaaaatgctcttgttgattcaggatacatacccaattttgttaagtctactgatgatccagcgaattgtagtaatgcctgagtccggctcagtgtgttttcttttacctgtgtacctgactgtcatttttcatccatcccacccataccaatataaaataaaagagagtataatacctccactttatcaaatccaatcaaatattcatctcttgatttactcccaatgtatccactacttttacaaactctgatgtaatggttgcttaaaaatgaacttattttgggacaaacgggggagagacaaaaatgaccttatcatgggatggaaggagtaattaggtagctacaaaccagtgccttctgttacatgtttgtgatgaggaaaactgttttcaacatcagatttgcgcataatcattctgtggtttctaaactctttgccaaatatgaatttacggcttgtcaaattgctcatgattaataattttggtggcatttgctagcttattgaatttgagtaacatgtaaggtttcaagcaggaaacaaatataaaaatgtaatgctattacatactgtttggtaagagcttgctgatgccaaatacgaggaatgaaagttagctgatgctcaagaaaaattacatcaaggacccttcgcaatttcattctcgcttgcttaaaatatactcctgatgggttaagtcaaggtagcaaacagtagtagctaaccagcataatttgatgagaactggatgactaaactgaatcctcttaattaacaacgggcataaaacctcatactatctttatcaatataaaacatatgtaactctctctaaatgtttccaggttccccagtaatttagccatgattggagtatctgacaggagtgttttgtttcctgccctgtgtttgcaggacacggtgactgggtttttgttggctggagttggcaatgttgatctgaggaaaaagacaaattatcttattgttgataacagtaataactttcacttgctaatatgcttaatttctctatcaatatcttgctgtttgttttgtcctgatttctgcctcttacaatagggacattgcatgatatcctgttgatcatctcatgtgcacaagtcatattatctttacccatttacatgttccattacctgactgccaaatcctttcttctaacttgatagctacaaatcagtgccttcttcatgataagacctaatttgttgagttctgccaatttttttactataatgctgcatatgctcattgaatcccaaggcttattttggtagggggtgttcaatcttcttgaatggttgtattaatcttgataatttcctgcttaatagagttattgacatgttccgtatttccacttggtagctggcatattatttgaaataaaataagaaagtggatctcacccagtcacatgtcagagacaattaatttcttcattattgtaggacgtgaatttcatccctgagcttatggtttcatctttatgttacccttatgcattttattatgttagcagacttcctaatgctttagtagtccatagacttcacacggctgaattttactctgacatgttacagaaacaacagtcaaacaaattgaagatgcgtttaaggagttcactacaagggaggacattgcaattgtactcatcagtcaatatgtaagtagcttgattgtatacatcaggttatttctttgtttatataatgaagtgataactgatcagcttgtcactaagtatcctggcctcagaaagtcacaatgattggaaacaaaactattcaattctaaattaagtcagcttgtcactaagtttcctggcctcagaaagttagtgactggaaacaaaactgtttcaattctaaactatttccgcttgtcactaagtctcctggccatagtcagccttgtttctttggagcgctctcctgagttttcaaaatggcatgtcccaggagcatatgatcaatgaatttcaatacaaaaacccatcaaaatgatgtgatttttttttaattcttatgtgatttatctaccaatttactggcctaaggttcctgcagctttgcattatacatttataatagctgaaatcgttaacaaattatgtgcagtctaaaatggttcttcgtgttcgacacaatcacacaacctgatggttttctatttttcatttggcaggttgcaaacatgattagatttcttgtggatagctacaacagaccggttcctgctatattggagattccatcgaaggatcatccttatgacccagcacacgattctgtcctttctcgcgtgaagtacctattttccgctgaatcagtggcgtcagataggcgatgagaactggttatgtccatgcaacatgggagagctactcggagcatttaccctttgaaattgttattcattttgtgcctattgtaaacactattttgtttcaataatgagatgtcgaccaaccagttgaattacagcaaaaataaagacgacgttcatgttgtgttttcatgtttgtgaatctgttcggtgcttctgtgattagtttggtgggctctgttttcaagtttgggttgacattaccacggtaaatataatcctgagtgacaaactgtaatcaattttggcaatcgcttgcaatcagataaatgtgcataatctagcataatctgaaggcctccataaagaaaagaggtgtttcaatttatgagttttgttaccacaagtccaagtgtttttcagatgatgagaagtccctggaggtgcaattgatgcaagtaaaacgtacagaaaaccaaagattcatgccaagtaaaaatataagaaaaaaaatcatccaatgataagaaaaaaaaaaccaaagattctcacaactcgatatgatccatgacaagccggatgacagtaaggaaagtctccgctacgaccgactagtgttataaaaacaagttaataaaaattgcacgtcgcaaactggagtcaacgattatgcaatttttcattaattatggttggaggtttaaaaatagaatttaataagtttgttttattttttttctattggtgttagtagtggtgtgtgcctttatcgatttggatgcgttttttatgacttgtttgaggtgcgattgtgtttggatcaaattttgtaataatggtcgtacctctgtgagcaaaggctatgattctattacattatctaaaaaaactatgattgaaaaactacttttaagtactattctcttcattccttaattttttgaaaaattaaaatttaaacattttgactaactgttaaacagaaagaaataatattttgacaaactgttaaacagaaagaaaatatgtgttgtgaaagggcatgtagcctagtggttacaagagactcagtagcacttgatgttttggttcgactccccatgggagtaaattttttaggatttaatggcgttgagatttcagtgataggcaacgtaccccgtatattagttactcttccgcatatttatatatcatcaaactagaagttaattttttcctaatataatgtcatttatattacatcctctttccataattttttataaaatcaaactagaagtgagaagctgaaaaatctattttttttaattctcatcagctgagcatccatcatttgtttatcagaatctcgagcttcccaaacaaaacgtagatgcacacaaattaattgctcatgcaacaatgttctcaacctggcttagcagtggatcgagcgttattacatattgtgtaatggatcgaatcgccccggccgatcacgctgtcaattgttcagttgtcacgttgatctagcgctggcctcgctctcctcgtggcaagttggcttcagtgcttgcgccttgggccatgaccaaacaaacattaaaaagaaccaatcctacttcttctattttaaaataaaccaatcccatcctagaatatgacatatcataatacaataaatatccatattcatggtactagtacgaggttgacttattttaggatggagagagtacgtacatacgtccgatatttggtacggcattggacactacaatccgtcgtactctgaagtctgaaccctgaaacggattgctgatcgagctgtagaggcactagagctggcaactaacccaatttggggtctatttggagagtttctagccgctgtagtttttttcagaatcaaaagttgtcccaaacggctcagattgtcatatagattatgagaatatgtagctatagaattcaaaaaataaattagaagctaaaagcttgaatttagaaacatcttctttaaattcttaattagaagctggcaaccaactagcagattcttatattattaagcttcctaaatagagccttggtttccattcgtggtccccattgtaacagtttgacatactcgaatgctcaactcatggccagcacaaggtcaaacctccgaagaacatacctctcgagtactatcacacatgcatatggtctggactagggacgaccataccagcattattgtttcaggacagatggagtacttcgtgtaatcccatgataccatccttattgtttcaggaggaactgacttgattgtttgctgcagtatccgtggtaagttaatgcacaataatgtcagctactgtggtccgagaacggatctacagccactgcttaagttataatcacattgccaactgtcctagtttaatactactaccttcgtttttttaaatagatgacattgttgattttttattatatgtttgacataattttatcactgatttgcaaatttttttaataagacaaatagtcgttcaaaattcaacggtgttatctattaaaaaacggagggactatcatggctcagttggagaggcgggagccggagctagcaattacccgaagcatgctattacctaggtaatagcggcatccaggggcgcgccataccgtcgcataaatgggcgcagcccccgcccctgtctcccttgattttacccatggctcaagctgcttggttgctttcctgacaacatctaccaagaacacatgtctttatggccacactctgcctatggctcgaacaacaactggagtattgctttaatagtattgtacaccttgtaccgtcaacattaatttttgtctagcactttggataacaaatataagctttgttcataatgcaaaccacatattatatgtagattttgtggtctattaactttagtgcttagccatctatgatcaccttaatgcagaaaattaaggtaactaatcgtaatttgacgccatggatatcatagtggaagcagtcatagcagtcgagctaacgaaatcactggcttgatcccgaagggttcgttggtgatgagcagcggggtagcgatagccttctggtcaccacttacactgccctagcatagccgcatgttttccctccaatacctcagtgatcgagtagagttagggttttcggggagaatgaatcgtgaaccagtatcccgtttcatggctggactcccctttttatctagcgccgtgggagatcgtgggcaatccaaataaaaggaagttattggcgcttccgatcattgcatgttttaatgaaggaaataatcgtgattcaatcgggttaatcacgcacgtcaacgggtgggactggttatgcgtgactctatctggtttccttgccgagagataaaaaatccccaacattataaaaataaacaaattctaattcgatattatttaatatataatttgattcttattttaacacttactattgggcatcttgtatctagggtggaggccactagtggtcgtcatcactaccgcgaaggttgattccatacccctgattgataaattgggagggagaatgccgtgctggaaacgatgtttctttagttcaacgggatgaaacactctagttaagtctgtacatttggcaatgcccatttaccatttaacagttttgcatactttgaaacaggtattcaaagaatagactggtttaggagagcgttcctgtaggaaggggatgaaccagacaatgtgagagagggtagcagtcgagtaaattggtaaacagtatgccatcctaaatgtttggggtgtttgggtattcttgaatcttgatctctagaaatttgcaagagccgttaggattcgatggctctagttcagctagaaagatgacattctgccttgggtcggcctggacttatcttgcactatggtggacaaacaactcacaactctttcaacatgcccttgaaattacccttggtgatggcgccaaaactagtttttggaatgacaattggttgaacaatacatgcccgaagacaccacccatttcaaaacttacaaaaaaaaggaaagaacaggagtgttcacaatgaactttcctaaaacaactggatcttttccttctgacaaatttcctcaattgaagaactagttcatctcggatatttgatgcaaggcatccagttgtcgacgaccatccaaaatgacataacctggaaattcaatgttcctgttgcttattcctcatcaagtgcctacaatctccattttttgggttcaatgccaaataaatctttcattcatatttgaaagaccaactgaaccaaagcatcttttttgattttctaaccctgcataaaaatctctcatagtcgaaaacctcattggccatgtaattggacccgcagcctctacacccaatccttcgaagctttgaaaatggattttcaatcagacttggattttcaaagcttcatgtgaagtcatgaatcctctacacagagcctcctaatcgggttttcatatatgtctctgctatcactatatctcattttatcttttcattgaacatgtgtatgtctaaatataaatcttctcagatatgtgtttacgtaatcaacagaattagccatatagtgtcattttggccttggtccacacgcacaggacaagttcatgcactaaaacgagcattttataaattcgtgcactagattgctcccacctgacaagttcgtataccgctgatacaatttactttatttctttttcttcttttgtttctttattctagtatgctaaacctttttctccttgctaatatattccgacagagctcttgccaccattccacatcaaaaataaaattacagtattgcttgcttttctctggttgatgactcactacttctagtttatagtttatatagtgtacaatctgctctatctcatcgaagggtatcatattaattgtttgtatggtactggattgcttgtataggtggttcctatttactctgtgttcgatcgaattggtccagttgaactctcttatctaacatccaatgtaaattttttaattataggaaacacgtattaacctctctaggcgatatctatgatcctcaagggaccatttcactatatacattgttgtgtgattagcattgggttcaaagatatctttcaggttttttccgtaatgaaaatagtttagatatctggcttctgccgctaacacgtagctattgagttctattcctgaaataaaaggagatagggtgatgggacaaaccccaactcccctactaaaatgataaccaacttaatatctgcaaaaaatattatatacggaatagattctagtaaacggtcactcataatgggataaaagaccatggaaaccgcgatgtcttcaattagtaaaatataaatatgggcttactacgtatgcaatatagttatgttttcaaataggcttatattatagaaatattattttgttatttccctccttaacatgcttgtttccgtgcggatccatagtatataacaatttgcgttggtcatctttggacttcattattcaatgagcgcttccacatgcaaatatacccatggatctgacctagagaaacacagacgatccagttgacaaaaatttttcttttgaaacacaatacaacattgtcaactcatataatcacgtgtgcactaatccctttgaatgcacacaagcacatcctatccctatgatcgcttctgaatattggactgatttatcttaagatttataaagttattatggacgtctagctatcgaccgaccagtacatgtggcatatcgctgaaacaataattagccgtaaatgcaaacccccatttcaagtttaggacttaaactctggtgaaaaggtttcaccatcataaatcgaatcagtcgagctacactcgggagagagaatggaaaaataacaggctagctaagggtgaggctatatttgacttcacagagatgcagcatggtcgagggttcggaactactaatagctgcaacaacatgcatatatacatgaggcatcaatctctgcccttggctggctttaagcatctaagctcagaaatcacagtagccaccagctcgtaccaaaatggcaatggatttcttccattatctgatggatgtttggaaaaaatggggtatccaaattcttgtcacctggagcctcatgctgcaggtcatcctcctcctcctcgcggggacacgccgccgtgacgcccccgccatgcttaggttcctcctctggctagcatacctgctggctgactccaccgcgatatacgcccttggccacctctccctcggctccgtggcgagcgatcactggctggcatccttctgggcgccattccttctgcttcatctcagcggcccggataacatcacagcctacgccctccaggacagcgagctctggcttcgccacctgcagatccttcttctccagctccttggagctagctatgtcctctacaaacatatcatcatcggcgacgtgactacgagaggacacgagccctttctgctggccaacgtcttgatgtttgtcgtcggcctttccaagtacggcgagaggatacatgcgctcagatgtaacaagctgagcaacatctggagctccccgaaggaagtatatcgtaataaccaacttcttcactacctgcaggatcgagatcataggattagagaagaagaagaattatctctgcagtatgctcactccctgcaccacatctgcaagcgtgggatagtcaactttgtgattgaggaaccattggatgtggagaaatctgaggggtccagaaccaagatattaatcaagaagatgctcaacgagaaggacaggaagacgcacataaaaatgtggaaggtgatagagatggagctgtccctgatgtacgacatcctctacaccaaggcgggcgtgatccacagctggtttggctactccatccgggtcttgtctccggtcaccatcttttcctccttcatcttgttcatcgtcagtgggaggggtggcagcagctgctgcagcaaagccggctagcagcacgggatcgacatcgccgtcacatatgtcttattggttggtgctttcctgatggagacgacgtccttgataaacgctctagcatcgagctgggcacttggcttcttatatggcatgccatggagttggctcgagaatatggcatttcatgtcagatggtggcaccggctccggcgatcagtcttggctcttcgccggagtgtcgaagcaaagacaagaggctcctggggcagatcaaggaagtggtcaggcagcattggccagttcaatctgctctacttccgcgccgcgcaggtcaaccaaaccaactactggctcagcaagtgtgctatgaaattggggttcggcattggcaattggtggaacaacacttgttactcgtggactataatgattccagacaaggtgaagactagatcggtgagtttggtctccaagagtgatctcaatacaatgggcttgctcaggtataagtggggcgagctggcactcaacaacgataaaaaaaggatctggcctgaactgcttcaaaaactgggcgatctgcacggcgtcgacttccatgagagcatcattatctggcacatcgccactgatctcatcctcctagagagaaaaaacaactactccggcgacagtaaaaatgccaaggaagttgaacgtgtacgttcaatcagggcactgtctaactatctcatgttccttgttgtgactcgccccgacatggtacctggacttccccaaaattggttataccaacagacctgcaacaacctcgatgaaatatgcgaagatcggcgttatcaactcctttcttcagctggcaaggccagtaacatcatcttccgagtgctcagggagctgttcagaggccataatgataacacagcgtcagttcggctcaaccagaccaacgaactcgctaaaatcttactcgagaaatataatcctacagaaaaatttgaccgctcagttcctcgcctgacgtatgcacgcaacgtagctcatatagttctaaattgggagtatccagatgacctgaaggatacaggcccagtgaaggtgctgcatgacttgtggatggactttctcatttatgcaagagtcttaagatgactgcatgcgacccactctttttttcacccacttaagtctcttcaagttccattctctccatgtcctccccccactccttttctcccctctcttccatagaaagtctttcaaacttcacgtgtagatttttataaatattaatataaaaagaaacaacatcatgaaaaaggaaaagattaattaaaatcattattattggaaactagttacgtaaatgttaaattaatcgtgatttttttctccaaatccagcacagcggcgcacatgcacacgcctccccagcatttccttgcattcagaaaaacgtaagtgggccggaacatgaaccgcgcgcgacgactcgcgatgacgtgggctgaaagacgcgccagatcgctaacacgtcttctttaattaggtgtagcggaataccgcatcgcactccacatgggcgtcgcgatcgtgcatcgatgtcgcttccctgagcccgagtcgtcttgccgggcccacctggcagtgggacaaatcagtcgcctgatgcacgcgatccgtattgcctccctacgagccaatcaccatgcgtcgcacacgagaaaagctaatacactaccagtcgcgccccccaccccccccatgcgactcgacacttggcgcatgtggagagggggacgaggggtggtggacggtccggttttctgtttattttcttttcccgtttattttagggttttttatacaaactttgtatatatgtgatttttttttctgattttttctttttttataatatgtaggtatataaagtatacgcatgtatacaaatatatatatgtacgtacataaattttatatatgtgtatacagtatacagagaggagagactagagtggagtatttttgtagtgtagcacgcgcgcaataccgctccccggccgccgcacgggaccattgatccacgtctccaccctcgccccgaatccggagatgccacgcctcccgccgccacgttgtccgcgttcgtatggattcccactgggccacctccatgccaagctgggccagctaccttgcctgtctccgtattgggccatgtcttgtctcggcccaccaagccaggtcgccatccgtttgctcaggccagctcgagttgggctccctgcctaccgaggcctgccagcccacatgcagccatgcacagcccctgtgcaagcccctttttcttctcctccgtgaacttgtgaaacccattatgaagatctcccgatatgatgtccatccactgtgtgtcaccttgtatccaatcacgtggcccaacatccttgatcattctgtatctcaacttctttctgagtcaaatatatcccgatcccgctgctgacaaagatagattccaaggatcttaacttcagtcccaccctgtcacatg

SEQ ID NO: 75075 - DNA, 1871 bp, Oryza sativa
cccccccccccccgaaattttttatttttgttttatttgtttgatatttttttcacgcttagggacacacaaaaaacagaatcactatatactgtttaacttatatatgtcatttcatgtgattatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatcggaaagaataaaataaaaataacaccgttgcaactccatacagagaaacaggaatagaggcggcggcgccagcatggctggcgccctcctccctggggcggcgccagcatggattgcgccctccttctccctactaaaggagtattggtctaatttttcgataaacagaaagagagaattcttgatcaatctgtaagaaatacaaaacgagagaaaacgggatggacataccagaatcactcacctgggaatatcccaacggtgcaaaagccgcttatgtcgatggaatcacgccgccggctggcttgacatggattcaagccatatatatatatatatatatatatatatatatatatatatacacacacacacacatatatgtatatatgtgtgtacacatatatatatacatacatatacatacatgtacatatacatatatatatatatatatacatacatgtacatatatacatatatatatatatatatatatatacatatatacatatatacatatatacatatatacatatatatataacatattgtcagggttatggataccacatatctaatagtcgtcgtcgccactgccggtttccggtgaggaggttcgtcgctgccgtcaccgccggtggcgtggtttcgtgtgtaatttattttaatctattcttatattttggcggggtttcggttcaactgtttcgcaggttgagtactataacaatttttctttgtttgtcaagaccttaagacgggaatggatcctactaataagttgttggttcatcctcctagtgatccaataactgtacacgtatgtatatatgttgccacaggatgatcgggagaaaatggtctggtcgtgggtagaagaagcaccagttggatgcacgcgctaggagctagtaggctgttattcacattatgtgttcgatcgatcgagacaggattagttttttgaactgatgttcttagacagtgtattaactttaaaactaatttgaatacaataattctagagtatataaaaagcttgtgtcggataccttgatcgcatctatatgatcacagatttttctagaataagaaaccagctagttttaaacatttgtgttaatcacttatcactgattactgaaaaataattttaaatgtgaagcactaatattaagtcgaatagactcagtcagacaggtttcaccacactcaattcgcaaaatatccaatcatgctttcaaattttagcggaagtttccaagttccatatgcttcaattgcatcggaattaggtatatttgtctggatttttcacattttgattcttttgaaaaacttatttcgcaaatagacccttgaaaaaacttatcccagaaatggtcctttttgggcaccagagtggctggcgccgtcatccaacgggacggcgccagcctctctggcgccgtcctcctgccaccgtggcgtacgcgaaccgacgtggcaggaggagggcgccagccatgctggcgccgcccca

SEQ ID NO: 75076 - DNA, 7974 bp, Oryza sativa
aattgcttgatttatcgtacagtagttcatcatggaaccctgtttagtgtgaacgcagctgtctctagagcgtaaccccaaaagcttagcggcatatcagtttggctcatcattgatcgcaccatgtacaataatgtacgattcctccgttcagacaccccattccactgaggcgttcctgtcggagtgagttgcggaacaattccacactcctttatatgattgccaaattcaaggctcaagtactcttcaccacgatcagatcatagatacttgattgtcttgcccaaatgattttgtacctcattctgaaattccttgaacttttcaaaggactcagacttatgcctcattaagtagacataaccatatctactaaagtcatcggtaaaggtaataaagtacccaaaatcacctctggcagttgagctcattggtccacatacatcagtatgtactagtcccaatagttcacttgccctttcactttgaccctgaaatgtgcctttatcattttgccaagtaaacaagattagcatgtctcaaattattcaaaatcaaaagagtgtagaagtccatctctatgaagcttctccatgcgtttctcatttatatgacccaagcgacaatgccaaataaaagtgggattcaaatcattaggacgttgactttttgcattaatgttatagactgaacatctttcaagattcacaatgtataacccattcatcatgggtgcatggaaatagaaaatgtcattatagtagactgaacaaccattgtccatagatctaaaatcataatcctctgcttgcaaacaagaagcagagataacgttcttacacaaaactataatgcaataataattatttaactccaaaactaatcatgaaggtaaagataatggcatagtgttgaccgcaacagcagcaactcttgctctattgcccacgcgaatgtccacttcgcttcttgctaagctcctacttcttttcagcccctgcaacgatttgcatatgtgagcaactgacccggtatcaaatacccaagaatcagtagaggaagtagcaagattaatttctataacattaatacctaaggtggaactcttaccatcctactgcttctgcttgagctgctctaggtatttcttacagtttctctaccaatgatctgtctccttgtaaaagaagcactctgtatccttagcgggccctgtcttttcaaccttggtcttagagttgctagtactcatgatctcatcagagtttagctttctcttttgaccactcttcttgttgttgggcttgcacttatgcataaccatcacatggttggagtttttcttgatgctttcctcggcagtctttagcatcccatgcaattctgccaaggaactgttcaagttgttcatgttgaaattcattatgaacggctcaaagctgggagggagcgactggagaatcaaatcagtagccaactctcggctaagaggacaaccaagcttatccagactctcggtgtaaccaatcattttgatcacatgtaggctcactggattaccttctgcaagcctacacgcaaacaaggactttaaagtattaaacctttcagctcttgcttggtcctcaaacatgttacgtagtcccgtgattatcgtatgagcatccaatgcctcatattgcctttgaaactcaggggacatagtagcaagcatgagacagcttatatcaagataatcattgcatcgcttttcatgctcgctacgttgtgcaacaggagcattgttgggcaagtcagctggaaaaggctgtgtaagcacaaactctttgtgctcttgtctgagaacaattcccaggttgcaataccaatccatgaagtttgttccagtcaactcctctttctcaagaatagaccgcaagttaaaactggatagtgcaggagctgccatgatctacaatagaaatatatgtatgcaaaatcagcaccatgtctacatttaacctttcattaaacaatttaacaaaagatactcccattatgtattgtgaaacgaaattccctctagtaacatagtgagtcaagatcatcattttattagtgtctagtgagctttggcatcacagctagacaactatcaaaataggtaagcaacaccttgctaatcacatcatatgtgactcttatgctgttggggtgacatctccatcttcaacccaacctatgccccaaggtccaaaaccgtttcgataaccttgtcaagtaaaccaataatctccgcatatagatgtcagacatctatcctattttatcatgataaaaagtgatactttgctatggcaaacccatcacttatgatcacaaccgtaataggtgtaattattggaagagcataaattacacttaatttttctgagggaatcaatcctaccatgtcatatcaaatatacaacaacaataaagtaagatagatataaaaccccaagcaaaatctaaggggcaacgcacacggcggtcccgctatgattcgccatgtgaaaaccttaacggcgtaatcaaattatgccgaaaccgagtcaatctcattggctcgtttttctcattggcgtgcggttccagtggacatcttactacccgatgaacacaatcacgctcggccttggtgagtactagacattccagtgaagtcaccaacacacataccgattgatctcatcaacccatgcggctattggttcatctcatgttccgatcacctaagaactcatatacaacataatagatctcaactactacacccgcatatcaattatatgcagtgatctagatcataaactatacaaggaggctctgataccactgttgggatacgcgtaggctacgatagcataaatcaaaattttctatcgcgtaaaccaggaaccatgcaagtattagatcatagatcgttaccactcgacgcgctgcgcagaggaaaaaggcgttaagaagtcgaaggaattctcgcgaagtagcgcgcgtcgatgtagaggaagtagtcgatcgcactagctcgaccttctcctccttgtgtgttctcctcgccgtactcccacgccgatcagcaccgcaaaccagcggcgcctctactagtatccacacgtacagggacggaacgccacgcgcagatgtgctagcacccgcgtgcggctagggttttgctcagggagggaagtgacggctagggtttctcacgtgatgaaatatctccaccggtcacacccctcacgaatatatataggatccatcactcgggcctccaaggcacgtaggactcctattcggatcccaatccaaattaagctcatattgggtctccatccaatccccttatttcggcccattaagcgtgcgaccctgtaggttcatgtatactcggctgtaacttggaaactccttctcggtccacgcgccaatagcggcccctagcagaacgtattgacccaccgggcatacataaagatcatatcgactgaacctctagtgtatacttgtataaacccctttgtctcacgatatcgattaagctcaaggctagatatgtgccatcctctaatagctcaatcattcactcgaacctctcgatagattatataacttgtgattgactccttaatcacctttggcatggccatgcgcttccataatctacaacatcgaggggcccagagatatctttccataggaggggcaaatcccatcttgattattcatatcccaatacatgtttcatagcatactcgaaaactacttttataactatccaattacgaagtagcgtttagcagtccctaagtaagctactacacatgttgggaaccatgataatctcagtgtctcatgtttggtctatcaaacaacatgttcactaacatgtctccacattgttaatttggtatctatataccatgatccatgagacatgatcatcaattaatacatgtgctgatcatctaatcatatttgttccacatttgatatttgatcaggaatcctttaaaaatagtaacaaacaacataaagagtctcatgaaagaatcacatatttattaaccaataatgagtttatctatttcaaggaacaatgtcggataaatatgtaaacatagtataggatacaatcatctctatgattgcctctagggcatatcactaacaccaccatccttacctccaccaaccgccagcctccccatccacgctgctgcgcctggcagccgccgtcgcgccaagccaccgcgcgccgcgccctgccgcgccaccgaggtcggccgctggccccgccgtgcacacgccgccctcacctctctctctgttgcacatggagaagaacgagagagagagcagaccaggaagagatgagaaagatataagagagaggagaaagattaagaagaggaaataaaggagaatgagacttacatgtaggacccacagtggaacccagtcggttgacccctcactcctcttgacccacaaaccctagtgaaagtctatattggcccccttttactttagtatccttcatttaacaatcagacaaagcccaccgtagccacctcatactaaagcccacataccacatcccctatacaactcaaagcctctcagaaagtctaaaccacctcccttcccgagaatgctccctcctcggtttataaaaccttccaatttcgaaaattcatatctctccaaccgtaactccgattgactccgttcaacttccataacctctctaaaatcgagatctatttaatggcaccattagttgtattgaatgttgttttattttatttcttttaggattgtgcgtggatattctttggttatttattggacgtgtcggatatttatcgatcgcgggtattctagttgtccaactgtcacagacatctcgaagacattaggaacctatagcaaggcaagtccctacgctccattccttgaacatattgatcctacatttacaaatgtgttgttttacaaataaattgcatgctatttataaattgcgtacctacatttgattatagcctgccttgatattgttacccttgtacatattaatgtatgcctttgaatacccaattcatttatttatatacggtcaattattgacaatgcttagcaatgctattgtagacatacgtatactccatatttaagctagatgattacggatgtgagatcactcgatgtgagtgattgatgatttgcgggtggagacatgagcgccacccgccacacacaaaccttttgtgaaaaccaaaatttaatacaacaaaactattttgactggggcagcatgaatagaatatgggtgggtctggaaacggttagtcgccgaccctggtcagttaaggaccgagtcaggaagctatacaggaaacgaacagagtacgaccgcatttctcaagtgggtatagaccggcggattaggaagctctcgtggagcggcacctaaatcgggtaggttctatatcagtgtggtgatgagtacagtgtcggaaaggtaaaggcctagatatgaacttaaaatgaaccctataaatatatatagtaaatatcccctattccgtggagcgccaggactcccttcaccatccagcagtaggggtttggagtgctggggtgcaatgggggttcatagtccttggagcaggtgccgaaatgcgagagcaactgaaaagtcgggccgtggcaagtctcatgtgttgggactaggctcatatgttgggcaagccgcggggtgcgggattaaaagcgtacatccgctgcagtgtgagtaaaccaatctattcgaatagttgtgctcgcggttaatgagcgccgagacctgtagattttaatactgcttagagtagatatgggagagatgtgaaccttgcccaaatagtgggaaggttagtatagtagagttggtataagatgaaatgtgagggtaaatcgaaccaagcgaggcttggagaggtggatgaaccctggataattacaacttcaacaatagtgttgtttttcagttaaaactgctaggtcaatagatttgtgaaatgaattgtgaaaactagctttatgcaaatgaactaagccatccttgaaccactgtgtgcattagattcattttgtagtggtggcttactgtgtactcactcttacttaattaaatcttttagaaggagttggcgtcgattagatttatgccatgctgctgtcaagtacgtgttgaagatgatggattagggaccataggttcaccagtcgttgcttgtggagttcgatggaccgccgctgcttcgctttcccgttgttttatctattactttggtattttgtattgtaagtgaccatgcttggtctttttcgggacccaatgaggttacccttatattattactgtagaaacaccggtaaacgaagtcagttgtgatattatactgtgctatgtgtgtaccacctactgatccagggagtggtactgtataacacatgggattaccggtgtataaaaccgggggtcccacagatatagggtattatttacttaggtaatgttataaaatgtttttgctatgtgatttttattagatttgacttcacataggtgtagagatgtgttttctaggacttgcacattttggtttcataatttttagagttattatgaattccttatgtattttacaagttatagcgtgttacaggtgaatagttttttgtattcatatagttttgggacaatatgtccagaatgttttgcttcctgttttagttgcataatgtgaatgatttgttgaccaactaatttttattttacaccattgaggcttttagtattttgcttcgcattttataatttaggggtgctctaagtttgtaactcaatatatcaacctaggaatattgtatgtgctgagtaccataaattttggtaagagaggatggtgttgtagcttttctggttcatctaggatttatttgttttatttggagctagggtgcattctatataatttgcttaactagtaatatgtgattagcactcagtttattaatttaaaatttagagatatatttgtacagaaggtgccacatttcattttactgggttgaagctcactacttgctggttagatagaaatttagttcaatccatttgaatctaaaatgatttttttttacaaaatttccaagtttaagtgtgcttatgttgattgttccttatatataagtttaggggcttttcatgtactgtaagcggatatttctattttataaatctgaaatgcacaattttttgattctacagaacttgagttcatttaaaaaaggagtcaaaatggattttatacgactttccaaagttcagcttatctaaaaccaattattttgtagataatatttttagaggcatttggtgcaaagtaagtatatatttttatttctccttaccaaagagtgtatgttagtgaatctgtagaatttgagtttgtcccaaaatgggttaaattaaattttctatgtattttataagttcttacatgttttatgtttactttttcttagataagttttagatgtagattttgtacagtaaataccactttttaagttgtaacattaaagctcatcattttgtgaatccatagcaactggaatcatctcaaaatgatgtttttttattttatatggattttacaagtttaggtgttttcttgttaaaaagtacatgtttttttattttattttatattttcagattttaaattcccaataagcaaaaaggtcccgcaggtttcagggaatagatcccttggtccaaacacgtgtggaaagccaagtttattaagagtccttgagttttaatgtatttataattagatccatggtcccacatataagtctaacacattttacacttcaaaccttgcatggggc

SEQ ID NO: 75077 - DNA, 8009 bp, Oryza sativa
ggcccgatttccccggccgacgtggggaggtggaggtggaagaagaggcgggattcgaaattcgaatcccaccatctcggggtcgcgggtgagcgggacagggggttgaggggcgcgggaggggcgggtgtggccaacgtggcgcggggaaggtgggcgcgggcggcggttgccggcccgggggggagcggctggaggttggggaaagggctgacaggtgggccccacctgtcagtgcccgagggagtgaggggggctcaggcgagcggctgggccgtggccttcggccggcccagcaagggcacgggagggggaggaaatgggctggcggcccatttgggaaaaaggagggggaaaaagggaaaaagaaaaagggaaaagaatttccagggattaaatattgcttgtgctcgtttttaattgcttaaaattatttccagagctttgaaaattccactaaaaatcttgttagtatatttcgacatgtagaactcatgaaaaaattgcacatgccaattccgtttattatttgcattaatttattggggtttctctcttgcttttacaccgatattttctctaggtgatttataaattcaatttaggcttgggaaaggaacttcagggtgtgacaaacctacccccttaaacggaatctcgaccccgagattcggaagagctggcgaagaggtgcggatgggcggccttcaactcatcttccctttcccaggttgcttcttcctctgagtggtggctccactgaaccctgtagaacctggtgaccttgtttctagtcctcctttcattggtctcaaggatgcgaactggcttctccacataagtcagatcttcttggatatcgatgtgctccgaattggcttgttctcccagtacccttaagcacttctttaactgagacacatggaacacatcatgtataccggccatgttggatgggagttctagctgatatgcaacttctcctctttgttccaagattttgtatggtcccacgaagcgtggtgccaacttgccctttatctggaaacggtgcactccccggagcggagtgacacgaaggtacacataatcccccacttcaaaagtgagctctcttcgacggttgtctgtgtagcttttctgtcgagattgtgcaatcctcagcctttccctgatagttctgactttctcctctgcctcagttagcacttctgtcccgaacaactgacgttcgccggtttgatcccaaaagagaggtgtgcggcacttccggccatacaatgcttcaaatggagccatttgtaaactggcctcgtagctgttgttgtaagagaattcagcataaggcagactcttatcccaagctccgccaaaatcgagtgcacaggctcgcagcatatcctccaagatctgattgaccctctcggtctggccatctgtctgaggatggtaagctgtgctgaaatttaaacgggtccccaattcctcttgcagcttctgccaaaattttgaggtaaactgactccctcgatcagatacaatcttcttaggtaccccatgcagacacatgacccatgtagatacaatcgtgccctgatgatgtcctgggcaaacccgtgatgaaatccattccaatttcttcccatttccattccgggatctagaggggttgtaataatcctgcgggtctctgatgttctgccttaactcgctgacaaacatcgcagagtgcgacaaactccactatttcccttctcatgctggcccaccaaaatttttccttgagatctttatacatctttgtacttcctggatgaatggagtattgagtctgatgagcctcggtgagtatcaggtctttcaaatctttctcccaaccagattgtgccatgttcatcttcatggaaatcctgggcttttccgaccctcatattctttttcagctcagctatttcaggatcatttacctgagctgctcggacctggtccacgagcatgggctgtgcctcaagggcagccacgtacccgtgttctacaattcctaagttgaggggttcaagctcttgtagcaacttgtcactcatgtctccaatacccaaggcgttgcagtagcttttcctgctcagagcgtctgctactacattagccttgcctggatggtagtgtatccccatgtcgtaatcttttatcaattccaaccatcttcgctgtcggagattcaaatcaggctgggtgaagatatacttcagactcttgtgatccgtgtaaacttcacaacggttaccgacgaggtagtgccgccagatttttagagcgtggactactgctgccaactctaaatcatgggtaggataattgctttcatgtgggcgcaatagccgcgaggcatatgcgaccacttgaccttcttgcatcagaacacatcctagcccttggcgggacgcgtcgcagaagacttggaagtctttcgtcttatcgggcagaatcagaactggagcagacactaatttattcttgagctcttcaaaactcttgtcacactcggccgtccacttgaacttttcttctttcttaagcaactgagtcataggtctggcaatcctagagaaattttcaatgaaccgacggaaataacccgcaagtccaaggaaactccaaatctgtgacactgtcttaggtggggtccactaggtaacttactccacattcgatggatccactgccacaccttgggccgtaatgacgtgacccagaaatttgacttccgacaaccagaagtcacacttactgaacttggcatataactagtgctccttcaacttctcgagtaccagacggagatgttgctcatgctcttcttccgacttggaatagataagaatgtcgtcaatgaataccatgacaaacttatccagaaattccatgaacactttgttcatcaggttcatgaagaatgcaggtgcattggtgagttcaaaagacataaccgtgcactcatacaactcatactgagtggtgaaggctgtcttgggattatcctcttcccggattctcaattggtgatagcctgatcgtatgtctattttggaaaacaccttggctcctttcagctgatcaaatagatcatcgatccgcggcaaaggatatttgttcttgatggtgacctcattgagtgcgcaataatcgacacacattctcttcgttttgtccttcttctccacgaaaatgactggagcaccccaaggtgaagtacttggtcgaatgtaccctttctgcagttgctcatcaacctgcttcttgacctctgctagcacgttggctgtcattctgtacggtctcttgtaaattggagcagttcccggtgccaaatcaatccggaattcgatctccctcttgggtggcatggtagtgaggtcctcagggaacacttctggatactcgcagacaatgggaataccttccaatttcctcgaacccttctcctcggtgaccaccggattttccacctcaatctgattcaaggagattccctgattcggtgagactggtgacttgtacaccatggtttctcccttctcattggtcaaagtgactgtgcgattcgcacaatcaatgacacccttgaacttggtcagccaatccatcccaaggatgacatctaggtctttggattcgagaaggatgaggttgggtagaaatcgtgatatttggatttctattagcacggaagggctataactgaccgaggttgaactatttcccggggtatgaaccctcattggtgtactaagctcttcttttcttaacccatgcaccccaacaaacttctttgaaatgaatgaatgcgttgcatcagaatcgaaaagtactgttgcagggattgagttaacaggaaacgtacccaatacgacctctggtgctgcttgcgcctcttctgtggacgcgtggttaacccgagcctggacaaacttgggtccagcgcgcctcggcttcgggcacttgttggcgaagtgaccagactcaccatagttgaagcaggctcctggcttgcctccggtgtccttctttgggggaacgggtgcagtctgctgaactggcgccattggcgggcgtggggctgcgccgcggttgtgctgcccttagccaagatggctgccactgctgccgggatggaagttgcttgggttgtaaggatgatgctgtcgaacaatcatggtggtaggtccaccctgttatccggaagtgaagcacggtcgctgatgacttccttggttggatcggaactgagttgcctttctcttcctatccattttgttgcgctggtcctcctgacggattgccttgtctaccagcttctcgaagttagcgtaatccccggagatcaactggttggtcagttcgtcatccaggctcgctaggaacttctcctatttctctgcgtcagtgcggacatcctccggtgcatatcgcgctaggcgattgaactcatgcaagtactcggttactgtcctgttgccttggtggagtgcccggaatactctcttcttttgtgccacatcctcgtctagcacctgagccttcctgaagctgcgacagaattctgcccaggtgacctctgtgcctggcggacgggtagccatgtggttgtcccaccaagctgacgcgggaccctggagctggtgtgtggcgaaggcgactttctccttatcactgcactgcagaagattgagtttcttctctatggcatggagccagtcatttgcctccatggggttggtggtgctggagaaggtgggtggcctgactcgtagaaactccagcagcttggactaagggggagggggaccaaactgctgttgctgctgctcagcctgctgctgcatcctctggtgcatctgctggtgctgctgctgcatctgctacatcatggctgccatcatctgggtctgatgggccatcacttatgcaagagtcggattctcggggagcggtggcggaccattgccggaggcactgttggggtatccaccgtcggtgcgttcttcgctgttgttgccctcacctgctgcacggctgccattcctagtgttgaccatctaaaggaagagcaggcggaggggatggaaaagaagaaaaaacatatgctcaggaactaagctttattatataggaatttaaactgcaattgttctgatctgaattaaaacacttaaaatagcaaacaaatccttattaagatagccacatcatagacacatgatgtcgaccgtcaactgacccataagcgaacaaacctaaacacacaactaacagacaactactaagcagtcgataagctaagggataatgggactaatgctcggaacggctcctgcggtcggtggagtcgaaggcgtcctcctgctcgtcgcctggcccctctgagcggctcctggagtactcaggctgataggtgctgccggtgcctgactccaagctggaactgctgatgaccacacgaccaccactgggagaagctggcagccatcctccactgccacctgctagacccctgtaggccgaagctggcacgaaagtgaagccgaactctagcacgggggctgaagatgctgcggtagatggagctggagctagaactggagctggcgccggagctgcaggcggtgctagaggtggaggctgcggcgggttcctaggcgcaagctggatgcgcactggagctgtggtcgacttccttggcgtggtgcggatgcgggctcctcctggcggtggacgtccctaaagcctagggacctccttcttgagtcgagcgttctcatcctgcagatctgcgatcctcacaagcttctggtcgttgagactcttggtcgctttgtggagcatggcgtgcaacttgtcgtagctcctcatcacgtcactcatgtggccgaaggtgacgtcgttctctccccacgctgacttgaaggtgctgctgttggagctggaaccgcggcaagggtggaagcggtaggcggtggtgttcaggacgccgtcatgcagctccctcagatgggccatcatcctgagggcggcctcctcacaagcatgctcaaatgtgcccccacaagctgtcacctccatgttgggcaggtaggtgggtatgtcatgaatctccaagcggacctgatgcgggaattcgccactgagggggtgaatgctggtgtactgcggctcccttggaaaaccaatcacaaacgctatgcgggacaactctgcaacgaagcctcccatagtctgaccttggtgcgtgaggggacagtcggccatctatagaagacaaaggatggagagtcaatgcatgctcaaatccaattataaaataaacggcaatgaactcaaataaaataagcgaatgagaccggaattttgtgcatagatcattttttttgcatgagaacgaacaaataagactgacttacatagcgataaaataatgagaaattagatacatactaataataacgataatagcataaataccttgcaacccatattcctgagttaggacctaatgcattcctcccatccaatcccgacttcactgtcaaataaacctcaaataattttactaaaatcctagactgacctgatttgacaaatctcacttaaacaagcgacaaagcttttttcccttgaaccacaggaacaaatcccaattttcccggagcaaatcaaattgcgaagaacatatgcaatgaaaaggattcagagggctcttaggttttccatttggcttgtcctacggtcaaggtcggctctgataccaacttgtcacgcccagaaattcccgaatagaattccaagcagaatgtgcatttaaacccccgtccaggaccggccggggtacacaaacgacaaagttgacatacagatccacgtcttacaaacattataaaagtcttacataaatgcaacggaaaattaaaagataaatggagctaagccttgacttggactgcagcgagaacaccactccacaggcatcctcgacggcacggacgaagcctactcctcggagaagccaccatctgacacgcactcaatctctggggttttggggaaaatagagcaagactgagtacaaccactgtactcagcaagtcataccggaatagagggtatgatgcaggatataatcaaaggatagatagagcggttcatttgtataaatcgagcatttataaacagtagttgaaagcagtaaaacagttgtaataattaatcaatattaaccatccactgtccaacgctacaccatattgcaacaggcccaaccatccacctgaactactcaattccattagactaagctagggtgagactaatcacggtgaatctggttgaccgcccgtaaccgcgggcacggctattcgaatagttttactctgatcagaggtgtacaactgtacccacaagacacagccccacgacacgtttccgtgtgccgacatgccaccacgacataccggaaagaggccgtgacaggacccttcgcataaccaaacacaccacacctcaggtttcacccccactcctcgcaaggcagcgggcagtcccctctcgtgcctaggtgaatccggaagctgcataggccgtcgcagggcccatccaaactccatcatgcccacccttgcctggttgcgtcagctagaggaaagctacaatacaagcccagccgttgcccacgctggcttgtggtaagtacgaggaattcttccagggtatcccgcgaaccggtccttaagtgcgaagcccaccatttaatacattttaattagagataatcccttatataccactgaaagttgatctaatcccttatatgccactgaaaattggctcttcccttatatgccattggtccaaatttgcgcaccctctcatgccactaccgttagttgaccgtgtgttgaccgttaactctcaagtaaaaaatacatatttgccctctctgagctgttaggcatgcg

SEQ ID NO: 75078 - DNA, 12721 bp, Oryza sativa
agttcatcaacaaattaatacgatgacctagtatagatttgatggttcgatttggacaggaaatttgtaggaacaatactacactttcaagtttcttcttctcccctactctatcaatatataaggcaatcttcttgcctttccttaaaaaaaaagtttcttcttcatgctgacattttggaatgtcaaagcttagtgattaagtaaactaaatacttggcacattcaagaatgtatcacatgttaaccaagagcattctgcgtgagagcttaatactaaaatctataaaaaaataaacagggatgagagaagaaatgtgggagcacctatggatcgggcgaccgatctggggctgggaaattgggcgctgaccaaattactttaaaccgatttttctcttaaattacttatccaaatcatgatccgattgcactattaaattcgttgcaattaaatcttcaaaacaaaaccacacatggatatattccgacgaaaaaaatagcttattattgatttttttaaatgttgcatgatgtttcatcaggtatatcggaattgtctcactaagtaaatcgaaaatgtttcactcgcttaaatcgggtgttgttacaccttatataaaaacaatgtttcagcaaatagcgaaagaatgtttcagttcactgcaacattagatttataaatagtgaaacattgtaattacactaagtgaaacatttttcggtggaacaaaaaataaaccaaattcccttaatagggggtttctaaaatatgtgggttttttgttgcaatggaatatttcgttcactgcaacattagatctatacatagcgaaacattgtgactacactaggtgaaacattttttatggaaaaaaataaaccaaatttccttaatagagagtttctaaaatatgtaggttttttttgttgcaaaagagtattttaattcactgctagctatattagatctatatatagtgaagcattataagtacactagttgaaacatctttttgtggaaaaagggagaaagaagtgggtgggccaacaggtagcacgtgggccaggggcgcgcgcggggcgagcgcccgatccgtctccctccgtgccgatcgactggcgacaagcattatcgaagaaatgatggaaacatggcatgatacaaactaataaaaataggaaaagatacataccgtataggaaaaatccttgtgtccaactcgatccaataattttctatgcagatcttatagtgaataattaaataattgttctacctttgtccaagattgtatatatatccaatgacgtcctagggtcctgtagcaactcgtttcaaggccaaagctgcctataactgctaacagataaatccatgtgcctgtggataagtgaatacaaaatttaacttggtatttccttgtgattcatcatgcaagccccaacaacagagacctaaaatcaggggaagtgaatgtaggtattttatcagaaactttccgaacaacaaaaactggcatacaactgatgcaagtgcatttgggcattttatcaaacacatagtgcacatataattggttagtgtgcgtacctgtgctaaacggcagaagcttgtgtggatccaagcgatacaggaagagggaaagggatcctctgacttaactgctgtgcagttgagtcactgatatgtgggccatagcaaagtgggacccacagaggatctgcttccaggaagaagagtttgtccagcaacgcgtagttgatctatgggggaggtgaaggcaattgattcagagctctcgaggtatattgcttgatataggagcatttgaaagcggttatgaagaggattcttattgctgatttactttgagtcagaaggggaggagtcctggcgatgcggcagctcgagctgcgcatggtagcaactccctcgcaacccctgtcaatgcctcgcttcctcttgcggcgctgtgtagcatgtgggatggacggggctatgtttttattcttttctcggagaagcggaggggcttggtcaacgagtagcctaggctggcccaatattaccgaaacattcatctgggaaatctgcaggacgatccaacggctcaggaagtgacgtggctcaatatggtgcaagctttatagtaataactgtataggactatataggaagaagggatttcatgcatttcccttcctttaatatattgttgccctgtaaccttgtcaccttcaattgtaaatggttaggatggtttattctatcatcgaatgcttagccgtgcttaggtctacttttgattcaccacccgtgatttatgggtattaaaatctgattacctcactcaatgattaatatggaaacatgctttaacttggacgggtgatagggcgatgacgggacggtgattttccctgatgcaagtagcctcgtctgggttgttaaggaccgaacatgttgacgtatattcaagcaccatacgtacttccacacgccttatttggggccggcttgtctgttttcaagtttataggatgcaattggaaagcaaatatgcaattggaaagggaaatatgcaatgtgatacaagttacctcagtggggagagagatgtctccccccaagcttggctttcgctcagggtccttggtaaggattgaatccctgaaagcggaaatatgcttgaaggtcatcgtgttgttgctgcatcatgttgttgatgttggcaaattgagcattagtagtctgttgtcattcttgtgtctgagctatgtgttccgtgaggttgtattggatctcccccgtctgcacatcaagggtgtccattctcctagtgatttcacccaagtcccaacgagaggaactcgagcgccattcacttggacatggaggtactccacttgatctgggaggttggttgtccccccactatatgtcatgaggcgcatgccaccggtcctcactggcacttgcccagcttgagacaccgatgttgtggcgtggagcttgggtccatccgagtgcatccccagttggttcccaacctgcctcatataatctgcacgggtgttgaggatgatgaactttctcgttcgttccttgccatgttgtgtgtgtccctgtatactccacctgcatgagattcttctatggtctgcaggggaatggttagctcacggcagttgtacaaatgataccccgcatttggtaacgggatttcattttgtcacgaccggaattaacccagcgggcattccatacgtgtgtgtattactccttgtcccaggaggcaaggtacaccaaaagttgatacaattcagagtttaacaagcggaagcgtaaatagttaatttattacatgagcgatgaaggcccagcacacacgaagataaacgagaaacagcggaagactagggcgacgaccacaggcacttgacggcaggcacgagctagacaccaaagccttcatcctccaggaactcctcttctgggctggggaaaaattaagcaagattgagtacaaccacctactcagcaagacacacccacgaatgcagaataaatgcaaaggagtacaagggagttataataaaggggttagggtttgcagtaaacagcatttaaaagtcacttagttgcccaaagctattttgtaaagacgattctagagctacacaatgttataatcaaggccgtgtacccacacgaacctgccttaacccaaggccttcgatgattcagaccgaactgacaacccgacctgggtcctagctcgtcccaagccaacccagaccaaccataccacattttagttgttaagcatgttttaagaattaaaccactaacttgggtacattgctaggcttgcccataaccgagggcgcggctattcgaatagattatactttgatcagaggtgtacatctttacccacaagacacatctttctcatgtgtaaccatgtgccacataccaccacggcataccgacgaaagacgtgacatagttctcaatccatcctagccataaacaagagtaccgacccaaccctggctacggccaggattcccgagacaggtaaccaaggttgagcccctagcagcaggacaccggccatgtgccatgacatctcgactaccgggccgcagctcgtgtagccttaatttgccctagagatgtccatcgagccccgacttcgtccatccctatccgtgtatttttgcccatgaccagactgagccacgaactaagccttacccactagacatgtggaagtacggtagtgctttgcaacagaggcccgaagaccggtccttatagtggccgagatgctactatcaaaaccatgcacctcgagcccagcctaaaaccattttaggggtattgaatagagggggaggtgtgtgtccaattccaacataagccaaccattccataatgtccaaatgatatgagaattcctaaagtctaaagttataaaatcacctaatgttgtctaattaatcagcgaggcatctacctaaattcatgctcgtggaaccatgaatagggtacccactagttgggggttttgtttatcctagggtaaacaaggtaataaataacaatagcaataacaataaggtcataacaaaggtaaataggcatggctaaataaaacagtgataacacgggaatttaaataaaacgatattgcaataatttaaaccaaaatagttttataaactgggattcaatatgctcaaggatgatgtgacttgccttgctcgctttcccaaacgttggcttcaacctccacgtagagcggatcttctgaagctgcagcgtctacacggccaatagaaagaaaaaggcttttactctaataaactccatataacaagcagaaacaaagcacaaaaataggttcttgacttcttaaggaaaaattagagacttgaacggtccaattctgagttcaaaaggccaagatatggccatttgaagtttatatgctcttaatgtgaatatttgcaaatttcttcatttaaattttaattaaaaaatagggtttattgtgtcagttgaggggagggagcgcgcgggccgggtccatgggagtggtgggcccctgcggcagcccctcggtccacggtggaccgggtgcacccgcggctcaccagccggctccgggggccccacacgtcagccgcacccgatggcacggggggctgacggccaggccccacgcggtggccacacggtgcgcccagaggcggctacatcggcgcggccggcgggaggaggcgcccgcgcccctatggccgccggcggcggccataggcgcggcggagcggcggccaagagaggggaagggaaaggggaaagaggcggcggtccacggctcaccccggagcgacgacagcgacgaggaggcggccgaagtggagggaggcggtggtgcggctcgagtcgacggggtcggcggcgttccggcggtcggcgaccgaaacggaggggtggacgaggtcggcgacggtgcggcgaagccggaggagacgacgccgaggtgggggacggtcccggcgagcagctaggcccagccagaggtcgatggcaacggcggagagagaggacgacggcgcgagctcgattccgacggggaaaaagggcggcgagtggcggaaacggacgagggaagtgcggggagggtttatatagggttgggagtgagagagtgcggccggcgggtgtcacgcccggaaattcactagtaatttccgaacttatttgtgcataaaaccctcgtctaggaatcagccgaggtacacaaactgacaattcaatatacaaatccatgataataataacgttacatactcacaaaagaaaagaaaacagcagcggaataacggtctagcgatggcttcagctccactctcacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaacatttaagagaagtaaaacagtagagtaattaatcatcaattttaatcaacactgaacagcaccccaatgctgcacaaactccaaaccaggagctaaacaaattattaccagttattgcatcaataactatttgtgagaggtgtgagactaatcacgaaaaatattgctcaaccagcccataaccgcgggcacggctattcgaatagttttactctggccagaggtgtaccactgtacccacaagacacgattccacacatgttgccatgccccgaagtaccaccacggcactgcaaagggggaaatcgtgacaatacccttcgcacaacacaactcaccatagtgcaccattcctggattataatcaccccctcaaaaaccaaaggcatggactccccagcgacccccacggacttctcgccgcttctcagtctggcaccccgtaatgaaccatgctatacaaaagataaagccgttgcccacgctggcttgtggttggtacggttaatgtttcacaacagtagctcgcgaaccgatccttaattgtcatgagcacgaacttcaaaaccatgtgctcacaacccaccattgacaagttttaattatcaattaattatcataacacgattaaccatcgtaagctacatttaaatctaaccataagtaataatgtaatatgattcaccccattaatgagctaatgtttctaagcatggctaagcaattatatctatatagcatttagctgaaccaaaccaatatataaggttctagctaatcgaattctaacccataggaaaataaagtcatcttcggccaataattaattgggaaaggctcaccacccgatgacattcgaaaataatgcataagttgaaataaaacattagctttaaatgggttcaacatgctcaaagggtcgtttgggatctgtgtgacttgccttgagcttcatcaagcgcttctgaaccttcctcaacgaaaacgctctccttcagaacgtcggaaactaaagcgaaagaacaaaatcaacaaaacagtacaaaaacaagcataaacaatacatgtggatatttttaacatgtagatctcgattttagaaaaatttagcaacttgaaccactcaaatcggagttacgatgaattagttatgaatttctgaagttttaatctatttgcatctagaaaaaaaactggaaaaagaaaatatgacgtcatgctgacgtcatcatcgcgcaatttcacgggcaacgaccttgccggcgatagagaggtcggcagggctatctaaagtcatctacacgtagaggacgatgacgcgaactcaccggtactagcaaacgcgatggacgacgacgaatggtggccggcggcgagctctagcggcgacacggctcgggtcgtcggcggcggcggctctccggtgaccggcaacggcggcgagggggcagccgaggttccccgcctccgtgcgcacctaacggcgacgacgggaagcggcggcgactgctaacgcgatggcgtggcgcggctgaacgtcggccggcggcggcggcggcttggacggcgtggcggcggcgctacgggggacgagaaggctcgggagttggtgcaaacgaaagaggacgccaaggggatgctatttataggcttggattagagagatcggactccaaacgagaggatttgagccggaaaatccgagggttagttggagagataaactcgaaaacgaattcgattccacgttgatttcttcgggataaagtgcgacgacgggaagcggcggcgactgcgaacgcgacggcgcggcgcggctggacgtcggccagcggcggcggtggcttggacggcgtggcggcggcgctacgggggacgagaaggctcgggagttggtgcaaacgaaagaggacgccaaggggatgctatttataggcttggattagagagatcggactccaaacgagaggatttgagccgaaaaatccgagggttagttggagagataaactcgaaaacgaattcgattccgcgttgatttcttcgggataaagtgcgattcttggggggaaggatagaggaggataagaggaatatttcccctcaactaattttgcaaacggagcacgggatgcggcggatttggtggaggaagcggcggctgcacaggtacaggacggcagctcgggcttctgtccaagcttgaagatgagcagtacaggggacgcaaattagactttcggctgggcttctacttccaaggactgattaaaggagggacaaaaagcagacgtcgggaaagagagcgaaaggactgcaggctgagaggagactgggccgagagtgagaggacttttcctaattcggcccgaaaaggaaaaggtgaattttaattacttttccaattaaattaatcactgaaatgatctttgaattgttaaaaatacttctattgctcaaataatttcaagaaaaatcttgaaaatacttggaccctcaaagtatttaacaaaattataatcagaccatttaatgattaatttaatatgtggataattactgaaatgttctttgtatgattaaaattaagaattcagctccgaaaaatccgagaaaattccagagagtataattaaccatggaggatttaataaaaattaaatccatccatgctttatatttaggaaattttatttcccacatttaacttcacttgtaaattaatgaacatttaatataaattctaataataatttattaaataatttataaatcctgaaacgaaaatcaggacgtgacagcgggggaggaaaccggcgcgggagacccggccgccattaatggcgccggcgggattagtggggggcttccatccgaaataaagagagagagaggggaaaatggggggaaagggagagggaatcaggggaaatatttcccccattcaattttgaacgggatcggcggagcacggcggagcacagcggagcgcggtggatttggcggcggcgggggcgctaggcgcgagcggagggagcggcgcatgcggcgggaggaaggggatgattggtgggccccacccgtcagcgagggtggcgggcgggcccgtccgtcagcggctgcacgtgcagggagaagccgagtggtccacggggaagaagagagaggaggagatgggccggattcggcccaagagagggaaggaggatttttagaggttttctttttataaaaccttttcaactttgtttatttcttgataattattatttgtgctctgaaaattccactaaaatttatttacacattttaggcttttaggaaatatacaaaaatcctccaagccttttttgacttttaactttgcacattttaatttttggaggcttttcactaggattttaattattctaggcataatttaaaggatgtattttagggtcgttttggggcgtgacacatttgtacaaccggggtaaaagtatatcaaagatccgtctactccatgtttaagaatatgcccatgcactagatagttctcatcaatacagggacgagctgctgagatgaaagcgatttggtcactaacgacccctagcactttcgctatcctagtaatcagagaaatgcactcaataggagcagaaaatcttatactttctaaccattcccttatcatacatttcacaggagcaattttgatttttctaaccatagcaaacatgataattaattcatcccccctaatgggtctaagatcacctctaggaaacaaactcagagcaatccacttgtgcatgagcctaactataggattatggatatcatttgtcctaggtttcttgcaaattggagcaccagaaataccttcccaaaacctatttttctcgaacccagaaattcctttctagagatcgattttacaagaatcgtgaaagccaaaaagtgtactcaatcctttccatgtaagtgtatactctttatggaaaaagcgaaaagaaattccatcttctatttctttcaaagtgcacagaaattgcaaagtaaccaaacgagaaccaggctcatctaccacaagaaatctctgccaaccaacagctttccaaatagcacgaaaatcaacatccattcctatctttttcagcagctccggagagtattctcgcgtgtgagcatgctcccggtcgcttagcatgtagtaggcttgtctttcctgattgtcgacaaggtcaaggtcggcgtcgttcaggagacatcgcggagcttcggcatcttccatcgtgacatcagctgatgaacaagcgctagactcatcatgattgacttgacgaagagccggaccacttgaatagacgaggcagccgcctcctcattctgcacaatggagcaagaatggtctaactcggcgggggttagaatagcaagagtgtcacacgccggttagtttcaccaaagcaacatgtatatatgcagctaagtatttgaatttgagggaaacaatcaaagcttgaatgaacttgagagaaaactttggagagggaatgaaaatgtgctgaaatggggtggattcccctctcccggccggttggcttaagtagtgcacccacaacggtcaaaactgacatgtggggcccactagccattgcctcaaaaaagggaggcagccgatcgaacccctggtgggcccaaccggccccactttcggccgttgggttccaacggtcagtgtggtcgtggcacagtgaattttcgttgaaaattttattttggtttgtttttaaaaattcatttgaagaatttcctcaaaattctgaaaatcctaaatgcaattatgaaattcaaacatgtgatgatgcaaaaatttaaattattgaaaacaaatatgcggatacataccaatttatgtgttggtgaaggtcgcatcattttaagtccgacgtgcaagaccgtaccacgtgcaagaccgtatctcctttcagttcagtgcactgattttccacctgtctccggaggtaatggagtaggcgtctttgacttttctttccacaccttctttggttttggtgtggaagacggcttcgactgctctagcttcttggccagtgtacttaattttaccagtatcttccaataacggttcgtgggcatcgttgtttccttttccaggaaattctgcatgaactttaccaggctatccatcttgggtggctccacttcgaccacttgaatattctgcggatttggcccgtactttattctgaccatggagcattgttcagtccttggctgaaactgaaacttttccttcttcccgttgatatggaaacggatacttctcgtttccacgtcaatgttggctcctgcggtgctaaggaacggacgccccaggatgagcggcgtctcttttccattgtccatatccagcaccacgaagtcaaccgggatgaagaaatcccatatcttgactagcatatcctccgcaatccccgtcgggtaacggactaacgagtcagccagttgtaggcgcatcggtgttggtgccaacaccgtgaagttgagcttgtcaaagacgttctttggcatgacgctgacactagctccgagatcacacaggacttggtcaaactgctgtgccccgatcgagcaggtgatcgtaggacaccccggatccttcttcttttctaggagcttgtggagtatgacgttgctgcactgctccgtcagcttaaccacctacattgttggatgcggtctcttgttgttgaggatatccttaagataacgggcatatgttagcacttgcatagcatccaacggcacgttgatgtgaatcttctggattacttcaacaaagcgagcgaactgctcgtccactgacggtttcctactccgttgatgaaacggcagcaatcgtgtgtcgcagtattcctgcggcacggccttttctggctgaacctctttgtcagccgagttactcgatggcgcttctctggcaacccgattagttcctgcagggttaggatatggcggatcacgagtggacttacctcctctcgtcgtgatcgccatgacattttcaatggaggagtcggtctgctccggaatcctcccagtttcagttgcagggactaaagaagccaattaagctagctgggtttttatcattttaatgaagctcagctggttttgaaaagtagaagcgaagccatctagcttaacattgatgttctctaggatcttgtcattggcagctagctttttgcttaaagcatcagtggttttagcttgcgcaaaaatgagatcctttaaggagggttggttagagaagttaccgttgttgtttcctccttaatagtatgggtgtgtctagttccacccttaacctcctcgtggacgattcccgttgttgttgttgcccatgtacatcgcatcctcacgagtttctaggcagtcgttcccagagtgacccgtgccgccacagacctcacacgtgacgtgtgagtccaaggccttgatggtgccttgtggccgtttgtcgtggtcgtccagtcgtttcatgaggaggtccagcttggcagcgagtagttccgtttcct

SEQ ID NO: 75079 - DNA, 1015 bp, Oryza sativa
agggcgccagccatgctggcgccgccccagggaggagggcgccagccatgctggcgccgccgcctctattcctgtttctctgtatggagttgcaacggtgttatttttattttattctttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatataagttaaatagtacatagagatgcaatttttttatttttatttcattttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcagacaaataatatatgcacggacatctacagaaaatgttacatccgattctccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgaattcctaagtgtgtaaaaaatatcaacaaaataaaataaaaataaaaaagttgcacatctctctcctctgcactagttcggagagaggagaggagaggaaaaattctacatgtcacatattacgtccatttgagttcaatttttctatagttggttcttgtgtgtccctaagcatgaaaaaaatatcaaacaaataaaacaaaaataaaaaatttcggggggggggg

SEQ ID NO: 75080 - DNA, 6839 bp, Oryza sativa
acatcgatgcgcgctaattcgcgagagttccttcgatttctcagcgtcttcttgtgctgcgcagcgcgtcgagtggtaacgatctatgatctaatacttgcatggttcctggtttacacgatagaaaattttgatttatgctatcgtagtctacgcatatcccaacagtcgtatcagagccgccttgtatagtttatgatctagatcattgcatatagttgatatgcaggtgtagtagataagatcaattatattgtacatgagttcttaggtgatcggaacgtgagatgaaccgatagccgcatgggttgatgagatcaatcggtatgtgtgttggtgacttcactagaatgtctagtactcaccaaggctgagcgcgattgtgttcatcggatagtctgatgtccactggaaccgcacgccaatgagaaaaaacgagccaatgagattgactctgtttcggcataatttgattacgccgttaaggttttcacatggcgaatcgtagatgagatctatgtaccccgtgtgcgttgccccttagatttcgcttggggtttttatatctatcttactttattgctgttatatatttgatatgacatggtaggatagattctctcagaaaaattaagtgtaatttatgctcttccagtaattgcacctattacggttcactacaagaatctatttaatctgtgacgaaatttgacgaaattttcgtgatgttttcagagattgtcacggatatgcaactatggatacaaggcccataataccgtgacagtttatcgatttcgtcataaaccggcccaaaacctgtgacgttatagcaatttcgtcacgatttaaatacttcaaaaccatataagagatatgtaaattttgtgaacaatgttactatcactttatcggatgaagaaatgaccaaaataaaagttataaatattgatgagttatacaacttggatgttgatgactttttccgttgaaataatttagtatatgaaaatattgtttgaacttgtcataatttgaaattcaaattcaaattattgaaacagagtcatataccaaaatggccaaaacaaaagttgtagatattgatgatttatacaactttgttgtatatgactttttcagttgaaaccatttggtatttgaaaatgttgtttgaagttgtcataatttgaaattcaaattcaaattattgaagagagtcatatagcaaaatgaccaaaacaaaagttgtagatattgatgatttatataactttgttgttgatgactttttcagttgaaatcatttagtatttgaaaatattgtttgaagttgttataatttaaaattaaaattcaaattattgaaacagagtcatataacaaaatgaccaaaacaaatgttgtagatattgatgatttatataactttgttgttgattactttttcagttgaaatcatttagtatttgaaaatgttgtttgaagtagttataatttgaaattcaaattcaaattattgaaacagagtcatatagcaaaatgaccaaaacaaaagttgtagatattgatgatttatacaatttttttgttctggactttttaagttgaaatcgtttagtatttgaaaatgttgtttgaacttgttataatttgaaattcaaattttatataggtcaattaaactcagatggagaaataatcaaaataagataggtagatctcaataagttatacaagtttgtttttgacaacttttccacataagtttatttagtatgataaattcgattcaaagttttaatattttgaaattaatttttttccctcctccctccttcaaattttttcatctcgtcttctctctcccattctctcctatattttcacttccccatccttatcttatcctctcctctcctctctgcctcttagggcatccataatgttgctagaaaccaggcattagacattcaatacatccttactacctggtaagaagtattgtgagggtgatacataactactatttagtcatatagctaatacctagtaagaagcgctgtatgcctgacacatggagtaaaaaattaaatgaaagcaactggttgccacgtgcaggtgtacaattgagtgatggatgatgttttttcaagaggggtctaccttattcctccctattacacataagcattgtggcctcctgtgatatactattgctatgtactgtttgggcccaccctcctaccgatttgggtaggatacattgagcttgcccttactctttcctcctctcctctctctcttcaccgacggcagcggcgggctcggcaccggcggcggcggcctcgaccgccgaccgccgacgccccgcgccgcctcctcgctcatcaggatgggctcggcggtgtatgccggtgccggcgtgctcgacgacttcctccggcggcagtccactttgttcgcggtcgcggcgacgtccccaacctccatgacgtcgtcgccctcggctactccggagcccgctgcccccggccggatttggaagccagctccacaacgacgggcgccgttcttcgccctcggcctccaccggcttcccttccgacgtcgccgccttgagctcctcctcacgccctccccgccggcccttcccgatctgctccacccaagccaccacgacgaccagatccaggaagtctctccatcgctctggtcctgacagtggctggaggaccccggccggttgcagcacttcatccccgcaaaaatatcaaacttgacatcgtcagcctcctcatttggataagtaagccccttcttcaccctgatttgtgcgctaatgctgatcttaatcggtgaatggttgtgttgccaggaatttgtgaatcaggatgttccatctaatttggttttgctcgggttgtcaaatactcgatggatatgtacctgcgcatgtgcatcaggttggtgtgtttcggcatatggtgggttgattttcttcagccaaggttgtgctcatctcttgtatcctcaaacactaagatactgatgttcttttcctcttctcaccattcccttgcatgccatttttttcaggtaaccaggttcaatgaagaatgggagaattatgtttactgataatgtgcatttttatttactgtgccttattagttcatttggcatggacgcccttacttttgcatcagctcaggcttagcaagaaagattctcatcctgttttaattgctgacccatgaatgattaatcttgaccccccaccctcaagcaactctgttgcttttcgcttgcgagaacgcagttctgtaatctagcttaactcagaccgattccttattttattgataatctcatctatttgtcatgtgagtaatttaagtggcgcttaaacaacaatgaaacaattgtccagatgtggttggaacaaaaccatatccacttgccgtcaaaaaaaaagaaaagaaaaataagtgcaaatttgttatttcttgttcctcgtatggttaaagatggtcttcctcgtatggttgaagatggtcttgtttgtcactatgaattattcttgtgcttgcagatggatgatactctgacaactggaagcatcaggagtacagagggggaaaagagacgtttagcagaggcttcacttgcctacaactgtgagaggtaattccatcatacatctatttaggtttgtgggaaatgataaaagctcttgcaagcatgtattgttagggagtaacatacttgccataaaagaaacagctcaattttcagtccgaatgatcttcccaagcgtaatgaattatgttagatgggtgacatttattacttgtgctgatgtgtaatatgatgccatcaatccttccctgtttgaagccatgggacactaacaagcttactttgttcttgtttccaaaatgtgttaatattgcgactaggtcttaattccaaaatgacaatggagaagtgggcactgaaaagaacagttgatcatgctctctatgttatttttatgcctccattttcttttcttccccttccgttgttgttcttctcttcttttgcttaacatgtatctgttttgcactttcagcaccatcatccacatattaacgtgcgcagcgtgaagccgcgcttgttcttctagtaacatccaatggccaatgctatctagagaatattcatcaagagcagttaagtatgcaaattattcaggagttgaatagttccaaaaagttggtatagagcatgctatctagtaattccttgatgacatgcacatcattttagaacacttagtctttacttggattttgaatatttctgttgaaatgtgaacactgactttcgacatggtcactacctcaaatgaatcattaatataccttgcctgatttttgtttttgcaggatatagaagactaaatgatttacagattacaggggaaaagagaaacggccaattaatcagttctacatgtagaaagctgtagatagctttaattagtgagacaattgtgtgaacttcattttttttttgccattgcaccttttttttttggtttaaatgtaccgttgagctgtaacttcgatgatttatccaatataaataaaaatagttatgatcatataaattttacagttaaataatgggccgtcattaaataatcaatggaccaatgtaaaaaaaataatgggttgtttaaaaattaatgagccgtataaaaaagttgctgacgtcagctgccacatcatcattgacatgtcatcgcacacgtgtcaaaacgaccatgtcacctgccatgttggtcgccacgtggcaaccatccgtgacgtttaatttcatcacaaaggttgggcctgggctggactacacgagcccataagcgttttatgacggttaaaaaacgtcatagattgtgctgatccgtgacgatttcagagaaaacgtcggcacatttaatctgtgacgctcaatagatgacaataagtataatcgtcacagacaaattcctgtgacgaattttcagtgatccatgacgattttttttcgtcatagattaaatagattcttgtagtggttgtgatcataagtgatgggtttgctatagcaaagtgtaactttttatcatgataaaataggatagatgtcggacatctatatgcggagattattggtttacttgacaaggttatcaaaacagttttggaccttggggcataggttgggttggacatggagatgtcacctcaacagcacaagagtcacatatgatgtgattagcaaggtgttgcttacctattttgatagttgtctagctgtgatgccaaagctcactagagactaataaaatgatgatcttgactcactatgttactagagggaattttgtttcacaatacatagtggcagtatcttttgttaaattttttaatgaaaggttaaatgtaaacatggtgctgattttgcatacatatatttctattgtagatcatggcagctcctgcaccatacaattttatcttgcagtctattcttgagaaagagaagttgactggaacaaacttcatggattggtattgcaacctgagaattgttctcaggcaagagcacaaagagtttatgcttacacaaccttttccagctgacttgcccaacaatgctcctgttgctcaacgtagggagcatgaaaggcgatgcaatgaataccttgatataagctgtctcatgcttgctactatgtcccctgagcttcaaaggcaatatgaggcattggatgctcatatgataatcacgggactacgtaacatgtttgaggaccaagcaagagctgagtggtttaatacctcaaagtccttgtttgcgtgcaggcttgtagaaggtaatccagtgagcccacatgtgatcaaaatgattggttacatcgagagtctggataagcttggctttccccttagctgagagttggctactgatttgattctctagtcgctccctcccagctttgagccgttcataataaatttcaatatgaacaacctgaacatgaccttgacagaattgcatgggatgctaaagactgtcgaggaaagcattaagaaaaactccaaccatgtgatggttatgcataagcgcaagcccaacaacaagaagagtggtcaaaagagaaagctaaactctgatgagatcacgagtacaagcagctctaagaccaaggttcaaaagacagggcccgctaaggatgcagagtgcttcttttgcaaggagacaggtcattggaagagaaactgtaagaaatacctacagcagctcaagcagaagcagcaggatggaaagagttccacctcaggtattaatgttatagaaattaatcttgctacttcctttactgattcttgggtatttgataccgggtcagttgctcacatatgcaaatcgttgcaagggctgaaaagaagtaggagcttagtgtcacaccctgaagttcctttcccaagcctaaattgaattttaaaatcacctagagaaaatatcggtgtaaaagcaagagagaaaccccaataaattaatgcaaataataaacagaattggcatgtggaattttttcatgagttctacatgtcgaaatatggtaacaagatttttagtggaattttttagagctctggaaataattttaactaattaaaaacgagcacaagcaatatttaatccctggaaattcttttccatttttctttttcctttttccccctcctttttcccaaaggggccgtggcccatttcctccccctcccgcgcccttgctgggccga

SEQ ID NO: 75081 - DNA, 21449 bp, Oryza sativa
tttttaggtatagatattgcaacttgacccacattagtcacacaaactcacactgacaatcgccaacattccaaatcaaatttatcacaaaaactaacccagggttcccaacttccttgccaattttccatcacaaataaactaaaatcacaaattatttccggacaaattaacctgttcacactgtgattcttcacaagatttattagtaaaaataaccagagtactgggcatatcgtcagactgttgtagacccctagacaagggtaagaaagatgcatgaagtaattgtatttctgagcgtaggcatgcactggcatttggagaaagcttggtaaagggaaaatttgattaatcaaaaactacatcacgagatataaacactaccagtggcaggatctaaacacttaaactctttatgaagaatactgtgccataggaaactgcatattgtttcgaacggaactgtagcttatgtcactggcgtaagttggaccaacaaggacacccaaagattcgcaaggaattataatcaggctgctgatcaaagagatgttcgaagggagagacatactggaaattctactaggagtacaattaattaggtatactgtagaaacaaaagtttcatcccaaaactttaagggtatagatgcttgggctagaagggctagaccaacttctacaatatgatggtgttttccttcagtagaaccatttcgcggatatgtatgtgggcaagatacatgataagagatgctgtcttttctaaaggaatgtatttttttatactctcctccccaatcagtctgcatagctataattttcctaatgaacatgcattcaactagtttttggaatgcaagaaacttatgaaaaacttcagatttaaatttaagcaagtaaacccatgtaaacttactataatcatcaatgtgtaggatcgaatcacaagaactaagccaaccagagagaggggggggggggtgaatggttggtatacccaaaaaccaaaaacttttagcggaaataaaatttaccctcgaaatcgatggatcacgatctgaccgaagtagtagcgctgaccgaagtagtagcgccggtctgaccgcctggatatcgtcggtctgaccgagattggaactccggtctgaccgccagatcagctgccgctagctgtcgccgccgccggtttgaccgctcttacggcgctagtctgaccgccagtatatcaccggttagactgccgtaacccgatgaaacacaaattgaagaactctcaaagtagatgacaactttattgcttctctatgtgtttacaaagtgcaccaacagcactccttacaaaaatctcgactaaactcgaaacactaactaaactagcaactcaattgctctaaaaagcgatatcgggaagcctcacgctccccctctatttatacatgaggtaagcagcctaaatctacgaaccaaactcatactaagagtcctaaacaccttaggaaaccctctagtacaagaaagaaactttacataaccaatcgtaccaaatttggactccttccaaattcgactccacatcccatacgcacacaatacctccatcgtatgccatatggaatctacatcaaccacgtgcatcaactctagtgttagtaacccgcatgatatctgaccaccacggacatcgccttaccaccaagccgactcccggtccatcaccgcaaatactctcccgaggcatcgagtcacctacacatgaaacaaacaaagaaaccatattccgagaccaagctatcaccaacttgactcattgttagcaaacaacagtattacatacgtatagtatccatctaaaagccataaccatgaaacaatcacggatatccaaacaaacaacccgaaaccgaaaccgacacagcgtcggccggtcagactgcgggcaagccggtcttaccgctcacatagcgccggtctgaccggcaaccactgcctggtctgaccgatcccaacaaaacagcaaaccctgttcatcacctaaaaatcaattatctccaaaaccacttcgataataatctctaattatcaaaaccaataatcacagatgccaattgttcatcacagaataagaatcaaaaacacgttgatcttacaatctccctcttgatgaacacattggcaaacccattaaaaatgttttggtgtttggaaaaataaaaacagcacacttcgtacaaatgtacacatcgtgctcaaaaattcaaaagaaaacttctccccctttttaaaagaaagaaattcccaattgaatcaaaaacgtgctcttctcaaaaactcttttcttctcccaaaactcatctcttctccccaaaacttatctcttctcccccttttgacaatgatttcatcaagcataggaattatgtttattaaagtataagagcttaacatacatatagcatatcatgtcatgtgttgcaataaaaagaagatgaatccatctataaaataacaagcatgcattaaagtataaccatgaaccaaagattttacaattaagcttgaatcaacaataaaaattcatgatttcatacgatttaaaatgcaacatcttaacaagcacataggttcaagaataaacactaaacacatatacctattgcatttatcactctttctgaaataaccttaagcacaaaataacaaagagaatttttaaccttttcttttcttgagcctttttcctcatatttttctcttttttatattccgggtacgtccctgtcgtcaagactgtttttacggattcggcacccattattttgcttacatcgaatacgtccttgtcgtcaagactgtttccaaggattcggtattcattttttttcatatttttattctcttttcacaatgagcaattaaagctatttgaggaataacaagtcaataaagcatatatatagagcatttaaaaatcaaaccacatgctagcatcaacattgcatatttacttaattcaagtgtagaatttaagtgtcatgcatcatctcccttaaaagcaaaatctaaatctcatgaaaagactagaatacatacaagctatgttagagacaaataaaccttcaaagtattactagcatgcacaagaaaataccatatgtataaacatagctctcttttctcaattttttcattgtcatattttttgcttgataaaactatgaggtacaaactccccctcaaatcatgctaaaagaaagtcataaaaagcactaactccccctcaaaataccctccaattctcccagaacaaaactcaagaagaaatcaaggattttgaaaaaaacatccaattaccaacgatatcaccaaaattctcaaatactagcatatgaaaaagctaataaacaagagagtagaccataattatgtcaatccaaaattaaagtgatgttaccttgctatacaatcgtcatctcaaagttaaacgcacatggggagtatgccgtcaaaatacctacaaatgagaagatgtcgaggcctccgtgttggggttagaaataagaaattttggaatccaacactgagtcacacgaccactagaaccagtaggtacatatgcactaataaaatcagaatcagacttaccagaaaacttacccttttgcttcacaaaagtccaatttgaatttcgcgtaaaattgccccgaggccggtctgaccgccgctgtgcctgcggtctgaccgggcctggcaaccggtctgaccgctggcctgtctgaccgactggtcagtgtcggtctgaccgtggtcttcgaattaaaacccgatttttgccaacgtcgttttgtaaaagcaatttctctttcctttttctttttatgggcaagtctaaaacaaaaaccaaccaaatgtccatcttttccacaaaaagaacaagtgtacatttcacgataagtttgtgaagtagatagttttgaaattgatggttttgcaacaacagaaggttttgtattcaaaacatttgatttcgaagaagatgcacttaaagaagacatgatgccagtagatttaaacacagtgttcttaagctcagattcaatcaaaatttcacctctcctagcaacacccaaaacagtaggaggatgtctagaattatgagcataaggatcaaaacctaaaccacgattgtgtgtgctaaccttagattgatcaagaatcatgttgaggttctttttaccatcagaaaatctttgcaaagaacttttcaaataagaaacctcctgagtaagaatagcacaatttttgcaagcatccaaaagacctttttgttttctacaagttgagcaagaaaacacctcatcttgtttaacaatttcttccatgtgtttaacatgccctaaagcatctttcaacttcatctcattcaaaacacactttgaacaatcttgagaaatcaaaacatcattgttttgttttgccttatttgcacatgaagcattgaccaaagaactcgcacagaaagcaacattgtattttttcaacacattctttgtcaaaattaactcatcaacaacacgagcatgtaaagcaaatccaagagcaaaagaagattccaactttttagatttttcaatctcaaattctaattttttgcaattaatagaattgacatctcgcaaagcattaatttcagaaaacaaaacttcacaagatttacattcatcatctttaggaatcaaagattttaatctagaaatttcagcatttaaaatctcaatagtgtgatccttctcatcaagtgcaatagaacatgtttgaagtttcttaccaaatttgtaagcagtatattctaattgatcataactaagcttttcctcattatcatcatcagattcatcaacatgagaaatagcattacgagcaataaaagctagatcaacaacttgcttacctttgccctcatcttcatcttcagatccatcaaaaacttttatgagttcttgaattaaccactgcatgcaatgcttcttcttctccttctgcttcatgttcttcttcttgttcacgtcatcatccttgactctcccatcatcttccttcttgcctctcccaagcttaggacaatgcgagcgaagatgatcaagtgcacaacactcaaaacaacgattcggttctcctcttttcctgttcctaacatttttcatagctcaagaaaatttgttagatagcaaaaccaagtcctcctcttcgaactgttcgagttgatcatcggaaatggcattaaataaagcaagaacagaagactttgatgaaaaaacaccaacatccaaagaagatgaagacgaaaccaaagcactagacttagaatcacctttacgagaaagaatattcatctcatgagttttcaattttgtgtaaagcgaatccaaagtcaaagtagtcatgttcacagactcctgaatagatgtaactttcatctcccaaatagacatgtcaagaccattcaaaaagtggcgagaaatctcagattgtggataattagcatcataagaagaatcaacagatctaagatcactcaaaattttattaaacctagaaagatagtcatccaaagcttctccaggtttcatctcaaatttaatgtactcctttttgaaaagatcacgatgaagttctttaatgttattttgtaccttgataaaaattattcaaagcaacccaaatctcatgagcagtttgaagatgagcaacacgatcataatctgaacgagaaatcctactcaaaaaaaatattgcgtgctttgcaatttagttcaaaagcagttttttcagcagcagtattaataacttcaggaatcacataaggaagagaaacttttctccaaatatcataattctcagccataatgtaagattgcatcctactacaccaatgagaaaaatccgttgcatcgaaaatatgaggcttagttgtaaacttattagaagtagccatggcaaaaactctagatcgataaaaatccaaagaagcaatcaaggctctgataccacttgtaggatcgaatcacaagaactaagccaaccagagggggggggtgaatggttggtatacccaaaaaccaaaaacttttagcggaaataaaagttaccctcgaaatcgatggatcgcggtctgaccgaagtagtagcgctggtctgaccgcctggatatcgtcggtctgaccgagattggaactccggtccgaccgcctgatcagctggcgcttgctatcgccgccgccggtctgaccgctcttacgctgccagtctgaccaccgcttgccgccggtctgaccgccaatatatcgccggttagaccgccgtaacccgatgaaacacaaatcgaagaactctcaaagtagatgacaacattattgcttctctatgtgtttacaaagtgcaccaacaacactccttacaaaaatctcgactaaactcgaaaccctaactaaactagcaactcagttggtctaaaaagcgatatcgggaagcctcaagctccccctctatttataaatgaggtaagcagcctaaagccacgaaccaaactcatactaagagtcctaaacaccttaggaaaccctctagtacaagaaagaaactttacataaccaatcgtaccaaatttggaactctttccaaattcgactccacatccgatacgcacacaatacctccatcgtatgccatatggaatctccatcaaccacgtgcattaactctagccttagtattccgcatgatatctgaccaccacggacatcgtcttaccaccaagccgactcccggtccatcaccgcaaatactctcccgaggcatcgagtcacctacacatgaaacaaacaaagaaaccatattccgagaccaagctatcactaagttgactcattgttagcaaacaacagtattacatacgtatagtatccatgaaacaatcatggatatccaaacaaacaaccagaaaccgaaaccgacacagcgtcggctggtcagaccgcgggcaagccggtctgaccgctcacatagcgccggtctgactggcaaccaccgcccggtctgactagtcccaacaaaacaacaaaccctgttcatcacctgaaaatcaattatctccaaaaccacttcgataataatctccaattatcaaaaccaataatcacagatgccaattgttcatcacagaataagaatcaaaacacacgttgatcttacacaatgaagctcacataatacttccttccccccaactgactagagggtaggaccccagacatacactataagacttaggataaggtaattgatgactttttgtcttttaacacacatcatggactgactgattactagactcactagaacatggcaatttataacttctgttgactttgtcgacaagtactgaggaaggatggcctggacggttatgccatctttggaaggacggcttggtgactccataaacatgtttgatcgacgactggtgtggtgaaaaagcaggtagaggataaagtcctttataaccgtgacaactaagcggaattctccacatggtatgatccttgataaagaaaagttagagtataattcaaggaaggcaaaattatcataagcatacctatgggctgaaacatgtttttttttttggctctaggaacgtaatgaacattattcaaatagagattatgattgtgggtcttaacaacaaaacatccaatatgactaatctccatacctgcaccacttgccatttggatttgttcagtgccattgtacttctcacggactgtcaatttttcaagttcaccggttacatgatccatagcacccatatcaagatatcagttagtatctacaccatatgatgctgctgtccctgcaaaaacattcatccggctcaaacaatttatcatatatcgataccaacagtccttttgtagcatagttgacatttgggatggttgtcgctattgccaccattgttgcggcctctagagttgtcatggccacatccttgcttattgttgttgaagccagcgcatccacgagcattgctacgcccgcgtgctgcgttccacagcccctgttgccatgttgacagatccttgagcatcgtttccgtgatgcaatgaaagcctctgctcaaagcttaagagctgagcaaaaggttcgcctagtgtaacccgatcttgccaccccacaatagaggagaccacgggttcaaactcctcatcgaggctagcgatgatgtaggagatgatgtcattgtcatctatatgctttttagaggcgatcatgtcatcgacgagggcgtgcagtttccccgaagtatgtcgtgattgacatatctccctttttaagcacggcgtgtgtcctggaagagaacatttcctcctcaatataccatgtggctgctactgctagagatactacaatctggactagaatatctctagacatggaagaaagtaggtatcctagtacctgtttatctttggctatccactcttcctagtcgggactggaaaccatgatttcttttgcgccctccttgatcttgatgatgtggtggaggctttacttgctccggtgaggtaaccctcaaggcattcccctctgatgatggcgagaacttgtgccctacgtagggcttggttttctttgctaagtttctccgagaccgcttggcttactaggatttacgatcaaggatttgaacgaactcgccatagtggcgttgctcggcagattagatggtaggggatcggtagaaactatttcctgctctgatctatatagaaaaataaagaggaaagcggtaacttgccctcggttcacctgcatgttaatataggatggaaatagcctccatcgtgacttacaaggaaagcatacaccaaccaatcaaaacaaccagcctgtatatgatatcatctaccacatgagacaattactgaatacaagatagagatatctaattaaactacgttatctaactgctgttgagatatctcggttgacacatgactaggtcccccatcatcctcagacttgggaaatttgatgtgctccacaagaagccacacagcagtgaggaactcaccaccagtgctcagctgcctggcatgtgactcctcgctgcagtggtgcgccgcatagcacaacatctcgaaccacaccccagcaatcaaccccagcatgttgggcacattgcattcgttgcgaagtaggtacccagcgactgcagtcccatcaaggtaaacctggccgtgttcattatctgtgctctcactgccaaatttttggaacaacaagcttgctagtttcttgctttttgagcggttgttgtctccaccctccgagctactggtggagtgctcctgccagagttcaaccaaacttgcacatacctttgggtacagacctatgcgaattggcccaggtagcatatccgggtgctgcagaaggaggtacaacatgtagttggagatctccttgatcacctttacaacaggtttctctgtatgttccacctcttctttgaaacaacataggtagacatcggttgcgacatgccacacaaggatgcttttttcaaagtcaatgtctaccgtgctccagctgagttcctcatccattttattctcatagaggatgcacatacgccgtgcattcctgatgtcccctcggcctctcttttgtatctcttttagcacaaactccttgatatcacttgaaattgaggttgtgtttgagtaatgcagtttattaaaccagttctcaagccccactttcatggcaatcctgcctctcagatccgtcatatcacgggtacagaaatctagcaagttatattgtccaatagaatccagccataatctacttcgtcctgctttcacaatctgacgagtaaacattacagaattgcagggccaatcccatttcctagtatgcaagaacgcacatgtccaagaagaccctacagtcctcagcaatgttgtgatctcaaggaggatagccccgatcaacaaagcataagtgacggcaaaatcaactatgtgataagcatctctcctactgaaatggaatagcagcagtgcagcaactgtggcaggtagtgaaaagactcgaatgcaacggccataccaggtgtgtataaccgctgccttgctgtataaaatgtcatacatgagggatagctccatctcgattaacctgtacatgtgctttccaccatcaatttgcatggcttactcgacagcacttctttggggctctgacatcgaaagagcatcaacgaataggctcttgcaaaaatcgaacatgtaatgagcacccaacagagcctgctttagatctctgttcatcctctcttttctggcctgctcaaggtaaggattgtgagcacttgaatcatctaaaaaatcaagagagcttcggatgctgtccatgttagcacacatgaatgcccataccctcttcccatacttgacaacaccgacggcaaacattaggatgatggcctcgaccaaagtcctactgccggcaatgtatctgtagagaacataagcaacacccaacacctgcactgtgaaagttaacaggtggcgcaaccagagctggttgtcctccaaggaataagctgtgatgttatccgggccacccaggtgaagtaagaggaatgttgcccagaacgcattcagcaggtgctcacgtgagctgctgcttgtggtcatggatagctggccaagcgtgtagatggcagtggagtcagcagatagataggaaagccataggatgatccttaacactttgtaacctttgtgtcgacggatccatgacaagaggtggaggataacttgtagagtgaagctgaggatgattagtatttgaatttgccactctttccagagttgagctagtcctccggccattgctcctcggctcaactgcaaacaacatcatattagtgaaatactccatctaaaaccagtcagccctatacccttccataaaatgctcactattccttgaaaggaaagaggaatatgggtactcagtaacattctagcagaaaaaaatatttttttacgagctttaagcgctaaagataaatatttcgtcaaaaatattttgcgaaagataacatctaactcaaaaatactatcataatattaaaagcttattattgtaatataaaattagttatcaaggatttataagttaaatattttttgtctgggtatataaagtactccctcctttttcatactgtaagatattttagttatgttctaaatcatacttaggataattgactaagtttaaaaaatacaccaacatctaaaatatcaaagtaggttaattaaaatctacgattatatatgtcttgataatatatttattgggcattacagaggtcgttcttatgtataatatatatttctctaaatttcatggaagttttaagttgacttaaaagataaccaaaatgccaaatgaggagtatatcaagataaactgctgactaccttgtcgttctataggtgttactaaataacaacatgtcgaaccaaatatatataggggtaaacagagcactgcactgcagcagcttgcacgagagctgataaagtggaaaccacaaacacaatgtcaaatcctactttcagaagcatatcggaattcgcagtatctaaattaaatgcaactgcagggtgtgagcaattgtgttctaagttaacaatctggtatatatgaaaatttctcaaagatatattggtctaatctcttgagatgtttatagaagtaggatgtgcgtatgtggatttctagaagtgagtgtgcatgtgttatgaatggttacgtttgtactatgacttttttattttcaaaaaaaaaaaaaatccatgaacacattggtagtagccaagcgaagtataacgattgttgtaaaatctgaatagatcctgcttcctgccccgatgtgtctcacactcttgatgtgtactaatatcagagagaccacactggggaataatcctaggattgatttgtacttgtctttcaccatggcctgaacagcccccagccccaatttacaccggtctaattaaccgaatttaaccaaacagaaatcgtccgtacgttggtgaatcgcacattcagagaaacaccaattggaatccaacaatataagagaaccgatcacaggcgcaaaagctatagggctgtcagctggcaaggcattacaaacgatcactgcaaacatgctatagatatgcagtagaagcgtagaatataatgttcatattcgacagaaaaatcaagtgaaacgaaactaagagaggcgagaagaaggcaatatacacgtaccggcgaacgggtctagaccaaaataatcgatgaatttaccggtccctctggcttgaactgactgactgtctcccaattaagctcctattatactggagtggagtggcactactggacactaagggtgagttcgagaggaggggaaaagagaagattgggaagatacgcaaaaagaggtgagccattagtatatgattaattgagtataaactattttaaacttcaaaaatggattaatatgattttttaaaacaactttcatataaaaatttttggtaaaaaacattccgtttagtagttcgggaagcgtgcgtgcggaaaacgaaacgaactaactcatggactcctcctgccgaaagctccctaaggaagcaagaagagtagtatgttaatttgaatgcatggcttaatactggagtggtggatcaatccattttaaattggtactccctttattttaggttataagacgttttgactttagttaaagacaaattgttttaagtttaacttagtttatagataaatataataatatttataatactaaattagtgtcatcaaatcaataattgaatatattttcatagtaaatttggctcggattgaaaatgttactatttttttctataaatttggtcaaacttaaagtaatttgattttgattaaagtcaaaacgtcttataacctgaaatagagataacctgaaacagagagagtaactaactttgggctttcaataagtctctgcatgtgctcactttattatcctttcgcaaggcaaggctagatgactgtccaagtgagctttgtatgtgctaacatgtgcctgctgctttaattcaagtgatcatcagaccatatgtattgatgtgatcaagaagcaactaatatttttttgttaagagttttacccgtcgtcgtgcttctagtcagggaacatggccaaacttcgagaaccgccgaacagaatccggtaaaaagcaaattaaccatggaggctaagtatatatgtgtcggttattaatttatcctagctgagttaaattagcctggtttcgagttaattatccaactgtcattaataaggttattagcgaatagattatcaaagtaattagtatattttatttattttatttgttgagtccgaaaaagacttcgtgtgggcctgcgtgcatccctttattagggttgattggctgtgtaacggagtttttttttttttttttgtcgttctgttgagagatcttttggaaagcttatggtgatcccctctgggaaggttggagaggaaactaggtcaggagattactttcttgttcttgctgcttggtacatgttagtgccctctcttctgctcttgttagaaaacagggtagaagattattgtatcccgggttcggtgttcaactatttgtaagccgagctctcgattatttggtttattttgctgctgaattctatttaatttacatatacaagtccggtttaatgcgtcaagttactcactggaggtgtgcattaattagtggcgatttcatgctgcctcacaattttagaaagttaacttgtttaattgctattggtaccataaaaagggacatattcgggtactcgctgtcggtgctcatcatctatgttctttgcaactgtaaacaaatatgggcatgcatagaatctagtaggtaaagaagtcgtatatataaaaagtgctagaccaataaggtgagtacactgaaagttggattaacccagttagaaggaaaagaatgtgtgttgctaatttattgacattggtccccatgctggtggttataaaatttttggccatcccctttgttaatgggtatgttcaatcttctaatacaataatgcatgcacctagggatttgaattatatcttatgcttgatcatctacgaagaggctcttgcaaacattgaacaggtaatgagtgcccaacagaacatttcgtagatctgcgaatagaggagagtcaagggatgacacagactgcgtgcagcttctcttttctgtccagctcaagataacgatggcgagcacttgagcgctcaaacatgaggacgatggcctcgaccaaggtagagaacacaagcagcacccagaacttgcatagcaggtggcacaaccagagcctattgtcctcctaggaataatctgtagtgttgtctgggccacccatgtgaagcaataggaatgttgtccaggatgcaatcagctggtgctcacctgagctgctgctcgtggtgatggatagccggccaagcatgcagattgcagtggagcagcagatacatagaaagccagaggaggatccttcacagtgtgtaacctttgcaccgacggatccatgacaagcggaggacgataacttgtagagcgcagcctaggatgactagtatttggatatgccactctttccaaagctagctagctctgcagccatcgcacatcggcttaactgcaaacaacatcacattaatgaaatactgaatctagaaccggccagccttgcatcattagctaaaatgctcgttttttttttggagctaatacacttgttgttccctgaaaggaaagaggaacattctagtagcaattttttttaaatcaaatcaaaataaagtttcgtgagctctgagcgatgtttgaaaagagaatccaagcgctaaagattaatatttccttaaaatttgaaaactttgtcaatccataatttattaaaaattttctattaataaataaaaagggtagaatctaagttgaaaatactgtcataatgttataagtttgttataatacaaaattaattatcaaagatttaaaagctaaatattttttggctggatatataaagtactccctccatttttatattgtaagatgtttttgttatgtcctaaatcatacttagggtaattgactaagtgtatagtaaaatacaataacatctaaaccattaaattaggttaattaaaatccataattgaatatgttttgataatatatttattgggtattatagaggtcatccttatgtataatatatttttctcaaaatttcagttaagttcagagttgacttaaaacatactgtaactaccttatcgtgttatcaatatatttttagaaggtgtcgctctaaagtgttactaaatgacaacatatgtccaacgaaatatatatacagcagcttgcacgagagctggtaaagtggaaaccacacacccagtggcacgccttcgggcgatcggcttgctgaagaacaccactggtctgctaccttcctggagcacagggcccatgtatgttctcgaagtctctctcgacgatgaagtccatgttgaagtctggtagttgaagcactagggtggccatttgggcttcctgtagtgcatggaacgccgttccgccgcctcttcccagctgaagaccaccttgcggagtagtgttgtgagttgcgtggcgatggagccaaagttgtagatgaagtgacggtagtagcctacaagcccgaggaagccacgcaccgcccacgccatcttggggatcagccaatcctagaaggccttgattttctggtggtccatcggcacacggagcctgagatgacatggccaaggcaggcaatggaggtgaggccgaatttgcacttggagcgtgcgaggtgggaatgatgatcctgcagggtttggaccatgccgagctgtagattaggatgtcataaaaaaccaacatgaaccatcgaaggaacggaaggagtatgtcgttcatgagcgtctggatggtggcagaggcattggtgaggctgaacgtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaggataacaaaggatggcgtaatagggatccatttgcaaaagcagcatttagcaaacatttgagaatttaataaaacagttaagtattaattaagcaatattaatccaacgctatacaacataccctgttgtataggcccatccattctgaacaaccatcccggctgcacaggtctatctccaaaccaggaatgtaccattccaaaccaggagctaatcaaattattaccaatttaagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggataggagttgtgacaatacccctcatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattagttaattaaccaatcacgattgtccatcgtgaactatcattaagccatcattaaataatagtgagtcataagttatcccataagtgtgctaatgtttctaagcagggctaagcaattatatctaatatctagttgaaccaatatacataaagctcaactagtcaaattataataacccaaggtatcaaggaataaagtaatcaagaacaaaagggctataacaatgaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttctccgacgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaggatttattgcgtcagcgggctagggtttcggtggaccgggcacacgggcggaggttcacgcgaacggacggccgagatcgaaccaatccaaaacggacgaccgagatcgaacgggtccacgaccggctcacggcggtcgaccccgatgacgtcagcggtgacgtcaccggcagcggcggcggctcggcggagcaaacggctcgggcggcgcacgctcgccggcgaacggcggcgctaggacgcaaacggagggcaccagcacgtagaggacgacgcggcgaacacaccggtgaccaaaacggcggcggaagaacgacaaacgacgacggcgacgaggaggaaacggcggaaaccttcgggttgacgacggcgacgaagctccggcgatctccggcgacggcgaaggggcggacgaggatggcgatgcgacggcgaagacgacggcggccttccagagcgacggcgacggctgaaacgacggcggcgcacggctggagcggcggcggcgacggcaaagctagggcacacggcgctagagctcttccggcgacgagaggcgaaggcgagggtggcggcgggtagaggagacaccgggggtccttttaaaggggctcggaggcggcggcaaaggcccacggcggccggcgacgaggaaggaaagatcaggaagaacgaatccgagacgaactcgaatccaactctttccaaaacgatttagccaaagattccaaaggagaaaaggtagaggagatcccgaggatcatttcccctctatcaattcggccggagaaggaaaggaacgtccggatttggaaggagacggcggcggcggcgcgctagggttcggccgggcgacggcggctcggggaagacgaacctgacaggtgggacccacctgtcagcgaccgaacgcgcgcgcggcgcggctgtggactgggccggactgggccgaggagagagaagagaggttttgggccgactttcggtccaaagccaaaagaagactttttaaaacctttttcaatttaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagatcttctctccaagactttttaaaattatttctaaaaattccaattaaacaacaatttatatattttgaattttcagggtgtgacaaacctaccccccttaaacagaatctcgtcctcgagattcggaagaactggcgaacagatacggatgagctgacttcaattcatcttctggttcccaagttgattcttcttccgagtgattactccattggactttgcaaaaacggataactcgatttctggttcttctctcattgatttccaagatacggattggtttctcaacataggtcagatcctcttggacttctatctgttcaagattagcttcttcagtaggtacccttaaacactttttcaattgcgacacatggaacacattatggactcctgccaaagattgaggtaattccaactgataagcaacctctcctcttctactaatgatcttataaggtcccacaaaacgcggtgccaattttcctttggtgtgaaaacgatgaacccctcgaagaggcgtgacacgaagatacacataatctccttcttcaaaactcaaatctctacggcgattgtcggcataactcttatgacgagactgagccacacgcaatctttcttgaatgatctttaccttttcttctgcttctcttaggatatccgtcccgaaaacctgacgttctcccgtttgatcccacaaaagcggagtgcggcacttccgaccatacagtgcttcgtaaggagccatctgtagactagcttgataactgttgttgtacgaaaattctgcatagggtagattcttatcccaacttccaccgaaatctaaagcacaagctctcaacatgtcttctaaaatctgattcaccctttcggtctgtccgtctgtctgcggatgataagcagtgctaaagttcaacttagaacccatctcttcctgaagtttcttccaaaaatttgaagtaaactgactgcctcgatcagacactatcttcttagggacgccatgcaaacacacaatccttgccatatacaattccgccaagcgacttccggaataagttgtctttaccggaataaaatgagccactttggtaagtctgtcgactatcacccaaatagagtcatggcctgatgacgttctgggtaaaccagtaataaaatccataccgatttcttcccatttccattcaggaatcttcaaaggctgcaacaaaccggcgggtttctgatgttctgccttgacttgctgacaaacatcacatactgctacgtattccgcaatttcacgcttcatacttgcccaccaaaatctttccttgagatcctggtacatcttagtactaccagggtgaatggagtataaagtatcacgagcttctttcagaattgcatctttcaaatctttgttgtcagggacacaaattctttcacccaaccatacagttccttgctcatcctccaagaaaccgatagcttttcctcttctcatattcttcttgatctcttgaatatcaggatcattaatttgggcttctctaacttgatcaattagagtgggcttcgcttctaaggctacaacgaaacctctattgacaattcccaaatttaatctttcaaattccttgcataattccaatggcaactgtcgtccttccgtagcattgcaataacctttcctgctaggagcatctgctacaacattagcctttcccgggtgataatgaattcccatgtcataatccttaattaattccaaccatctccgttgtctcatgttcagatccggctgagtaaagatatactttaaactcttgtgatcggtgtacatctccgtacgagtaccgaaaagataatgacgccaaattttcaacgcatgaactactgcggccaactcaagatcatgagtagggtagttcttctcatgcggtcgtaactgacgagatgcataggcaaccaccttccaatcttgcatcagaacacaacctaacccaagtttggatgcatcacaatacacctggaaacccttctttggatcaggcaaaatcaaaataggagctgagattaagcgacttttcaactcttgaaaaatctgctcacattcttccgaccacttgtacttcacatctttctgaagcagtcgtgtcatgggcttagcaatcttggaaaaattctctataaacctccgataatatcctgcgaggcctaggaaactgcgaatctctgaaactgtctttggttgcttccaattagttacggattccacattactaggatcga

SEQ ID NO: 75082 - DNA, 3629 bp, Oryza sativa
cttctgccaactcatgggctgccattcgatatggtctcttatggatcggagttgttccgggtaccaaatctattctgaactctatatcccttttgggcggcattccaggtaaatcatcggggaacacatcggaatactcccgaactataggaatctcttccaaagttatctggttcagtcttgcttaaagactcagaagacaatgcatgaacagttacaactcgaccatcattgctggtgagagttacttttctgttagcacagtctatcacacctttatgtctggctaaccagtccatccctaggatgacatcaaggtctttggattctaacaagataagattggccagaaatggtactcctttaatttctattctgaccgaggggctacgttgcaaagaaagtgcttgattacttggggtactaaccatccatggacatctaagatcttctacttccatcccatgatttcccgcaaaactcatagataagaatgaatgtgtagcaccagaatcgaaaagtactgttgcaggaactgagttaataaggaacgtacccaaaatcacatctggagcatcttgagcttctgcagcagcgacatgattgacacgggcctttgatgctggtacggtagaattgctctgggcagggacaaccttcacgcgatggggcttcggacacttgtcagcataatgtcctgggtctccacagttaaaacacaccacgggattgctgccttgctccctcttggcaggctgttgctgtgttggagctgcaacagggcgtggagcttgattgcggatgttgttgccagcattgttgttgaagaactgacgctgcggacgaacaacagacgaagaacctccctgtggcataggctggggtcctaaagtaagacgcggcttctgattactcccctgttgtgccttgaagtgagcaatccggcgtttcttttgctccatgcgattgttcttgtcctcctgacgaatagccttatccactaacttctggaaatcaggataatctccagtcatgagtgggtaagaaagctcatcattaagtccttccaagaacttctcctgacgctcttcatcattgcgcacatcttccggagcataacgagcaagacgattgaactcgtgcagatactccgtaacagagcgagatccctgagtaagcgacctgaactccttcttcttgagagacactactcctgatggtatatgcgtctttcggaaagcagcggtgaattcaagccaagtgataggttcagcagtagtcctgttaaggcggaagtgatcccaccattcagaggcagggccatgcaactgatgtgatgcaaatgaaaccttctcctgatcagtgcactgaagcaaatccaacttcttctctatggcatgcagccaatcaccagcttcaacaggattagtggtactagagaaaataggcggcctcacacgaagaaattctgctaacttgttctggggaggtgcatggttatttccctgattttgctgattctgaagttgttgcatcatcatgttcataagctgagtctgttgagcaagaacttgagcaagagtgggattctctccattgttattattggggttattgggaccattcccgttgctgcgagtattcaccatctggcatggacagggcacaagaagagaaaccggggaaaactacttaggacagagaattactttaacttttattgatcttaactgagttttattattacaaactgaagactctcacacctctaaactcaccaacttcctaacactcaaaagcaaacaaacgcatgcacttacatcccaccactgatgtaaatcacatgcaagacccacacacacaaccaaacttaaagcaagcaaactaacacaacgatctaagacaacgacttaacaagtcactctagttcttccaagcatcggaggtcgattgaaggttcgttcggctcgtcttcatcatcttgagttgctacccactcaatcttggaatggttgcgcttggattcttcttcttcatcatcacttatgatgatgactggaggatctgctaaggctggggcaacttctttctccaccacacggacctttggcgccaattgatagcgagggacaaatagagctctcttccttgcggtaagacgaaccctggccttctgcggcggcgcttctcccttcaatgcggctagttccttctccaaacgatccaccttgtcttctagcttgcaaatcttaccacgattccggtcttcacgatcttgagccgctaacacagtctccgcacgactttcatccatagcccacagcatctcaaccaaatgccttatggtagcatcattctcaattccttcagtctcaaggtagctgccacggtcacttccctgtggttgacgagggtggtagcgatactcagtgtcggccaactgatcactgtagcgatcacggagctctcctatggcgatccttgccacctcctgacatgcatggatgtagtttcttcctccagcttcgaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaatccctcgacaccaaacaggtactcaggcttgtagcgcggcatctaaatacaagtgaaaggagagagttaagacatctatccaattaacagcacaagtttttggattaatttgaataaagtttagaaattcaaagtaaaaggtatgtaaataaagtaaaccaagcttgcaagatgagttgaaatagttgaaaacaagtttacaaattttgtacttttgaataacaggtttcaaaagaaatgaaggagaattttaaaatcatcatgctaaatttattttattgcagcaagattaaataaaacaatattgtaaaacttttgctgataaatgagccattagtacagtaatagatgtacagtactaataacactggaataaattttgaatgagaaccattaaaagagattatgaagtgcatgtgccattagtttggtttaattaaaagagagagggaggagaacagttctacttttccaatattttagagggcttctatgggtaaccatttggcataacctagggtcaaggaggctctgataccaacttgtcacgcccggaatttctatccaaaattccaaacgcttaaatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaactaaataaacggcgcagacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaggataacaaaggatggcgtaatagggatccatttgcaaaaacagcatttagc

SEQ ID NO: 75083 - DNA, 876 bp, Oryza sativa
aggacgacgcggcgaacacaccggtgaccaaaacggcggcggaagaacgacaaacgacgacggcgacgaggaggaaacggcggaaaccttcgggttgacgacggcgacgaagctccggcgatctccggcgacggcgaaggggcggacgaggacggcgatgcgacggcgaacacgacggcggccttcccgagcgacggcgacggctgaaacgacggcggcgcacggctggagcggcggcagcgacggcaaagctagggcacacggcgctagagctcttccggcgacgagaggcgaaggcgagggtggcggcgggtagaggagacaccgggggtccttttaaaggggctcggaggcggcggcaaaggcccacggcggccggcgacgaggaaggaaagatcaggaagaacgaatccgagacgaactcgaatccaactctttccaaaacgatttagccaaagattccaaaggagaaaaggtagaggagatcccgaggatcatttcccctctatcaattcggccggagaaggaaaggaacggccggatttggaaggagacggcggcggcggcgcgctagggttcggccgggcgacggcggctcggggaagacgaacctgacaggtgggacccacctgtcagcgaccgaacgcacgcgcgcggcggctgcggactgggccggactgggccgaggagagagagaagagaggttttgggccgtgtcacgtcctgataaattcatcccgaattaaaaatcattctctaaaaggaataatagaattaattaaaattcgaaaagaaattggcaaacactaaaaatacgtacaagaaaaattcaaatgtgacccggagaatttttgttaaattctccttggtctaaaa

SEQ ID NO: 75084 - DNA, 10783 bp, Oryza sativa
cggctcgagtcgacggggtcggcggcgttccggcggtcggcgaccgaaacggaggggtggacgaggtcgtcgacggtgcgacgaagccggaggagacgacgccgaggtgggggacggtcccggcgagcagctaggcccagccagaggtcgatggcaacgtcgaagagagaggacgtcggcgcgagatcgattctgtcgagcagaagtgcgactagtgccggaaacgcacgaggtaagtccggggagggttcatatagggttggcagtaaaagagtgcggccgtcgggtgtcacgcccggaaattccctagtaatttccgaacttatttgtgcataaaaccctcgtctaggaatcagccgaggtacacaaactgacaattcaatatgcgaatccatgataataataacgttacatactcacaaaagaaaagaaaacagcagcggaataacggtctagcgatggcttcagctccactctcacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaacatttaagagaagtaaaacagtagagtaattaatcatcaattttaatcaacactgaacagcaccccaatgctgcacaaactccaaaccaggagctaaacaaattattaccagttattgcatcaataactatttgtgagaggtttgagactaatcacgaaaaatattgctcaaccagcccataaccgcgggcacggctattcgaatagttttactctggccagaggtgtaccactgtacccacaagacacgattccacacatgttgccatgccccgaagtaccaccacggcactgcaaagggggaaatcgtgacaatacccttcgcacaacacaactcaccatagtgcaccattcctggattataatcaccccctcaaaaaccaaaggcatggactccccagcgacccccacggacttctcgccgcttctcagtctggcaccccgtaatgaaccatgctatacaaaagataaagccgttgcccacgctggcttgtggttggtacggttaatgtttcacaacagtagctcgcgaaccgatccttaattgtcatgagcacgaacttcaaaaccatgtgctcacaacccaccattgacaagttttaattatcaattaattatcataacacgattaaccatcgtaagctacatttaaatctaaccataagtaataatgtaatatgattcaccccattaatgagctaatgtttctaagcatggctaagcaattatatctatatagcatttagctgaaccaaaccaatatataaggttctagctaatcgaattctaacccataggaaaataaagtcatcttcggccaataattaattgggaaaggctcaccacccgatgacattcgaaaataatgcataagttgaaataaaacattagctttaaatgggttcaacatgctcaaagggtcgtttgggatctgtgtgacttgccttgagcttcatcaagcgcttctgaaccttcctcaacgaaaacgctctccttcagaacgtcggaaactaaagcgaaagaacaaaatcaacaaaacagtacaaaaacaagcataaacaatacatgtggatatttttaacatgtagatctcgattttagaaaaatttagcaacttgaaccactcaaatcggagttacgatgaattagttatgaatttctgaagttttaatctatttgcatctagaaaaaaaactggaaaaagaaaatatgacgtcatgctgacgtcatcatcgcgcaatttcacgggcaacgaccttgccggcgatagagaggtcggcagggctatctaaagtcatctacacgtagaggacgatgacgcgaactcaccggtactagcaaacgcgatggacgacgacgaatggtggccggcggcgagctctagcggcgacacggctcgggtcgtcggcggcggcggctctccggtgaccggcaacggcggcgagggggcagccgaggttccccgcctccgtgcgcacctaacggcgacgacgggaagcggcggcgactgctaacgcgatggcgtggcgcggctgaacgtcggccggcggcggcggcggcttggacggcgtggcggcggcgctacgggggacaagaaggctcgggagttggtgcaaacgaaagaggacgccaaggggatgctatttataggcttggattagagagatcggactccaaacgagaggatttgagccgaaaaatccgagggttagttggagagataaactcgaaaacgaattcgattccgcgttgatttcttcgggataaagtgcgattcttggggggaaggatagaggaggataagaggaatatttcccctcaactaattttgcaaacggagcacgggatgcggcggatttggtggaggaagcggcggctgcacaggtacaggacggcagctcgggcttctgtccaagcttgaagatgagcagtacaggggacgcaaattagactttcggctgggcttctacttccaaggactgattaaaggagggacaaaaagcagacgtcgggaaagagagcgaaaggactgcaggctgagaggagactgggccgagagtgagaggacttttcctaattcggcccgaaaaggaaaaggtgaattttaattacttttccaattaaattaatcactgaaatgatctttgaattgttaaaaatacttctattgctcaaataatttcaagaaaaatcttgaaaatacttggaccctcaaagtatttaacaaaattataatcagaccatttaatgattaatttaatatgtggataattactgaaatgttctttgtatgattaaaattaagaattcagctccgaaaaatccgagaaaattccagagagtataattaaccatggaggatttaataaaaattaaatccatccatgctttatatttaggaaattttatttcccacatttaacttcacttgtaaattaatgaacatttaatataaattctaataataatttattaaataatttataaatcctgaaacgaaaatcaggacgtgacagcgggggaggaaaccggcgcgggagacccggccgccattaatggcgccggcgggattagtggggggcttccatccgaaataaagagagagagaggggaaaatggggggaaagggagagggaatcaggggaaatatttcccccattcaattttgaacgggatcggcggagcacggcggagcacagcggagcgcggtggatttggcggcggcgggggcgctaggcgcgagcggagggagcggcgcatgcggcgggaggaaggggatgattggtgggccccacccgtcagcgagggtggcgggcgggcccgtccgtcagcggctgcacgtgcagggagaagccgagtggtccacggggaagaagagagaggaggagatgggccggattcggcccaagagagggaaggaggatttttagaggttttctttttataaaaccttttcaactttgtttatttcttgataattattatttgtgctctgaaaattccactaaaatttatttacacattttaggcttttaggaaatatacaaaaatcctccaagccttttttgacttttaactttgcacattttaatttttgaaggcttttcactaggattttaattattctaggcataatttaaaggatgtattttagggtcgttttggggcgtgacacatttgtacaaccggggtaaaagtatatcaaagatccgtctactccatgtttaagaatatgcccatgcactagatagttctcatcaatacagggacgagctgctgagatgaaagcgatttggtcactaacgacccctagcactttcgctatcctagtaatcagagaaatgcactcaataggagcagaaaatcttatactttctaaccattcccttatcatacatttcacaggagcaattttgatttttctaaccatagcaaacatgataattaattcatcccccctaatgggtctaagatcacctctaggaaacaaactcagagcaatccacttgtgcatgagcctaactataggattatggatatcatttgtcctaggtttcttgcaaattggagcaccagaaataccttcccaaaacctatttttctcgaacccagaaattcctttctagagatcgattttacaagaatcgtgaaagccaaaaagtgtactcaatcctttccatgtaagtgtatactctttatggaaaaagcgaaaagaaattccatcttctatttctttcaaagtgcacagaaattgcaaagtaaccaaacgagaaccaggctcatctaccacaagaaatctctgccaaccaacagctttccaaatagcacgaaaatcaacatccattcctatctttttcagcagctccggagagtattctcgcgtgtgagcatgctcccggtcgcttagcatgtagtaggcttgtctttcctgattgtcgacaaggtcaaggtcggcgtcgttcaggagacatcgcggagcttcggcatcttccatcgtgacatcagctgatgaacaagcgctagactcatcatgattgacttgacgaagagccggaccacttgaatagacgaggcagccgcctcctcattctgcacaatggagcaagaatggtctaactcggcgggggttagaatagcaagagtgtcacacgccggttagtttcaccaaagcaacatgtatatatgcagctaagtatttgaatttgagggaaacaatcaaagcttgaatgaacttgagagaaaactttggagagggaatgaaaatgtgctgaaatggggtggattcccctctcccggccggttggcttaagtagtgcacccacaacggtcaaaactgacatgtggggcccactagccattgcctcaaaaaagggaggcagccgatcgaacccctggtgggcccaaccggccccactttcggccgttgggttccaacggtcagtgtggtcgtggcacagtgaattttcgttgaaaattttattttggtttgtttttaaaaattcatttgaagaatttcctcaaaattctgaaaatcctaaatgcaattatgaaattcaaacatgtgatgatgcaaaaatttaaattattgaaaacaaatatgcggatacataccaatttatgtgttggtgaaggtcgcatcattttaagtccgacgtgcaagaccgtaccacgtgcaagaccgtatctcctttcagttcagtgcactgattttccacctgtctccggaggtaatggagtaggcgtctttgacttttctttccacaccttctttggttttggtgtggaagacggcttcgactgctctagcttcttggccagtgtacttaattttaccagtatcttccaataacggttcgtgggcatcgttgtttccttttccaggaaattctgcatgaactttaccaggctatccatcttgggtggctccacttcgaccacttgaatattctgcggatttggcccgtactttattctgaccatggagcattgttcagtccttggctgaaactgaaacttttccttcttcccgttgatatggaaacggatacttctcgtttccacgtcaatgttggctcctgcggtgctaaggaacggacgccccaggatgagcggcgtctcttttccattgtccatatccagcaccacgaagtcaaccgggatgaagaaatcccatatcttgactagcatatcctccgcaatccccgtcgggtaacggactaacgagtcagccagttgtaggcgcatcggtgttggtgccaacaccgtgaagttgagcttgtcaaagacgttctttggcatgacgctgacactagctccgagatcacacaggacttggtcaaactgctgtgccccgatcgagcaggtgatcgtaggacaccccggatccttcttcttttctaggagcttgtggagtatgacgttgctgcactgctccgtcagcttaaccacctacattgttggatgcggtctcttgttgttgaggatatccttaagataacgggcatatgttagcacttgcatagcatccaacggcacgttgatgtgaatcttctggattacttcaacaaagcgagcgaactgctcgtccactgacggtttcctactccgttgatgaaacggcagcaatcgtgtgtcgcagtattcctgcggcacggccttttctggctgaacctctttgtcagccgagttactcgatggcgcttctctggcaacccgattagttcctgcagggttaggatatggcggatcacgagtggacttacctcctctcgtcgtgatcgccatgacattttcaatggaggagtcggtctgctccggaatcctcccagtttcagttgcagggactaaagaagccaattaagctagctgggtttttatcattttaatgaagctcagctggttttgaaaagtagaagcgaagccatctagcttaacattgatgttctctaggatcttgtcattggcagctagctttttgcttaaagcatcagtggttttagcttgcgcaaaaatgagatcctttaaggagggttggttagagaagttaccgttgttgtttcctccttaatagtatgggtgtgtctagttccacccttaacctcctcgtggacgattcccgttgttgttgttgcccatgtacatcgcatcctcacgagtttctaggcagtcgttcccagagtgacccgtgccgccacagacctcacacgtgacgtgtgagtccaaggccttgatggtgccttgtggccgtttgtcgtggtcgtccagtcgtttcatgaggaggtccagcttggcagcgagtagttccgtttccttgacgaagcacatacctcgctgatgggtttggagtcgttcctcgctccaacccatattggagaccatcttctctattaaatcaccggctcctcgaaccaccttagagaagaacgatccttcagctgccgcgtccaggtggtcacgggacattggagtgagtccattatagaaattctgcagaatcagccagccgtccatcccatgatgaggacagacggccacatactcctgaagtcgttcccatgcttcaggaatggactcaacccttgtcagctggaaactagaaatccttccaccaagggcattggttttgcccatcggaaagaacttcgagaggaatgccgtagagcatttgtcccagatgttgacaacagcacggttggcataaaaccattgcttcgttttcccgagaaggaagaacaggaacagccgcagcctgacggcgtctggactgacaccctttataccctttatagtgtacgtgatacagatctctaggaactgctgtagatgagcattggcatcctcgttaggctcgccacagaatgggcaagcttgcgccatcatgatgaggctagacttcaagtcgaaatcaacgtctcccatgttgatctgcggcccaatggccacattgccagtagagggagcagcgaattcgcggagggtcttgtcagccatagtcttgaaagtctgtggcgctggtacggctggattttttgtcagtagagttttctgcggagcaatgaatcgcggcctgatgctccggaagaaagcttctggattttctttgaagttttccgccaagttgaaaccagtcatgcactaccctgttttcacaacaaaagtgaaaacaaccaaggttagcctgcaaagggcagtgattatacagaggtaaatataaagtattagttcatgtaatctctattatgaatcttccccagcaacggcgccagaaatacttgttggtatttctaaacgacagtactagaaatataattcccagcaatggcgcagaaatactcctggtatattatggttacagagttcatccgcaagcgcacagatataccattgtagcatttcacccgagagtattccaagggtattgtatttattttatcccgtgggaagatcatgtagagagaacttgactaataatttatatattacttgtgataatcatattctaagcaggggttaagataatcctagggtagagtgacacacaagcattatctacccattctcatgatatattatctaagctaagtggaaagaaaagagaaagaaaatctattcctatacttctagtatacatagtatacatacattctagttaaccgacatactagctaataccctctatccgatgccctcctagtactttgagaagccacccttgactgccgagttccttacgacagcccgtcatgaccatacaaccggggctaaatacggaggaataccctccctagggaatgaacttaggactatatacatgcgtggggaatacccgtactaagctgtcaccatcagcggcccacctctcatccgcagcatataaccccaaataatgatatccgtaatctagacaccacgtctaaactaccagatactactctaatatcatcgtcatgacatagagtaattgcataagcaaacattatacccgcaccaaagcatctcccagataagctagcagtatattcaatataacatgaacataatataaagtaggtattcatatactcggaaagtatttcaataccataaatgtatatagaagagtattctaaataaagtacaaagcttacaaaagagaggagaagagctcctagagccatacctgaactcttccgaaggcttccggactcctgatttctactctgttcctattccactagcttaagaatactaaactaacttgagagaatatgagagagctcttgcttgaggtgtgtgagtgaagtgagaagaggaagtccttttataggcaggtaatgacggttgtgatggttggaatggtcggtaataccctccaaccgtcattggggatcaatcccaaccgtccagaagaagccctgcatccaacggcgacgagggaggttcagccgaacccccttgttcggccgaaccaggggccggcccaaccagcccaagttttggctggcggcctcctccgttgcttcacttcatagactggtgaattttggcccaattcatcgtgtcaattctgagttcttggtccattcatgcataagtctgattcttgacatcgtccgattgatttatcatctgagttgatgtcgattctcctccactttatggttattctcttcaaaaggttagtaaacctaatactagtggaatattattattctaacttgtatatgcattgcaagcataactagttctcctttattttggtaatattgacggacgaaattgatcgataacgaccgtcaacacacctacagctagacaactcaactaccgagcgacgggacaaaacaacggctaggcaaagacgcacggcagaggcacgcagcgcaacggtgcggcagttggcagcgacggtggctcagcgcggcagcggctaggcggcggcagcggccacgacgacgattcggccaactacgacacaggaacaaaaccctaaaaacaggagggaggttctcagcagggagcaaaaccggcagggaacacgacgacgacggcggcgctagagaggacacaacgtgctaggttagacgtggaaacaattgacattgggttaaccaattcaattgagaggggaaaatagattaccggcgacgcgagggcgacgatggcggagacggcgacagcggcagaacaacgctagggcggtggcggcggctagcttgggcggcggtggcgcgacagctagggtagctagggcagaaaagaaagaaaaactgggggagggaacacttaaataggggaggactagattaggaaagggggagtcatagatggagtaggactaggacggaggggaggagactgactcgggcaaggggagggggagggcgcgcgcgccggaaggagagggggagggcgcggccggctggggagaggggaaggaaaaaggaaagtaggggattaggacttacccaaaaaggaaaaacaatgcggtgctgttttaggaaagaaaaggaaacggtcccgcgaactgacacgtatacggttcgtcatgcaaaacgaaaccgcggactgagaggcgagtgaattgggcacaattcacgaccaaaggcaaaggaagaaaaattaacttgacacttttaacttagcaacattgcctctggtaatctgatatttactctttaaatcctgttagtgattttcagagcaaagagaattagaaaaaaattctccctgacaattccaattattaaaagtactgttaactggggttttctcctggttaaccaaagcaaattcttgagatcatttattagtgatttggaacctaagggaagggaaaactccgggtgtgacagggtcgttcgacatcatcgacacctcgtcacacaaagctatcacacttcgtgacgacttagataatttgttcaaggtaaacggccaacatttaaaaattttccttgagtggaatgaagttttcgatgaagaagtagacgttattgaactaatcgatttcgagcctcaatgaactcatctaaaatttgcttaaattctgtaaaattgtatcatgtcttgcttgaattaatttagtgtagacgtgtgaaaaatttagaggccgactgagcccaccagggttc

SEQ ID NO: 75085 - DNA, 125258 bp, Oryza sativa
ggacgttttcattttcgtcatcattttacttcttccgtcgccgactggttatgctgtcgttgactggtgtttttatcttcacaactacgcgtcttcgctattggtttgcttctgttgccgctgactcgtgttcacttcatcacgactatgcaactctgtcaccatggtggagtgacttcatctttattatcttcggcaccggcaaactctattgcctctacttcgcaagctttgctgcttcaccgatcaccacgtctacaagaacctcgacatctcggcatgcatcaacaattatttcaccggcaattttggcttctccaaagtttctcaagtatcaagtccaagatttaatctaaatgtctgggagtttggagtcatcaaccaatcaactcagattcaatgagttgaacaacagtattttcctccaagtgaagatcttctacagctacaacaccaagttctaccgtcatcttgataaatcaagaggcgttgcatcaatctacattacgcacacgctagcatcaaggaaactacttgagctttgatatcttctcaacggtttgctggattactgtctctgacatcatcaccagtacctctaattcatcggctttgatgtctccgccgtcgctattgggagactatgtctttgtcttcggttgcttccgtcattgtccacttgttatttcgctttcacagttggcctactacgcatttactgaaggatgaccttgccgttatcatcggctgctacactgctattgactggatcattgacatcgtcatcttcataaacatcctgtcaagcctcttcggctatgcctactctgctgccgttggtgggcaacttcgtcatcataactggctgtctccgttgccaccaattgtcattatcgccgattgcgtttgctgtcggcaattgttttcttcttttgcatgattcatggatttcgccattgccattgataagcgtctacattttcaccatcggcttgactccgccgttgcccatggtgtcttcgctttcacggctgacttattatgccttaactgatgggcgtcttcgtcttcttcaccgggcgcctcgtttgttatcgactgattatttcgctgccatggctgcacaactctgttgctgttgctgggcgccttcgtctttactgctgactgacttgtctgctgccgactggtttcgtcgcctccatgggtatgcgacttcatcacctttaattggtgtcattgtctttaccaccagtaacatcttcgtcagctttgacgggtgatatcatcttcatgttggtcatttcgtctccatgccaactgtgtcagttgccttcaatggacaattttgactacaacagaaggacaagctacatcctcggtggcttattatctcaaacacaaggatcataccttcaatttggacttgtcacggatacatgcaacgtgaattcatgttcctgagactatttcctacgctcaaagactgaatcatttattatttcccgtgagggctatcacctaagtacttgtgccagtcgggattcaattatcacatctactttggtacaacccatgagggagaattactcaaattagaagccactcatatgagttacactcgatctacatcaaccgggaaatttatcactcgggatcatattaattggcgtgctctatttcttcatattttaagggtatcggtagacatatttgaggtctaggcctaatatgtctgcaacctatatttttaggtgtggcatgtcacgttcttttagggacttaggcattttttgcttaggcaaaagtgtgcgtgattatgtgcccaatacctcaaaatccttttataccgtagttactcaattttttaggagttggtataatgcattttaaaaggtgccgaatagtgaagtttttcattgctgcccctctgacttttttatatagtcaaagcgctgtttgggtttgtaaagcaattgattggacacaatatcattgttttttgccacgtatgtgtgcatttttattgaccaatattatggcttaggctaattatatattttggtctttttctaggcggttggtaaatgctttatgagtttatttactcgaattttacaccacatatgccgtatatttccaggtgtagtgaaaccatgtgtcttttagggacttaagcacatctgttaaagcaatgtgcgcatggtgtgtgtccaatacttttgaaatttctttattcacagcatataagcttctttatagctgttttgctatgtgaattttcaatgatgcacgcatcatattttacaaagcagtcggtatatcactcggatcatgttattcggagattcacaccgcatatactatatattgatatcaagtcactcggttgactataattatcaaaaccactcaattgggtggggtatgtactccttgactatatgctcagtttgttcaactaaccacatagttgggggctacacctattaggtgcatctagtcgatgcacctaagtttatatttaattattttttcagccctccacagtcttctgatttggtaaaaagtactcgtgagaccatggcaaagatgattgaagcactcggctttggagtaatctaattcaagagaagattatcttttcgactgtgaaggtctcagccgatgctagtagtgagcaaggggttggagcgggaggcgcggctgatgcagtacaaggagagcccaccggatgttgctctgccaaccagacctcgcagccgcgttgtccctttacactgacagcgcaccgtccctccacgccaaccggggagaagaagaaaaggaaagaaggaagaagcagcatgatgacgagaacgtgatggcgatgacaagtagacggcagtggcacgaatcgaattttagaaaatttcagtggcattcagccgatattgcaaatattaatgatatttttttaatttgacatatttatagtgggatggatcaaattaacccatcaaaatatggaaaattgctaagatttgggaaatctgtcggtttcctccacaggacaggtcagaacgcgtcctgagggctgtttagactagcggcatgtggccggtcagaccggcggagtctgagacaggctatgttttggttttcctttggttttgatctcgagttggacatggaggagggcctgtaaagggcaagaccaacccctatataagggataaggccatttgaaaccatgtaacatacaatctacacaatcaatcgaatcgttgttttcaatattacttctacttttcatatagcctagttttagttcatccatctttgtcaatttgtgtcataaatcgtccgccttcgttgcgagagtacgaattcctctgtaggtttgtcctgaaaaccttccatttgcccatgagacgggtagttatccatcgttctatctaaatcggctcagctagccggtttaatctatcaaaacccattttggtctagctttttgctagattggggtggttggagactctatatcaccgcaaggcgtttaggtgtcacgatcgtgcttgtctacttgccaaaaaagttgccaacacaatttttggcgactccgctggggacgtcttcatcatgaccaagccggaggttgatccatctaatgtcctccccatctcattggaggatctagatgaggagcaatgtcgggagattgaacaacacctcaaggagacgcaagaggcgcttttggcaaggtgctttatcaagactcgtcaaggagctattcgtcagaccagtttcacatcgaaaaacaccatcaatgtggtaagtggtgatgaggtatctcttccacttcaaaagctcgtagcaagttccatagattagactattaatactacttttaataataaacttgagcatgatatgagttcttattttgataagcgaattgatgcttttatgagttgcaaattcagttctaatatgaccgatttgccgcctaattctgttgcaagtactagtcaaggtcctgttcaccaaatatttagtaaaaccgatggggcgaccatgcaactgactaggggagaaaaccctaacttccccgccggtctgaccggcggttcctacaccggtgttggccggtccaactgcactgcctcacggtctgaccggcagccctatggccggtcagaccgcaccccctatactggtcaggccggtccgactacacctctgtctatcggtaagaccgggctctgggccagtcagacctacacaattcttccagtacaggaagttgatcctattttatatcatatttttttacatgatcctcgtgtagctactattaatcctcaagttcccccacatatacctaatgcttacaatgattctaataggggatatcctgaagatgttaggtatggccaatataacaatattgtgccaccgcaccacttattaggccaccaaacccaccaacgcctgaaaatatggaggaacgtcttaggaacatgattagagaagcctttggaattgagccaaggaatcgcactagggtttatcaaaagccgtatcctgattattttgataatatcccatatcctcgtggttttagggttcctgagtttactaagtttagtggtaaggataatatgactacatgggaatatataggccaattctcagcacaatggggtgaggctagtaacagggatgcttttaaattacgcttgttttctttatctttatctggtactgcttttacatggtttacttctttaccggtaaattctattcatacttgggctcaattagaacaaaaattccatgattacttttacactggtaaaactgagcttagattatgtcatttgacatcggttagacaaaagtataatgaatctgtaattgattacattaaaaggtttagggatgttagaaaccggtgttttagtttgaatataattgatagagatttggctaatcttgcttttaatggtttacttgctcctattatagaaatattagatggccaacaattgcttgatgttagtcacctcatgcaaaaagctctagctcaagaaagccgggttagggagagtaagaaattttttaggtccaatgacaaaaagcctaatgctagtattgttgattgccctgagtatagtgattctgataatgatgatggtgatcatgatatatatattgccgagtggtcatggactaacaagaataagccatttatatgttctacttaatgccgactcctcgtaaagatcggcaaagtgaggttaagtatagctttgatgtggccaagtgtgataagatttttgattatcttttgcaagaaaaacaaattagattacctaaaggccatgtcattccatctcaagaagatttgaaacgccgtgcttattgtaagtggcatgattctcattctcattctactaatgattgcaatgtgtttcgacgacaggttcaattggccatagaggaaggatgattgaaatttactgagggctccaagatgaagctatatcatgattcttttcttgtaatactattgatttcaatgacaagaaagtgttgattcggccggagcaagccgtatctactaaggggaaggaagtagtagttggagagcctagatcgaagatgattgtgccaacaaaaatcaagaagttggtgtatggaaggagaataaggatgaagcttcaagctctaagactccacggaagccaaggtgtcttttgatatgctcttgaacaagtatgagaagaaaagtgttgaacaaagttgtaacaagggcaaaaaagcaagatcaccttctagggagcgatttggtcattcaccaagaccattggagccgccttttactcatcatcctcaagtcatgccatggggaccttgtccaatgccactgccgggttatccttttccttacttcatgccatttggacatcaccaccaatgtatgatcatatgcctcctatgcaatttcatcaaagttggggagaaccaagaaggtcagcacatgagcgtttgtcttcaccaaacaaatgccggtttccatctagaaatcgggttgatgaaggaagcagggaagaaaagcgtgtcaaggtggaggcgaggacttcaaggtgattactattaaagtggagtctcatgatgtgccaataccttctgaagatggagccaaggtgattccaatcgatgaaatcgaagccgagaccagctgtgcgcaggtggccggtttgaccgaagccttaatgccggtttgaccgggcctactggccggtctgaccgacggccgcatgctggtctatctgggccgtctagccggtccgactaggctgcaatgctggtttgataagagatttgcaaggggtagttcaggggcttcgttgtcttcaagcaaaatcaataggggggcattatattcctcctggagcagagccaaaatcaaggtggatgcctaataatttaacggctacacaaaagagaaggttgcaacgtcttcgggctcaagaattaatagagagagaagccgaagagtagacagatagaagattcaatgagttgcgaccgccgccaatgaaggagtggatgcctaagcctatagagattgaggagccggttgttgttcaagcggagaaggaaaagcaagtagagaaggatgaacacgggttgttcaaggatgatttgctgccaaaggaagacatggacatcaacatggtgtgtatgttacctatggagttttgtgctatggatgaggttgaagttgctcaactttcactaggtccaagagatgcggtttttgagaaggccgatgaatctaatcgtcatatgaagtctctttatcttaatggtcatattgatgggaagccgatctcttgtatgttagtggatggtggtgccgccatgaatttgatgtcgtattcgttattgaagaagttgggcgtggagatgatgagttgaagaagaccaacatgactctcaacagctttaatggtgaaccaatggaggcgaaaggtatcttttcagtggagcttaccagggggaacaagacgttgccaactgctttcttcatcgtcgatgtgcaaggtaactatagtgttattctgggtcgttgttggattcatgccagttgttgtgttccctccaccttgcagcaatgtttaattcaatgggacggcgatgatattgagatttttcaagtggatatatcgtctgaggttgcaatggccgatgcttcaattgaatggcaacatgggaatattcaatgcttatcggggttagatctttctagctatgattacattagtgtctctaaggatggttttgtacttattttctataaattcggctagtttagtatagctaggcaatattactttgtatcatgagtaaagatgctaatctagagtagttacaaaagagggttgttggtaattcttatcctcacagataaaattcgcaagtgcacggaatataccgatgtagtacttcacccgggagtattctcaggttcgatttccacaaggaacatgtgtgtcagctcttcaccaagttcgtccaaggacacgaagctaaagtgatgtgaccatggctactacagatacaaccattgctcacatcatggatgaacaagatgacatcaagatcaagtcctccaagtgctagaatccgattcggccacctactacattgctgaattcaatcagccgccgaatctgcatacaacctccgtttttgacccgtgagtacttggtggaaagctcttggagtcctctttccagcggatccggcctcaactccaaattccatcccagtcgtccacaaatgaagaaacaaggtgttgcatcaccagtcatgggcctttgggcttgtaactttgtttgggaccccggcccaagtggggcccaaggggggctgcgccccaaacagagggaggacgcccttctgacctcctccatcccttaaatagctagtaacccctccaaggttagtcgggttttgtttagatgaaagtttagccattgctacttccttgcagcgtgtgtgtcggctagaccgtccgtctgcttttattcgaaaccccaacttatcgtgtgtattcattcctatttgcaattcagattgcttttatcttgttcttgcttgtttcttcgatttgcttgcaagaataaggttgatctgcatcggcaagatcaacaacccacggagaggtgtatcgatcactaaggcgcaacacaacgtctcgtacggttgtagccggatcgtcaacgtttctcccaaatcatagttacctacaactcaccgaaagatcgggccaacaatagccttgagtgtcgaggggaactcagggttcatcaggtggtatcagagctttcgttgctcggtgagtttttatctacctataaccagaaaatttcccaacaaaaaaaattgtatcctatacctagccatctttgtgcctttgcattgttcttttcagtttttacgttgttgagttttgtgttgcattgtcgagtcgtgttgctggtattagcgtctagttcgtttagagtttcgagttctggtcacgttttgtaccacagtcatcgccgcccccgtgtctctgttgttgtcgggacctacgaaaacagaatcggctcgctgccacagttctattttcgtagttttcagaagtttctgttggttagtatttgagttcttgagttgcatagcttctgtttggtggttgtgccgtgatggtgtgtgccgtgatggtgcgcctgtgcatgcgcgcgtgagaaagatgaaaggagaagattagattagattgactggtttggtttatatttagtgccaagtctgtttctatttatcacctggtacctttccaaaccaaggccgagtgggattccttcccttgcgtcatctcgtagccgagacttgtgagtccgactcacactccctcatgattgtttctgtccgagttggttaaaaacttcgatgaaattttattttggtgtcgattcaagatccgtttgcaaaaacggaaccgacataacttgagcattccatttttgtataatttttaattttggtttggacttctacagttgagtccctgtaattttcatatttacatttgagtccctttgaccttacattgaggtccttgagtcggtttttggtaaaaaatcaaaaaaaagagaaaaaaaaggcagaaaggtgctaaaaaaaagagagaaaacaaaagccgccccaaaaaaaagagaaaggaaaaataaagaaaataaagaaaaataaagaagaaaaagaaaagaaagaaagaaaagtgaaaaatcagttgaatcattgagatttcttttatatatcagagcatgcttgagttgtttctagtgctatcttgtggtatcgtttgtgtctaggctcgcgtctctagtacgttctagcctaggaccagcacggtacttgactttgaacaattattcaactttgtattctctgatttgagcatttgctattgctttgctacatatttaagcctacccagagctccacagatttgattgcagccgtacagcaagtgtttgccaaggcatcgatacatccaaactccattggggtgcttggttgagtcagtgtacattatcattccgcttgctttggtaagaacttataagagcttggtgaaaagcttgagtatgtgtaatatttcagctgccactacctagtagttgataggagcgtgcatattcttgtgtatgtttcttgtttgctactaaccatggcaggattacacaaggggaaacgagatggtcatgctcaacctcgacttcttcaccatcaacgagatatagcgacttcttcacgcattgcatatgaggtacatgataatgatcttgcaatggtagaatctaaattgccagtttttgatggtaagtatgattccgccgcttatgttaattgggagctagcagtaaacaaacaatttgatgagtatgatttctctaatgctcaaatgattaaggttgctagtaataaatgtaccggttctgcatctttttggtggtacattgttggcaacaagcttgaaacttgggatgaatgcaaaacaatgatgaggaaaaattttgtgttttcatattataaacgtactctcgttgagaaattagaacatctaaaacaaggtgacaaaaccgtgcaggagtactttcataactttaaaatttgtatcacttatagtggtttaaaagaaagcaatgagaacacaatgactagattttttagagggcttaattctgatattcaggctgggcttataaatgtgacatataatcatataggccacttgttcatgctttcttgcagcgttgagagcaatattttaaagaacccaagggagaaacaagctatgcttgtgcctcatattactgacattttgtagggagctcagaacattcaccatgaggagaagagcgatatgctcgagatgtcatctccatcgctcacgaaggaagaagagaagactgatgcacctacattatctgaagagggcataaaaggtaaattaaatggtgctgatattactcaaggtgagtgtgcttctgatgagtcacatttgtccactatccatgctaatctagagcaaattttggtggaaactacttttgatttgcctttgtcacaagttgatttacttgctattccttgtgataaagaagagttgtgtaataatgcttcacttatatccctaccacaactagtgaatgaacatgctatttctagtgtttcattgtgtgctgattttaagcatgatgttcacattgctaatgatgttgaggaacgtaaattgataacttctttaaatacttttagctatgttcaatttgatgatttttgtgagctcaataatttggaggagaaattagttgcttagtctgatttgccatgtccaactaatgctatttttcatatctttggcaaatataatgatagaggaatatatttggtgcatagagatttcagttgttcggattttgagaaacatgttattgctactcacacaacatcgagtttctctagttttgattggatgaaacaggttattttgaatggactatgtgacgagcaccgtatagaaaaatcgaggacggttttccgtgaagaaggggaggatgatgtgaccatggctactacggatacaaccattgctcacatcatggaagaacaagataacatcaagatcaagtcctccaagtgctggaatccgattcggccacctactacactgctaaattcaatcggccgccgaatctgcatacaacctccgtttttgacccgtgagtacttggtagaaagctctcggagtcctctttccagcagatctggcctcatatccaaattccatcccagtcatccacaaatgaagaaacaaggtgctgcatcgctagtcatgggcctttgggcttgtaactttgtttgggaccccggcccaagtggggcccaaggggggctgcgccccaaacagagggaggacacccttctgatctcctccatcccttaaatagctagtaatccctccaaggttagtcgggttttgtttagatgaaagtttagccattgctacttccttgcagcgctcgtgtcgactagaccgtctgtctgcttgtattcaaaaccccaacttatcgtgtgtattcattcctatttgcaattcagattgcttttatcttgttcttgcttgtttcttcaatttgcttgtaggaataaggttgatctgcatcggcaagatcaacaacccacggagaggtgtatcgatcactaaggcgcaacacaacatctcatacggttgtagtcagatcgtcatgtttctcccaaatcgtagttacctacaactcaccgaaagatcgggccaacaacagctcagggttcatcataaagataggctaaggattcaccggtgagaaacagtatctatggaaagcttaactttaatcctaacgcgatactttgggcactggttagctcgctgctcccagatatcgctttactacgcacccggacaggaagaacttcagtgatcttgagggttgtcaccacctcatacctactgtgggatgcggagaaaacaccggaaatcaactaccgagacactgcgtctaagcagttaataacatacttgaatgttagctacgcactaaagcaatccctatattttagtggattatagtgaacgatgatcccgtatgctaattaggaactaaccaagaaataaatctcaccaagcaaaactaaattactcaaaagatatttctattataattagagtaattaacatagcagaaaataagaagagttttaccgacaactctggcactcctctgacttcttctaatctactctatgatgaggacacgactagcctagttggatataaccatgactaccttatgtattaatgaaccaaaggcgcatatgttctacattagatttacttcttatatatttgaacaaacgttgctacacaatgagttttgtgtgttttcgtttgtctgaggtactttacttggatgaaggaaaagacgccgagcataacgaatgcatggaatatcaaagaagttgattgggaccaaaccaagatcttctccaagtcgacttcgagtgcaattcggaatccaggactagtctgcactaaaaggggcgcccgagtcgcatacgtgctcggattggggcgttctttatatggatggaaagctaacaaaataacctttccaatgcttttggtcccacatccaaattctttctgtgtaaacggaaattgaccaaacaagttgatatccggaatctgtcttggtgctgcgtcaccgtatttgggcccttgggccgtgtatcgtgttggaacccatcagggttgcgtcaaggattggttgcacgaccctaaactctatatatcagtaccccctgtcatctttagtgtttgggttttgcttagattattctgtcgagaacaatttcaccgttagatcggtttgtaagaccccaacttgtgagcttaatcattcatctgcaattttggtgtattctaccttgttcttgtttgtgttcttcgattggcaaatagggattagccttctcggcgaggtcatccactttttgacatgggtgataaccagaggtgacggtgtgctgcgattgcggggctcaagagcgtgttcgttcaagaagccggatcgatttgtgtcgcgactctgcccaaatcgttgtttatcagaaccttttagaagatcgggaaccctagtccacatcacaaagactttatcattgccaaggccatgcttgctcccatattgccagcttatcaaagatttccatggcgtccaaggagcttgtgccgctgttgcaatgatacatggcttggattataggagtggcaatattagcaacttcgtctctagccttctcagcaatttcaactttgtttatcaacaagtcgaattgcgcctttgttttccccatatgatctgcatataacatcattcaaggattcaagatataatgatagttgatcaagtttcattcacaaagaatcaaaagagttaccttcaaattccttgacaacaagatctctttccttggacagagcagctttgtcattctctaaggctttaattcgtctctccaaatcttcaattttggcaacttggactgctagacacagaaaaattatacaactgctggaattgaatatggaaagccaagcaggaataacattaacctttggaggagccgctcaattcgaagttggtatcctggaactcgacaatccgattcctgagttcatgttctgtcttcctggcttattctttggtttcatagagttttgctctggtttcttccaaagtgccaagatgaggaaccagcttctcaagggtagcggttttagcctcgttctgaaggtggattctctgcacaatatcgtattcaacttagtaaattcattggatgactaaacatgtgaggggcagtatacttacatttacaagacgagtagcctgattgagagtctttgctagcagaactacttcatcttcttccttctgccaatttatcacaatgccttgcggttgcatttcatcatcccaccatttgaccaggataggcggctaggagtcttcagctgatttagtacgaagaatttcttcttcgtcaccaaccattgggccttcatttatataagaacaatgagataacatgaattcactggagagagcattacctgtgataattataggcggtggccgagcaggtccttccaccttgtcaaaagtgctggcttcaggtccaacatctgtatcttggttcagaggaggactgctagcttgctcctccgtttcagggatattgcttcccccatccatatttggttactgggagtcttctttatcttcacccgactggtttccagtcaagggctcctggtttgtgctcgcttcagcggatgccgactggtttccagtcggtggttctttgttggcatcagcttcgcctgtcgttggcttttcgccagtcggggtttctactcggaaggtcccagtcccggttgcgggtgaagtttttccttcttcaattgctttcgagctagcgggtgggtcagtgctcttactagacggaccaatgtccggcggtttcctaagaaataaaaagatattgcaagatgatttcagcaaacacaattgtgaatgttaagaaaacaaaatggacaaatcttatacctagaagttcttcggatttttggcatcggacgactggttgttttcttcttcgacggagtagcctgtttaagctgtttgccgatcgattcatcatcgctgtcatcatcatcatctatgatcatcttcctcttccaagagcccgcttgtttagccagattagcactacttttctggccgccgggctggatctttggacccccggtagcttggccctggtgacgccgcaaagaacgacattgaacaatcggaggatcagatttcatcaaggcattttcctaaggataataattcaaggtttattttcaataacaacaagcataatagaaattcaagcgacttgtcacttactgctggaggtggattgaaggcattgaacggcacgaccgggagcagatgtgtgaagtcaaccacgatactagatgataaaatcttatacatcctctccttcatgattttgaattcgagggagtcgggatcctctcagttagggccggtcttcccatcatactcaaatgtcgtgcgtgatctttctttgattggagacagtcggcacattatgaaatgccgagtgatttgctccccttgaaggccctgttcctttatcttcaacattatattcagcagttcaagggcttgagacgctttctcacgcatgggaagggagttccagacatcccgatacttaggcggacagcacgagtactcaggcagggcagggtctgggttttggatataaaaccagttagcatgtcagcccttgttagaggttttgaagggatgagaaaaatatttcttgtgcagggttccatggagttggaagtcagatcccccaacaatgcaaggcttatttttgtcgggctggggttttaaaaaaaagattcggcgaaacaaggcaaagtgaggccgaatgccaagaaaagcttcgtagaggtggacaaaaatcgcaatatgaacaatggaattggggttgagatggtagatattaatcccataaaattcaagaattccccaaaagaatttagaggtttgaagtacaaagcctccataaaagaagtgggtgaataccacgatctcatgggtgtcaggagttggaaatggctcaccaaatacaggacgccacccgatgatctccttgcttggcagtaccccatgcgccaccatttccttgagagtttcttccttgacatcggaaggtgcccattggctctggaagttttctctattgagggcggaggttgcgtggagggtttcggttgaagggagacggtttggaagaggcggattgcggtgcagctgcgaaccctagcttttggcggcacaagtttgttactgtagcatgaaatggggaacgagcagctgttgcggcgaagaagacaaagtggtttccttcgacgtgattttatcgttgggtatcggaaaatgctaatgggcatgggcccatacagtgttttcagcccaaatataccttcggtgtggctgaatgtggtctcttgggacttaggcgtatttttgcttaggcaaaattgcccacacaaattaaagcctgataccgttaaaatccttttttcgcagttagtaaattccttggaattactacgatgcatacaaaaaggtgcccaactgtcaaaaacatcatgctatttttgttgactttctctataaggtcacaaagctgttagggtttaatcaagacgactagtttataaagttgttgttctattgatgcgaaaacacgaggccttgaagatctgcttaacttcagtgcaggtccaaaaatcttgcctttaggttcgtgagcgtgccagttaatttaatcctgcaatcaacaagaaataaagataaagaaaccgcggttaaatccataaatgattgccgatcgactagttgccgatgacatatcatttatctctgagccgatgtcatgtttgaatcgatcggcagatataaataagtaagaaaagactaaatctactcgatcagctgtagatattaacaacctataatctttatatcgatatatacttaaatcaagtgattgggatagatcggtcgccatgccgagacagtataaatcacttagattgaaatatatattaacaatgagattatagatgctcatagcattgccgatcagatagatctagcatgtatcggctaatactccgatactacaatatattaagatattaaagcaatcaaaaatatatcaaacggaagcctaacatactttgttgtactaagatcataatataaagggcagatctagcatgtcaattaaacatgaaatataaggctaaatcaggtaagatcggctgaaaccccgatactaccctaatcggcaaccaaaagcatgctagaggttgagattctaatcatgacttataaggtcaaactcaactgatgcagctataattatgaaaaggacaatatctagacaatcaagccgttgggtatttcatagatggtggatatcctgtacaatctaagccaacatagatatttaacctaatcggctgccttccaatgatagatgttatccgattgaaggttagataacaatattgtcaaagattatacagaatatatgataactcgacgaattacataaacaagattagactatcataaagatggaagcactaatcccgagaacgcaagccgccatagcaagttttacctctagttgaagatcgaaaccgatgcagctcaacccaaaagcaagaactcgtcgaaacaaaacgaaagtaaaagggtggcgatgcgccaagattgtattgaacgtgtgttagattgattacatgaggctcggggtctatttatacccgagattacaaaatatgtccgtgtcggacacgaaacaaactctaagacaccataaatctttgcggcagacttttgcccaaacatatctctaaggaaattacataaaataacctaattaatagatacaattgccttctcaggacccaatccgtgcgtggcaattctcatgaagcacattagctcaacccgacaacgtgtaccatgtcacattgtcggattcggctcaatcggctatccttgtccaactcggactctgccgatcacaatcgcagtcgattcggactttagccgatccttgccctgtttccgaaatgatttccaccttagactccgcctcagttttatctttgtcttcgatactgaaattactaaatttggttgttagcatgttccttctgagcatttatatgcttcattctcttaataacagactaaagttacggcttaggctgattaaacttgtaagtcgttatttatttagcggttaaactggtttttactcgaattttaatacaaatgatgtattatgccccaaaatagatgatagatctgtagagtgctcttatcactcggatctttatatatcatctatgtttcatagtgagctcaataatcttatttaagcagtcggcaaattcctcagatgaagtcgaatatgctttaatattaaattacttcggtagtaccattcataaaaccactcacctagttatttattttaaccttgactatatgtttagttttttccaactaatcacatagtcgggggctacacctattaggtgcatctagtcgatgcacctaaaattttttagcccttcacagcatttgattcaaccactagggaggccaaggcagagataattgaagcactcgggattttcgtttaatgactcgggagaagattatttcgtcgattgtttaggtctcaggggctactgtggagattatggataccccatacctacacgcatgtgtatccgactaggtatagggataccaaatatactgatagaatatatttagtaaaggactcagttgttatgttaacttatatatcaaggaaacatccgatagtcctagtcggttacgattataatttatctttacatgcctagtcgttaggaacatgggctgtatcttgtaattctggctcctccccctatataaggaggatccaggtgcctccaggggcataacctttctctctgattatacgatcaacaatacactcggcggatcaatccccggacaggagtagggtattacttctcattgagaagacctaaacctatataaacactacaggagttcagacttcttgtgtccaaaaaatgtgacgaagttttatttcaccactatttattacaattgtagtgaccaaaaaagttttcgccactgcgatactgatcattagtgagaatatgttaagtcgccacaatatatagcattagtgtcaaatctttagtgagaaattaatattttgccactgtcgttgtattattagtgggagaacactgtgtcagcacaagaggccttatcagtggcgaatttattgtggtgaaccatcctgttgccactgtttaatttttaattagtgaccaattgttatattgtcacaggagtccctagttgtagcaaactcattcgcaactaatatttttttattagtgggaaaccttcatatcgtcacaggatactataattgtgatgaatttgtaaaatatcatccatatctggtggcatactatttttttcatagaaattcaaattagcgaaaaaaatgtgttctcactattcatttataattgtttggatatgccatgtacaatttatctaaaatctattttttaaatttgtatttcttccaaaaattttattcaccgcatatactaactataataagtggcaaagcaacaaattttggacaaaactttttttacaaaggaattaaagagcaacataataatttattctccatatattttccatacatgttttttttaagcaccacactcacatgtagaaaatggaataaacatgtttactatccgctcaagaacagaataaaggaggtttagagggcttgtcggctgggaggccgaccaccgcgccgagtctgccatttaatttcgatggcaactagagaggtggtgaggacagaaaattaatgggtctgtttggttcttacagctgtagccacagccaaaaaatgctgtaccgaacaagccaaatgattttctacatataaattgtcactgggtggctgacaggtggtctactatcatataaatataaattgttccataagcatttgcatttaataaagaaaaaatacacgcttcgatcattctatgacccagatattctgacatttgtattacatttataaagtccatgggtccaaaagattgtttttagtatcacaaaaatttaatttatgcctccaaatggacacaatcgtgaacacgcgcacacccattttctatgagcactcaaatagcactaggtcataactctagtttgagcatcatcgtgatgtcggcttgctgctcatcatctgcatcggtttactcgcgcactaaggccctttttagatcccacccaaaatttttcaacatgtcacatcgaacgtttgaacacatgtatgaagtattaaacatagactaaaaaataactaatcgcacatattacgactaatttgcgagataaatcttttaagcctaattgcaccatgatttgataatgtggtgctacagtaaacatttgccaataacggattaattagacttaataaattcgactcgcgatttactgacggattctgtaattattttttttattgaactacgtttaatactttaaatgtgtgtccgtagatccgatgtgacacgcaaaactttttaccctggatctaaacacagcctaaaccattagtaattaattaattggccattatttttaatttaccgtcattacctatccattaaaatagtatgcgagattaaatttttgacactggcatggatgcaaaattaaattggacccatcggtcaatcaatggttttattatgctaaaacgtaatgtaactagcttgtattaatccaatatgtacactcgtactgttgcttaaaaaagtactatgtaggagtactactctttatatagtagctttgaactcctccttatcctcctgtctaggagtattaaagccagcagcatttagagcgtcctagaggcacctacagcagcaacctgcatattctcgatctggatctaggcagctgcttgcaaaattcgggtggcagcgtgaaaatttctcctgaggatttttgggttagcaccggccggtgagaagttcacgggatggccaggtatgagtcgttgaggtgcagagattttgttgggatattttctgtagtatggggatttctgtggtttcttgagatatttgctcattctcaagttcgttaggataacgcgtgttcttcttcggagggattgtttctgctactagcggactaataggcaaccaaaaccatggtgaggcaaaccggcctccttctccattgccgcagggtgtttagattgagaaccatcttcctaattcccttcaaagatttggcgtcaaattatttctcccgccaaaaacgatgggtctatatatacagcctcatttcccaaaccaatcttttcaacatccagagtcaaacagaaacagaaccttgaggtttctacggtaggtttcccggagagaagctgcaagcgaaggtaaagtgctaaacgattcaattcgatctgggaatactatttgttagtcagccttgcgcacaaacacaccaccatgtttgtccatcactgcctctattgctgcaatcgccgcaaacgatgacaccgccgctgccgatgtccatcgtgtccatttgttatgtcttcttctcaattatcattctttcggtttaatttgctattcatatctttttcgtcccctgctcttattgtctagacgcagtaaatatttcttttttcaatgttacagaaaaaatgagttcccggctgcgtcagggaaatcaacgagtggatactgcagatcaaccggccacacgtcaacgatctcgtcaagtggggactgtgggtgaacaaatggcatcgatcatgccattgatagaagcgaacaagacataggtaaaatttctattaaacacaagcactttgatgcattaggtgaaataattcgttagctagagcctgtacaatatatatctctacaactgaattatttatattgtggggataaatattgtttaaagtccatctgtactgttatgtctcaattcaacatgtgcattgccaaattcagatgatcagcaggcctctgatgttgccatggatgatgcagaacaaattgcctctacactgctaaactcaagatgtatgatttgtttcaaataatatttttgccatggtttaattgaactatttacattgaaatgtctattttgactgctcctgtttttactgacataggtcgtgctccaaggaggggggggggggggcgaaaagtcaccatcaataccaaacttgttaagaaaagggcaagaagagaaaggctagatatttcttttcctcaaccatttggaaaagtgtgtggaaagcatgcaaaattatttaaaagtgaggttaccgttattgtaagaaatcatgtgcctctgaaagccaaaaaatggaagaccattgaaaagcaacatcctggtacaatggctaatgtttggaagaagttgaaggttgttaaatattcttatgtcaacatattttacatatttattttttttagttgccaacatggaacttttgctgacaggatgcatttcctgagctacgcaacgaagatgaagattgtgctatgaagcaggttgaagagtagtatagtaatcgacgttatcgtctccactgcttgcaccataacaagaaaccaaggccaacccatgtttcaccagaagattgggcttggctgataaagcatgtgtggaccgatgaggattttcaggtgcttattttttttaatataattgtgccatgttccatgcataataattgatatgcctgaaattttattatatagaaaagaagcaaccagaatgcagctaacagggcaaagcaggagatgggctctaaagtgggaactaaatcaattgctcaaattgcacatgaactggtgagaacaatatagccatttgtctttcactttctccgtatttttgttaactgtacagctcattttctcatttacatgcagagaaacaaagagacaggtgaatggcctacaacaatgcaagtttggaaagcaacctatcaaaaggctgatggaacatggtctgttcctaatggtgaacgagttctggtatatatctttacttatgacaacttgtttttttagatttcagcctaaactatatgatatgtgtcaatgtaccttctgagtagtactattttaccattggaaacgcttccatctgccctatctgtatgattcttttgcttactgttgttttcacattacaaatgcttctattactctaaaatttcaccttaacaagtccacctcacaagaagtgcatactaaatgggctaggtgaactactgaactgtgttgttgctaaataatcagtaagtgatatcattcattttatattaggccctgtttgatctaatacttgcaaaaaaaactagaatagtaagtgattaaaaatcatatttgttgtaccttgaaaccttgtatgaggtgttagtttgtttatgcttatacattttctttttataatctgtgtcaacagtctaaactaaatgaagttgctcaatcacaacaagaaaatatatgttctgcagcagtaccactagtagagcattttgccttggtccttgggaaaaaagcgaaccattcacgtggtataggcttacgtgcaattaatagagtggctgaagaaaggctaaggtaacttgcacaagttgaggctgctgaaaagcatgcagctactgcccaggagcgtgttgatgctgcggaacagcgagcagtagctatggaagaccaagtccgcaaattggatgaaacaaatgcccagttgcaagtagagcaacaatctcaacgtgatgagttgaactcccagagaaggacagtagagggacaagctacagatgttgaaagaatggtacaacaaaaacttgatgagcaaatggccatatatttctcacgcttcgcttcttccaatggtgtttcatcctcacgatctccatcagatgtaagaaacaataaaatatgactaatgttttgtttttcatgcaatggctttttaagtactgaaagctaaaaatatatttgctcatatttacaggaccattagaatgcatgaagttgatctccagaagtctatttaatcaagctgaagacatcctaagtctatttcaccgaataatttagtattagtcccatttaagtttctactggttgctttagttctcatcatgatgtttatgtcagcatttcgtgagaaattttgagcttcttgttgagtgcaacatttgtttggttgtaagacttctgaataaatatttcaatatcattgttccttaatttggtttaattgagatgttattttttttaatggtgttcgatgcaaaataaaatttatatttcattaatacaattgtcacggtgaaaaatagtagtggtcctgggagtataagttcttgtgatgaaaaattgtcacacatcttacgtggcctcacaaaaaaaagattatttgtgataaaaaattaacacgaactattcatttgtggcgttaaacacatcactattaatcgtcctaatcaacggaaatggtatagaggtgagaagaaatttcaccacataaaacatcaaaagtgacagtaacgctgccacagatctaacggaagtagtggccatataaataatcacatttgtaaattacaatagtgacaattttatagtcataattatatactaaacgtggcaatttttggggccacaataaaaatcttaagtgatgaaactatcaccactattctaaacatatttgtggcggcgtatgtcgtctctgatgtaactattatcagtgataaattttaccatcactaatatttatgaatatttgtggcgaacacaaaatcatcactatgttatttgtgatgattaccagtggcgactagtgacaaacttcagaattggccacagtcgcttgcttgtgatgaataaaacattttgtgtcaaaattaatcatcacaaaaaccaatttctcttgtagtgaaaccttgtgtctcctagcccatccacttttccagcttgatagccctttttgtattgtcgaaatcttgttttgtcatgcccggaaattcactagtaatttccgaactaatttgtacataaaatcctcgtccaggaatcagccaaggtacacaaactgacaatttaatatacaaatccatcataataataacgttacatacttacaaaagaaaagaaaacagcagcggaattaacggtctagcgatggcttcagctccactcccacaggcagctcaactggtgtataagccaaatgtcttctccttttggatcatttttcttcaactaaggttgattgattattgcaagaatgagcatatgacatactcaacaagccacacagcaaatatgcaagtgcacaaggataccaaaggatggcataatataggctcatttgcaaaagcagcatttagcaaatatttaagaatagtaaaacagtagagtaatcatcaattttaatcaacactgaacagcacacccatgctgctcaggcccaaccattctgaacaaccaaacccggctgcacagatctaactccaaaccaggagctaaacaaattattaccaattatagcatcaataattattgtgagaggtttgagactaatcacgaaaaacattgctcaacccgcccatgaccgcgggcacggctattcgaatagttttactctggccagaggtgtaccactgtacccacaagacacagccttgacatcatgtctaacatgcgtcgcgatactggaaagtacccgaatagaggctgtgacaataccctctgcacaacacaactcaccagagtgcaccattcctggatcataatcaccccctctataaatataaccagaggcatggactccccagggacccccacggacttctcgccgcttctcagtctggcaccccgcaatgaatcatgctatacaaaaggtaaagccgttgcccacgctggcttgtggttgatacggttaatgtctcacaacagtagctagcgaaccggtccttaattgtcatgagcacgaccttcaaaaccatgtgctcacaacccaccattgtcaagttttaattatcaattaattatcataacacgattaaccatcgtgagctaccattaaatataacttttggtgtaccttgcctcctggtcgtcaccatctgaaaatcccacacagaaccagcaaacagagagagctgacaattaaagctaaccacccacgactaccataattcttgaatttattactgctattaaattggttcattaaggttcaagtttcttaagcaaataaaataaagacaggctccaacacagttataccacacaccggcataaccatgccccatacgactctagcagaaaaacaaacgagaagaacacacgtgcaagcctactaactgctcgtctactgctgcgatgagccagggcggaaggtgagcagcagcgcatcctccgtgctgccaacgccagaggctccctcctcctgaggaaccacgggggcgggctcggcacgaggggtctcgacgaagcaggtccacgctagggactgacgaacaagctcgggcctggaggtactcttgcgggcggtgatcttcaggctgtggcagacgcggcgacgcttggggcgacagacctctccctgggcgatcttgagctgacgcagctgcgcctccactgcgtctaggtccttcttcagctgcagattctcctgacgtagctccaggatcttcatgttgttctcaaccaaccctcgacgcatcatctgatggaagtcgatatgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgcagagtgccgatggcgaggagtgcggcgttctggcaagcggcggagaaggaatctccacccgcggtgactgccaacgaaatcctctcgggtgagccagtgaggatcactgcagtaacctcccaagcagcgtggggctctgcatcgtcaccctcctgctccgggagctgcttgccctggtagtccactccatgcagataccccaggacaacgcacatgccccgcagctccaaaacgaagccagtcaggtgcagaccatgacggttgatgctgccggccatctacaaacaaaaacaaaagagaaaagcaacattttaaaggtcagattttgacgataaatgaagcagcaggacagagagagactagaggattttcacaaataagaaaggatttttattttgaaaatattgctaaggcttgggatctacggctcgtcctagggtcaagggggctctgataccaacttgtcacgatcggaattaacccaacgggcgttccttacgtgcgtgtattattccttgtcccaggaggcaaggtacaccaaaagttgatacatttcagagtttataaagtggaagcgtaaatagttaatttattacatgggcggcgaagacccagcacacacaaaaacaaacggaaaacagcggaagactagggcgacgaccacaggcgcttgacggcaggcttttgtttataaccagactgagccacaaactaagccttacctactagacatgtggaagtacggtagtgctttgcaacagaggctcgaagaccggtccttatatggccgaggtgctactatcaaaaccatgcaccccgagcccagcctaaaaccattttgaggattttgaatagagggggaggtgtgaatccaatttccacaataatcaaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaatagtgataacgcgagaatttaaataaagcgataatgcaataatttaaatcaacataattttataaactgggattcaatatgttcaaggatgatgtgacttcaacttccacgaagagcggatcttccgaagctgcagcgtctacacgaccaacggaaaagaaaaggcttttactctaataaactccatataacaagcaggaacaaagcacaaaaaaaggttcttgacttcttaaggaaaaattagagacttgaacggtctaattccgagttcgaatggccaagttatggccatttgaagtttatatgctctttaaatgaatatttgcgaatttcttcatttaaattttaattttaaaagggtttattacgtcagccgaggggagggggcgcgcggaccgggtccacgggagtggggcccacgcggcagcctcacggtccacggtggaccgggtgcactcaggctcacaccggccggcgccgtgggtcccacgcatgagccgcacccgagggcgcgggcggctgacggccgggccccacgcggcagccgctcggtgcgcccgaaggcggccacgtcggcgcggccggcgggaggcggcgcgcccgcgcccctatggtcgccggcggcggccatgggcacatcggagcggcggccgagagaggggagggaaagggggaaacgaggcggcggtccacggctcaccctaggtcgacggcgacgacgaaaaggcagccggagcggaggaaggcggctgcgcggctcgggtcgacggggacggcggcgctccggcggtcgacgagcgaaacggaggggtggacgaggtcggcgaggatgcggcgaagccgaaggaggcggcgctgaggtgggaggtggtctggggcgacgacggtggtggaccggagctcggcggcgacggcggagagaaagcgacgacgcgagctcgattccggcgaggaggaagggcggcgagaggcagaaacggacggaggaggtgcggggagggtttaaatagggttggaagggggggagagagcggccggcggggaaggaataggcccgggaggtccggccgccatcaatggcgccggcgagatttgcgggggcaaatccgcccgtttgaacgcgagagagagagggaaaaatggggggaaagggagaggggatcacggggagtgatttccccctctttattgcacgcggggacggcgggaggcggcgggattcacggcggcggcggcgctagggcgcgggagaggcggcgggaggaaggggatgacaggtgggccccacccgtcagcgagggtggcgggcgggcccgcccgtcagcggcgcgcgcgcggggagaggctggatgggccgcggggagaggagagggagggggagggagatgggccgagccggcccaagagggaaaggggactttttagagtttttgtttttataaaatcattttaactttgtttatttcttaataattattatttgtgctctgaaaattccactaaaattatttacgcattttaggcttttaggaaatatacaaaaatcctccaagccttatttgacttttaaatttgcacattttaattgttggaggctttcacacggattttaattattctaggcataatttagaggatgtattttagagtcgttttgggacgtgacattacttgaccattcaggggcccgaacctgtataaaatttctgtctcgatctgttttacctcaatctcgcatatatcctagtaccaacaatccccatactacgcaaatactggaattacgacatcaaatgtcgacaattgtagcatttcaccaggaaatattctaaggtatcatatttatttaatcccaagggaagatatgataagggagaactatgctaatcatttatatattacttgtatatatcaaggtctatgtaggggttaagtagttcaaagggtaggataaaggtgacacacggaagaaagaactaagatattctcactaaaatataacctaggctaactggggatatgaaaagaaaagaatcaatcctatacttctagtatgcaaacatccttagtttacactcgctggtatacaatcatggaaccaataccccctaacagtgctctcctggtgtttcgagagatcacccttgattgcggagttccatatgacaacctgtcatggccatccaaccggggctaaatacggaggagtaccctccctaggaatgtgccttaggaatatatactaacatggaggaatacccgtaccgagctatcgccatcagcggcccatctctattgtctgcagcatatatgcccagataataatacttaataatccaagcaccatgcttagattactaaatactactctacatccatgaatccgacatagagcaaccgagttctcggacattaaaccctcaccaatgcacctctctgataagttagttacacaactatatcgacagaagtataaaataaagtcggtactcagataatataaagggaataaaataccgaagatgtataaagaaaaatattctattaattaaataagtcttagaaaaaaagagaggaaagttactagagccatacccgaaatctcttgaagactcgaggactaagaaaactattatatttcctactccactagcagtagagctctactaaacttgagtgagctctttgatcttcttcttgagtgtgtgttgtgaagcgagaatgagagcttcttaaataggcaggtatgacggttgtagagcatgcgaattgtcagaaatgtcgcgcaactgccataggacgtcatccggagcgtccacgccaaaccccagcctgaacggctaagacgggggttcaaccgaaccatgggctggcccaatcggccaaaattttgctccttacttcagtgacgtggtgtcttgggatttttgagattgtttcactggatttgtaagcccatttacctataagtctaactctcgacgatgtttgattgattattcaattattttccattgattctcctacattttatgtagaagtgaaatggatattatttgcttgcagagcaatggcaagcagagtgcaagcaaataatatccaagtacaagtggaaatagattattctaaagcgaatatgcattgcaagcatagctagttctcctttattttagttatattgacggtagaaattggcctataacgactgtcaaaagttatacaacatacccattgcatagacccaaccaaaccacctgaactaaactagtttgtcaagtcaaattattatggtgaggcaaatcacggtgaatctggttgacctcccataaccgagggcacggctatttgaatagttttactctgatcagaggtgtacaactgtactcacaagacacaatctcacaacacgttaccgtgttccgacatgccaccacgacataccggattgtgactatgacaggacccttcgcacacccccctaaccaatcgaatcacaccgtaggtttcgcccccactcctcaacaggcagtgggcagcaccctctcgtgcctaggtaaatccgaaagcagcttagaccatcgcagggcccatccatactccatcacgcccacccttgcccgggtacgtcgactaggtcaaaccacactgcaagtccagccgttgcccacgctaacttgtagtaagtatgggtaattcttccagtgtttcccatgaaccggtactttatcgtcatgagcacgagtgcacgaccatcaagaccatgtgctcacaaccgaccattatcaaatttcagttgacaaattatttaattaaccaaacacgattggccatcgtgagctaccattaaatgtccatcattaagtaatagtgaagcattaaatatcccaatagtgtgctaatgtttctaatcatgactaagcaattatatctaatatctagctgaaccaatatataaggcctaagctagtcaaattataacccataggaaaatataggaaaaagactcacaccacccaataacattcgaaaataaatgcacatttgaaataaatagagaatttaaatataggatcaacatgctcaaaggattgtggttgggatatatgtgacttgccttgcaaacaagcatcttcaattcgtctttaggaacttcccacgaacgagcaatccttcaaaacgactacaaactaaacctagaacacaaaatgaggaagaacactaataaaaccaaataaacagtataattaaaagtagagatgaatttagatgaattatgatacttgaacgacctcattccgagttcatatgaattagttatgaattaatgaagttttaatcaattaaaacctataaagaaaacaacctaaatgatttatggcatcatatagaattatttttgtactgataaaggaggaatatgacatcagcgaggagtgagaatggactgatgttgctgacaagcgggacccgcatgtcatagagacaagcggtagaccgggtctaatacgaactcggttcacagagaggtccacgggtccacgggatggatggctaggatttcattgatcagactttgatcatgatccgacggatgagatcgatccgatctagggttttgaggtggacgccacgcgagacaggcgatgaagtggctctgacgtggcatgccacgcgggatggacgccggcggctctagatgttggcgacagctgcgacttcagcgcggcggcagacacagagggcacggcgaggaagaggagaccgaggtaaaccttaccagcacttacgcgacattgaacggagaagtacggcgactggcgacgagcttcgagcggcagtgagatcgagatgatggtggcggcgccaccccagtgaacaccggcagaagagaaggggtggacggccttcccaaggtccttgcgaaaccaacggaggagacagcaaggtccggcgatgacgggtggtgaagcggcaaggcttcgccggagatcaaaacaaggcggcgagctcggccttcatggtgagggtggcttgcggggttcggcgcaggggagcgaatgtcaggggtggagcttggccttgcggagccgagggaggtggcggcgcaggttggtgacggccgaggcgacggcgaacgacggctggagttggtggcggcgacggagagagacggagctcgcttggagaggtggctaaggcatgggaggctcgggtaaaagagggaaaagggagaggaggtccggggctagcaatttatagcctcaggaagaaaagatcggatcgggtttgagaggaatcaatgatggaaaagctatggttcaccggataaacgatgctcgaaatcgtgtagaatccacgcaattttattcgggaatcaaggtggtttcttggggataaggtacagcagatcaagacgattccattctcgcaaccaacttgtgaaaaagagtaatggggaggctggatttgacggaggacgcggcgtcggctagagtacacgggcactgcacgggctctgtccaagctggaaaacgacactgtagcaggagggaatgagtttaaacttttctttctttcttggaccggatgaaagagggaggccaattggactttggccgagagatggagagggctgcaggctcggattgggccggcgggagagagaggaaggagaagaggattttctttactttttaatttataagtaaatgctgaaatgattttttattccgggaaaaatccagaaaatacttggaaactcatagtatttataagaattttatctagcccaatttgatgctcaaatatttcatagattttattcaaacacttactttaattattacataatttgtaaaatttcctttctcacaacaatttataatttagcaatttttagggtgtgacatgcacctcctatgtctattactctttgcctggtgatctccccctctccctgcgatcatctcactcaaccatacttcagtgattgaacctaggattataaactctaactccaactcgaacccaggattctaaactctaactccaactctttgtaggggtcattggagcaggagaagaagatgtcactggagctagagaagaacgaatcgcgaagcaaatcctaaagttctaagggtgtgtttagttcacgctaaaattagaagtttaattgaaattgaaacaatgtgacggaaaagttgaaagttatgtgtgtagaaaagttttgatgtaatagaaaagttggaagtctgaagaaaaagttagaaaataaaccaggcctaaatcctctcgtgtttctcttgtggaaccaagtactacctccgtctcaatttaagtgcattgctaagtttccgcgtccaatgtttgatcgtctgtcttatttgaaaattttataaaaaaattaaaaataattagtcacacataaaatactatttatattttatcatctaacaacaataaaaatactaatcataaaaatttttcaaataaaacggacggtcaaacgttgaacatgaacagtacaaaactacactctctcttttttaggatgggtagcaacatatactccacgtcgcattcaaccgtatttaattcacaaacggatgggcagtagttgttgttgtcatgaatactcggagaaaacaagccatcacaatcacgaattgaagaaagtccttcatttcacatcaacttcttgctaataccttagctcttaagcaacgcggtcctttaaaagactttggccatctatccaggaatcatcaacacaaataatacaagcaatcatcagaagatatctgcataaaaatggtggcactagacttgagaaatcctccctccgccgccacgaccgtcaaggaggaccagcagttcaccatcttcatcgacggcgtggagacagccctccacgagggtgtgatccagtggaacggcggcacggtcactttggtcagcacgggtgtcctcgcggtcgaccgtctccagcacgtcctggtgcgcggcgggggcagtggtgacgtgagcttcacccggtgcggcttcgcggccgcggaggcctgcggggtcgcgtcgttccatcggtgcgacgccgtgcgggcggacggggcgcgggaggtggccgtgcgccgatgcaggtccgcggacgtggagcgcgccggcgtggtggccatccgccggtgcaagggcgccgcgcgcgtgcgcggcgcgggggaacttcacgtcgggcggtgccacgaggccaacgtgggcgggtgcgcggacgtcgcggtaggccggtgtcgcgccgcgcgcgccgactggtgcggcgcgatcggcatcgagcggtgcgggtcggcggacgtgagtcggtgcggcgccgtccgcgtggatcgatgccgcgccgcgtccgtgtcgggctgcggcagcgtagcggtgcgccgtggcaaggtgaacgtgatcgaacagccgccggtttgtcaagagaagccgatgtaccacctcgtccacgctgagccagtctacgcgatccctttggaaatatcgagcgagattaaattgcagtagaccgggcagtgccagcgggctaaaggtctgatatgctgatgatatatatgcgtgtcggtgtgataagtatacgtaatatactattgtaatataatgtgtggtttgtacggagtatatatgcacaaggattatacttttaaataaagggacaacgttgacaaatgtaagggtggattgaaaaatgaacgaatcgaaaagaccaagaccaccgaaactgaaaagacaagatcgataaatttggtcgggcattttgttcgtcaattcggttagtcttctcggttaaccgaaaagatctaattaaaaaaaattcaaatgcaaccaacaatccactaagtttaatagaattaaaacctaatattcacatcctactccttttagccataaaacccaataaaagtctttactaagacgtgcttgcgaattctttttgtgtgatttttgtgttaaaatttttttatgatttctttgcatatactacctccgttttttataatatggcaccgctaactttttgttaaacgtttaactattcgtcttattcaattttttttgcgcaaatataaaaaatttgaagtcatgcttaaaacaacatttgatgataaaataaatataatgaatggttaaatgtattttgaaaagtcaatggcgtcatatagtaaaaaacggatgtagtgtttaactttttgtttaatctcggtttggaccgagaccgaatttaccgatcctgatatttttcaattaaaattcggtcctcactttttaatgactgaactgagaggaagactgaagaccaggaccaaaattttcagtctgaccgaatgcccatccatagacaaatagaatacagataaaaaaaaacaaagtcatctattaactttgagttcttctgtcaatttgcatacgtaacatttgctgcaactcttttacaacaatggtcaaaattaatttcgctcactaaaagaatcgcaaaagaaatgtgatgaggactgaagtcccgatcgtccattatgtactgataagtccattgtggagactgaaccaagatgaccgaaccactcacaatcacaaccccaccccttcgttggttatcaactgtgccaaagcgcggtcgacctcaccgataaagctatctcctacaaatgaatcgagaacaaaaacaagagagaagaagaaataatataaatatattgcatatatacaatgaagctcacaaattggggttccacaaaccgaactaagcggcgaaactgcaacagcagaataatctaagcaaaaccgcactctaaataatgatagttattgaataaatatgattagggttagctgtagggcatccacccctcgtgcttaagatgtgaccatggatgctattgagacaaccgctgctcacatcaagaacaaattaaacaagttctggaatccaattcaactgcctgcaacaatgttgatttcaaacgactgccagatgtgcatacgaccttcgttttgggtccattagtacttagtggaaagctttcggagtccgctttccaacggattcagcctcatctttgaattccgtctcgtttggccggaatcataggaacaaggtgacgcatcacctataataggcctatgggtttgtaactttgtctgggaccccggcccaagtagggcccatgtggggtgcaccccaaccaggtggagcacaaccctagggacaccaaggtcgtccttccaccttcttgaataactaggtacccgttaaggttttcttgggttttgtttagattgaagtttagccattgctacttgcttgtagcgcgcgtactaaactgtctgtctgcatgtctttggaacccaacttatcttgtgtattcaattcctatttgcaatatcggattactttgatcttgttcttacttgtttctcgatttgcttgcaataataaggttgacctacactggtgtcgacgtttgatatcgcgactacgtatttagatggtatggggattgttggtaccaggctatatgcgagattgaggtaaaagagatggagacagggatttttatacaggttcgagcctcttatcttacaggtaatagccctacatcctgttggccgaagccgatgttgctctttattcatctggatcacacaaataaaatatttgggataacatatctggctgtcgtcgacttgacggatagataaccaagtcgtagtcgacgatagggtagtctatctcctcgaatttgtactcggcgggatcagagatggcgctagatccctcttgccagcttccgtaggcaccggatggggtatggctaggctaatctttgatgtcgatatccggcgacgtgtgttggcttgtggctttgtggctttgtggctttgtggcctatcccctctcctcctagggggtttgtatttatacccatagataaccccttgtccaagtaagtatagggagataaatatggatatgatctgagtagtccttgtcgttttcatgtagaactcttcttgtccttccttatcccgaactccttctatatacgaggtttgtttccgtataagacatggtatgtggtgggccttgccgagcttagtcgattactattgggtatgtggtatccataaccctgacagtagccccgacttcaatgcaaatgaacgagttcatgttctcaaccgaagactttggaataactgttgtcatgctcgcttgaccgttctcggtgagatcagagatagtgctagattcctcttattggcctttgtaggcactatattggttttgtctaggttaatctctgatgtcgtccgagaagatacggaacatgcgactaagtctcccgtcgtgctgtaatcgagaatttggattgaagtcaagaaattccatctcggcgagtacacctttgcttcattccatattccttgtcgaactccagtagtcgttctcggataatcgagaaggtgcaaagtctgcgacaaagccttgaaatctgacttgactattctgatgtctgacttccctaatcaacattcgtcgtactcgcttaatcgatcccgctgtaagaccgtagagacatggagtcctcaacagcgttgaatggaattatcttgaaatcaattctcaaaacaaaatattaaatagagatagccctcaagcgaacgctcaagggtaacatgttctaatatgtatggaaaaattgaaaatcaattgaatctacgtgtaacaataaaagagtatgctggctagagttgccctcagcaaacggagtttggtactcctcctagcccctagccctatcctcggggaagtctgttctcggaggggaaggcccaatgacacgtaacttgcctagctgaaaatgcaattacctagcccccagccgtgaagttggaaaaaccaatttccaattacacggcttggttaatacgcattatggagcactcttacatgaccaggttttacatggtcgtttggctctttaggatctgacaagagcttatctgctctgggtgtccccagccgaaattcccttaggtttctcggaggcttgtcagactggcgtaaagggacaataatttcgatgtcaagagtaggtgttatcgtggttagggatctctggacaaatattgcacatataaacacttacagaagatgacgtagatgatgagataaccaccacactaggcaaagcccaggcgtatagttgtacccaataaatcgcataggtagtgggagaatcgctacatcgttggcagaaaaccagttgtagtcatatctcgaccactacgacctactggttcaagaaccaggagtaggagtctctcaaccgtttgaaattgaggtgcgaggactactacgctactggtcgaggaccagttatagtcgtaactcgacctttggaagtcgtggtacgaggaccgctacgctgccgatcgaagaccagtcgtagtcgtacatcgaccatcagaagtcgtggtgcgaggaccgctacgttgccgatcgaagactagtcgtagtcgtacctcgaccataagaagtcatggtgggaggaccgcaacgttgctggtcaaagactagtcgtaatcgtaccttgaccaccagaagtcgtggtgcgaggacctctacattgccggtcaaagactagtcgtagtcgtacctcgaccatcagaagtcgtggttcgaggaccgctacgttgccgattaaagactagtcgtagtcgtacctcgaccatttgaagggaatcagagtaatgtatggacgacattcccgtgacttgcgagaacaacctcctgatgaagacgaagacaatgaggaattatcgtagtcggaggttcggctcctgtacctactacctcatcctcggaccctctagaagtctggggatctcgagtttcgtcgtcgtcgtgtgatgtagttaaccgtgtccgttgtcgtcctgatgtcattagtcctcgacattgtcgtcctagtgacaacggcgatctagtcagtcttggttgtcgttatcacgacaatgctgattgtcccgttagatgtcgagagcttgctaaccgattagtcgaggaccaggagtaggcgtatcttgatcacctgaatatgaatttttaggtggtgagagatcgctacgatctactggccaaggaccaggcgaaggcgtatctcgatcacctaaagacgaattttcaggtggtgagaaatcgctacgatctactggtcgagaaccaggtgtatgcatatctcgatcaccttaagacgagattttaggtggtgagagatcgctacgatctactggtcgagaaccaggtgtaagcgtatctcggtcacccgaagacgaagttttaggtggtgagagattgctacgatctactggtcgagaaccaggtgtaggcatatctcgttcacccgaagacgaatttttaggtggtgagagatcgctacaatctactggtcgaggaccaggtgtaggcgtatctcgatcacctggagacaaattttcaggtggtgagagatcgctacaatctaccggtcgagaaccaagtgtaggcatatctcgatcacctggagttttaggtggtgagagatcgctacgatctaccggtcgataaccaggtgtaggcgtatctcgatcacctggagatgaatttttaggtggtgagagatcactacgatctactggtcgagaaccaggtgtaggcatatctcgatcaccaggagttttaggtggtgagagatcgctacgatctaccggtcgagaaccaggtgtaggcgtatctcgatcacttggagttttaggtggtgagagatcgctacgatctaccggtcgagaaccaggtgtaggcatatgtcgatcacctatgaatttttaggtggtgagaggtcgctacgatctactggtcaagaaccaggtgtaagcgtatctcgatcacctatgaatttttaggtggtaagagatcgctacgatcgactagtcgagaactaagtgtaggcatatctcgatcacctggaggggcgctagagttggtgattacatgcatctcatgtggccagcatgactcacatacccaacatatagcatatccggatgtctatttgcaatcatgtcgggtgatcaaaccgacgttatttgtgagggattatccgttaacgacatattctccaatagtccgggcgtggccggcgctatacatgagataagtcgtcagtcttcgttggtaggttgggtacgacgacttagcctttatcgagaaagttctcgacaatggggtgtactcgaccacaacctactcgagtgctcaattgtttctgaaaaatattttctagaagacaagatatataacagagaatatcgagtatgtactcaaaaaaactgcatgactcttctagtattattaggatataacgagcagattaaatattaggtattacgtaaaccgtaaacaagtatgatttatactaaagaaaatagagcgagccccagcattaaaccgtagttggccaatcatcggaaacattcgcacaatagatatgtataaaaaacatgctctaggtaaatataataaattattggtctcaatattatatgatctgatcgtggatagatgtgatttatctgaatagtcaacgcattgcactttaggcagccatattggtcttctctgcaggtacacgtgcacgcctgggcacgtactgagtccatgcatatgcacgtgtacatgtcaggagtaagcacgttgactcgttgtcttgttgttcagtagattacgccgtggtgattttgggcagcaatatatccggcctgagtagattaacacatggtttcctatcacgtggagtgacaggcacctgtcattcacctatccgtccggcctgttattgtgtccgaccaaagcacgcgttagccaggaaatcgatcagtgtagtagtcaattccggtctcccatggtgtcagcaacatcctcgagatcaccgatggtcgataatactgaacagatgtcttcagctgcggcgacgatggttccgatctcgtcggaagacatacttcggtcggattagatctccccagtcccccataaccgaagttgtcgagtagtttggtgttagagaatccatctcttgaaccaatttcatcgaaaccttgaagcaccaaactccccctacctggcgcgccactatcgatgtttgatatcgcgactacggtatttagatggtatagggatcactccacctacctggcgcgccactgtcgacatttgatatcgcgattacggtatttagatggtatagggatcgttggtaccagggtatatgcgagattgaggtaaaagagatggagacagggatttttatacaggttcgggcccttatcttacaggtaatagccctacatcctgttggccgaagccggtgttgctctttattcatctggatcacacagatacaatatttaggataatatatctagctgtcgtcgacttgacggatagatcaccaactcgtagtcgacgatagggtagtcttccttattgaatctatactcgacgagatcagagatggcgctagatccctcttgtcggcttccgtaggcaccaaatggggtatggctaggctaatctttgatgtcaatatccgacgacttgtgttggtgtcgtaggctctccagaccttccattataattaagagatgaagtgaataattcaagtcattaaacaagcataatgaagtagccgacgcctcgagaaaggaatattgaagacattgctgggctttaagcctgccagtgaacttcagtctgagtcaacttcagtctgagatgtgcccgtcaaaccactcgaaggcggtgacaagatgtgttacacattcaggagacttgataaaaatggctaaatatctacaacatctcaaatattctgaactcatactcatgtgaatctagttctgaggatgtgcactagattcacactttcatcttaagcatggacatacatagcaaacacaaataagatgaaagcgattaaaattacatctaacttagagatacataggccgaccgaccaaataaatatatagaacagcggaagcttatctacccaatccataaacacaccgactaggggtttaccccattaagttcaaatcctagaagaagcagtcgattacccgcatcactcaaatattaaatctaaaacctgcaagcaaaaggttaattcaatggcaagagtcagtacattattagaaataatgcactggcaagtaccaagacaaacctaacaccctacttgcaaggcatataatcaaggatggttctttttagcataaagcaagttttatttgcataaaacacattcaaatcagattttctttcaaataaatttcagcaagctagtacttaacatatgggcatcaaagtaggcattaatcatgtataaatatgcacctcattgccatccatggcagcaaggagatcattctgaaatctcaacataatttgaaggtaaattcaacatttagaagaataaacacaagtctatactcaatacatatccacacgctgttcatgaccgcgagcacggctaatcgattagtttttactctgcagagtttgtacactttacccacatgatgcgaaataataatcatgcaagagcatggcacgcgattcataagtatccgatttattactcacaacaaagcttttccaaaattcatgatttagccttacaccaacacgatacgtgttactccatcctaagccatacacgttatatgacctagaaccgttaagtggtgggcccacatcttaaacttaacaccgtggtggcggacataacgggaacccacccacgtggcacaatatggttgtattggatagacttagtcacctaaactaccacgtcggggtaaataggaagtttctctgagttatccgaactcatacacaccggcctactagaatgtaaggctgaaccataaataatttactaagcttgggctatcccatactagcacatgtggttgtactgtatacgaaatgaactgacattgagtgaagcccttaggtcggtttgggcacactctccccctatcggtactcaactaatcaccatatgtgcaccacttgaggcccaaacctaaaatccatgttttccatcattttatttatcaaaatcacaagtattaaagttctgtccagattatttaaaaatcaattttcatgtttgtaatgagcccataatgacaaggaagaccattctaagcatggctaagcattatagtaatctagtgactccaaaactcatatataaagtggtatagtcatattgttccaaaggttacgaatgagggatatggttatatgtggagttaaggtgataatgcaactagtaggggtttgtctaacaagtttaacaagattttagtttattagtgtacaatcgacatgcaagattttcaaacattttcaataacctccaaaacataggttcaatgtgatcaaagagagggaggtgggacttgccttgtaactggaaaatgtcagcacctaattcacttcttcaccgtttgagcaatcatctatacaaagtacacgttatgtaattaaacaccgaaatatgtgaaaaattcaaaatgctctaaaatgcatgatttgtgcacagtaaataggtactggtctaaaatgaatttaggtgaaagaatttctattttatctcatttcatttgagagttatgaattttagaagttttcgtcggtatagtataggatttacttaggtactattgtgaaatgctcttgtaaggtgattcttattaagtttatgtttgctagggtgaagatatatgttttctaagactaacacatttgatttcacaatttttagagttaatgtgaattctttatgtattttacaggttataacgtgttataggtgtatataggtgtatagtgttatataggttcatggctttagaggtttaggtccataacttgcctcatctagctagtgatgtacaaaatgagtattttagttaactaatctaaccttagttcataagcttatggtctttattatcatggttcatattcttataaactaggggagctctagtctatgctagcaatatattatatcaatctagaaattattatagaaattattatatgagctaagttcttctaagttatggtggatggggatggaactatggatccactggtcctaacaagttttatttggaattatttggagctaccatgcatatatatacttattgatatgtattgtttaaccactattatgtgttaagtacctatactaccaaattaaggtttagagctatggtatgaacagagggtgccatattccactctactaggttgaagtacattactttctggtcctatagaaatttggttcacttcatttaaaataaagatgaattttctacaaattttacaaattaaaggttgctctacgttggttattaattacataaatatttagaggcttttattacaaagtaagtatatgattttattttacaaattagaagtatatgttttggtgactctacataagttgggtttactcaaaaacgatctaacatgaattttatataaacttctaaagttcagcttatatatctaaaactattcattttaaagataatagttttagaggcattaggtacaaagtaagtatattattttatttcactttacagtggacaacaaattgatgattccgtgaaatgtgaatttaccctaaaatgagttgagatgaattttgtatgcattttataagtttgtgcatgctttatgtatattttttcttaaataaattttagaggtgaaatttgtactgcaagtgtaagttttcatttcataacattaaagttcatccttatatgagttcacagaaacttgaatcatctcaaaatgagttatatttgattttatatggatttttacaagttttaggtacttttcttatataatctcagattttgtttctaggggtccgctaacagtcatacggccaatatgcaaaaaagcccttgagatttctagaaaccaacccgcagtcttaggcccatatgtcagtgtttagtatgttttcatattgaaccttatgtttgtttaaattctcaacacgaagtcctgcgacctggacagaacagagcgccatggccgagctcgatctcgagctcgccggcgacaaacgatggctcgtttgggggtgcgaccaatacacaaaatgaagatcatgttattgcgatttcattcctatacatttctcagatagcggacattgaagcagcgccagcggtgagtccgagcagaggatgttttcgggtggtggtgcatgtcgtgctatcgactggatgtgttagtgatatgccctagaggcaatcatagagatgattgtatcacatactatgtttacatatttattcgatattattccttaaaatagataactcattattggttaatgaatatgtgattctttcatgacactatttatgttgtttgttactatttttaaaggatccctgatcaaatatcatatatggaacaaatatgtttatatgatcagcacatgtattaattgatgatcatgtctcatggatcatggtatagagataccaaattaataatgtggacacatgttgctgaacatgttgttggatagacccaacatgagacactggaagagccatatgtgttgtgtcatcagtgatctcatttagtgttggtgttgaatttttagacctgagattatcatggttcccaacatgtatagtagcttacttagggactgctaaacgctactccgtaattgggtaattataaaagtagtttccgggtatgctatgaaacatgtagtgggatatgaataatcaagatgggatttgctcctcctatggagagatatctctggacccctcgatgttgtagattatggaagtgcatggccatgccaaagatgattgaggagtcaatcacaagttatataatctatcaacaggttcgaatgaatgattgagctattagaggatggcacatatctagccttaagcttaatccatatcgtgaggcaaaggggttcatacaagtatacactagaggttcagccgatatgatctttatttatacccggtgggtcaatacgttctgctaggggccgctgttgacgcgtggaccgaaaaggagttttcgggttaaagccgagtatatatgaacctacagagttgcacgcttaatgggccggaataaggggattggatggagatccaatatgtgcttaattcggatagggatccgaataggagtcctacgggccttggaggcccgagtgatggatcctatatattcgtgaggggtgtgaccggcggaggcattgcatcacgtgagaaaccctagccgtcacttccctccccgagcaaaaccctagccgcgcgctagtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcgatcgactactttctctacatcgacgcgctaattcgcgagaattccttcgacttctcagcgtcttttccgctgtgcagcgcatcgaatggtaacgatctatgatctaatacctgcatggttcctggtttacgcgatagaaaattttgatttatgctatcgtagcctacgcgtatcccaataggatgtacccaaagggatgcatgcatgtatgttctataggctgcaggttgctcaccgaagctcggatgcgctacgggtaggcctggacagcgacgatgatgtagaggatgtcccggcggcggcggaaatcagcatagcaacggtgacaaccaccatccgaactccgggttgccaaaaaaaagagtggaacggctcaaagaccaactaaagatgctacacgagtcaggaattgcgccgaagctcacccgggatcaaggaatcgaagatcgacgccggcggccggagttggagaagatgacgccgatctccctcctcgattcaccgatccatgaggttctaggagtatcttgaagaggacgtctaggcgattctggtggcgcaagggttcggcttggggtggttcagtttggtcggaacgacgacaagaacccgacagcggtcatcgttgtgcgctccaaggcgtttgtgggcacggtggcattcccgctcaaccactgcatagaatgggatgaaattagatgaaatagagatggcattgagagtaggttttggaacgcaaaagaagaggaaacgaccgcggctcattaacgaatgtggctatcgtcttcttcgcggccggcgatggagaaacggtggagaagggcagcaaggatgctctccctcggttggatctgccctggaatggtgggtgaagagtggcgacgcgtctgggagaggcagagatggagctcggcgtttttagggcgtcgacacgtcgtggccacgcatcgaacgtgcccgagggctgtcggctcggtctctttctcagttctggtcggctagagaagttgcacagaggaagggcaagccaaggaggctgtcaggtgggtccaggtcggtgtaagctaggtgggggtgtgagggatgggtagataattgggtgcaagcgattttggacaaattttcaggattatttctcttacccatctttgttaattcatatattaatttgtggtacagatcaattcatgtggattttactgaagtagatgaatgtacctagtttccattttctttgattgcactcacgaattatggatagattgcacacagaaattaaaagaagataggctcaatggaaactgtttgaattttcaggagacataaacagagaagataaattctggaaaaattatatatattcataataaatggcctagtatttgaataaattgtttcccctatacactcccatgaagttaaatgcacttttaaacaaagtatggttttagccaattaggaattttaattagtctattatttaactgggttgacttatttatttgatgtaccaaatttagttattaaatcttaccaaaattacaatgagttgtatatgttaaatagagccttcatgaattttcccatggttttatcttgcacgaattattttagataattagcaagacttatctcttatatgtgtttccctttcctaaatgcatctaaatgtttataaaagttatatttggactcttcttaacctgaggtgatgttgatatgttagaattgcagtttaccttacatatgtcacaaactccttaccaatttatgtataagtttactttagtattaaattaagagaatgcttatcgagatgattaagatagaatataccctatatgagttaatttatttgttcacttccatgtacatgacttgtcttcagatggatgaccaaattagttttgtggggcttgacattggccttgttgatatattttaaggtgtatggtttctattttaacttcctctagctagcactaggccttaatggtttggttgtttatctagatcttagttatcattcatgagatctattatgaaatgcaaaacaaacatccaaatgcataagaaggacttaagtcaaaacatgatgtaagcgagtatgcatgctttcacttgtttttgcatctatggtataggttaaagatgaaaatgttttaatttgttctcaaattttacttcagtataagttagatcaacttcacctaggttttaaaatggaaatttttggttcacaaaattgaagaactttcctttcaactagttttgaagaaaattccttaatcctagaatttgggtatgttacagttggcttgtggctttgtggctttgtggctttgtgcccttgtggcctctcccctatcctcctagggtggcttgtatttatacccatagataaccccttgtccaagtaagaatacggagataaatatggatatgatctgagtagtccttgtcgtttccatgtagaactcttcttgtccttccttattcggaactccttctatatacgaggtttgtttccgtataagacatggtatgtggtgagccttgccgagcttagtcgattactattggtatgtggtatccataaccctgacaaccgtcaatatcaacaacccacgaagaggtgtatcgatctctaaggcgcaacaaaacaacgtcttgtacggttttagtcggatcatcaacatttacccaaatcgtagttatcaccaactcactgaatgatcaggccaatcatagccatgagtgtcttgagtggaactcatggtttatcaagtggtatttgcttggtgagttttttttatccacctataaccagaatatagccataaaaaatattggatccattacctagccatctttgtgcccgctgcattgttttttttagtttttgctttgttgagttttgtgttgcatcgtcgtgtcatgtttgttggtatttcttaacgctcacggataaaatctacaagcgcatggagatactgatgtagcacttcacccgggagtattccaaggtatcgatttctaaagctaatgtgtgtgcttaactcttctctagtttcatccaaggacacaaggcagatataggaaaagggtagagaggatttcctattgaggaacatggtctatacttcaggcactggcttactcactactgttggctgctgttaaatgccaattctatgccgccaatacctagataaaacatagttaataagacatccaacatagtggtagggtttaattctaacatattccatgagtgttgatacatatttggatgaaatccaaagttgggatgaaatcaagacttaagtgaaggaagaattgtcacgaccggaattaaccaaacgggcgttccttacgtgcgtgtattattccttgtcccaggaggcaaggtacaccaaaagttgatacatttcagagtttatcaagtggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgagtttgggaaaaattgagcaagactgagtacaaccaccgtactcaacaagacacacccacaagtgcaggataaatgcaagggagtacaaggggattataatataaagggttagagtttgtagtaaacagcattaaaagacacttagttgctcaaagctattttgtaaacacgattccagagctatacaatattattagtcaaggccgtgaacccacacgaacctaccttaacccaaggcctacgatgattcagaccgaactggcaacccgaccctgggtcccagctcgtcccaagccaacccaggccaaccattccacattttagttgttaagcatgttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacatgacatagtttccaacccatcctagccatagacaagagtaccgacccaaccccacctatggccggaacccccgggacaggtaggcaggactgagcccctagcagcaggacaccggccctgtgccatgacatctcgactaccgggccgcagctcgtgtagccttcatttgtcctagagatgtccatcgaccaccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaactattttgaggattttgaatagagggggaggtgtgaatccaatttccacaataatcaaaccattccatagtgtccaggtgatatgaatatcccaaagtctagagttgtaaaaccacccaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgtttaaggatgatgtgacttgccttgctcgctttcccaaacgtcggcttcaacttcaacgaagagcggatcttctgaagctgcagcgtctacacgaccaacgaaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattttaaaagggtttattgcgtcagccgaggggagggggcgcgcggaccgggtccacgggagtggggcccacgcggcagcctcacggtccacggtggaccgggtgcactcaggctcacaccggccggcgccgtgggtcccacgcgtcagccgcacccgagggcgcgggcggttgacggccgggccccacgcggcagccgctcggtgcgcccgaaggcggccacgtcggcgcggccggcgggaggcggcgcgcccgcgcccctatggtcgccggcggcggccatgggcacatcggagcggcggccgagagaggggagggaaagggggaaacgaggcggcggtccacggctcaccctaggtcgacggcgaggacgaaaaggcagccggagcggaggaaggcggctgcgcggctcgggtcgacggggacggcggcgctccggcggtcgacgagcgaaacggaggggtggacgaggtcggcgaggatgcggcgaagccgaaggaggcggcgctgaggtgggaggtggtctggggcgacgacggcggcggaccggagctcggcggcgacggcggagagaaagcgacggcgcgagctcgattccggcgaggaggaaggtcggcgagaggcggaaatggacggaggaggtgcggggagggtttaaatagggttggaagggggagagagcggccggtggggaaggaataggcgcgggaggtccggccgccatcaatggcgccggcgagatttgcgggggcaaatccgcccgtttgaacgcgagagagagagggaaaaatggggagaaagggagaggggatcacggggagtgatttcccccctctttattgcacgcggggacggcgggaggcggcgggattcgcggcggcggcggcgctagggcgcgggcgaggtggcgggagcggcgggaggaaggggatgacgggtgggccccacccgtcagcgagggtggcgggcgggcccgcccgtcagcggcgcgcgcgcggggagaggccggatgggccgcggggaaaggagagggagagggagggaaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttgggacgtgacaaacctaccccccttaaacggaatctcgaccccgagattcggaagaactggcgaagagatcgggatgggctgctttcatctcgtcttcacgctcccaagtagcttcttcctcagcgtggttgctccattggaccttgcaaaaacggattacctggttcctggtcctgcgctccatggtgtccaggattttcactggcctctccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttccccgcgtcgagcaatgatacggaaaggacccacaaaccaaggtgcgagcttccctttcgtctgaaacctgtgtacacctcgcaatggcgtgacccgaaggtacacaaaatcgtccactgcgaattccagattacggcgtcggttatctgcataactcttctgccgggactgtgccacctttagattatcctgaatggttctgactttagcttcagcttctgtcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcacatcttctaggatctgatttagacgctcggtctgtccatctgtctgcgggtgatacgcggtgctgaaatttaatcgggtacccagctcttcttggagcttcttccaaaagtgagaagtgaattggcttcccctatcagatacaattttcttaggaacgccatggagactcacgatcctagcgaagtagagctcggctagtttgttccctccataggtggtcttcacaggaataaaccgagctaccttggttagtcggtccacaattacccatatagaatcatatccgccttgggtttttggaagtccggtgatgaaatccatcccaatttcatcccatttccattctggtacttggagaggttggagaagaccggccggtcgttggtgctctgccttgacacgctggcacacatcacaaagggccacgaactctgcaatttcccgcttcatactaacccaccagtatttctctttcaagtctaagtacatcttcgtactgccagggtggatggaataagggctttcgtgagcttcctgaagtatcaactgtttaagttctctgtcgtctagaaggcatacccgatttccgttccatagggttccgtgttcatcctctgtgaaaccagcggctttaccctgtttcatattcttgaggagtccacgcatatccggatcattcttctgagcctcgcagatttgatcgagcaaggtaggcttggcttccagcgtagccaagaatccacgactaactatgcttaggttcagggcttccatctgttgattaagttcgggtggaatgccacggacgtcaagagtgttgcaatggctctttcgacttagagcgtcggcgaccacgttggccttaccaggatgatagtgaattcccacatcataatccttgatgagttctaaccatctcctctgccgaagattcagatccgactgagtgaagatgtatttaaaactcttatgatcagtatatatttcgcagcgattcccaatgagataatgccgccagatttttagagcatgaaccacagcggctaactccaaatcatgggtagggtagttgccttcatgaggccgaagctgccgggaggcataggctaccacatgaccttcctgcatgagcacacaccccaatccttggcgcgaagcgtcacagtacaccaggaagtccttgcgagtattcggtaagattaacactggcgaggaaaccagcttttctttgagagtttggaacgctttctcacattgcgggctccacacaaatttttcttccttcttcagcaactgcgtcatgggtctggcaattttggagaaattctcgatgaatcttcggtagtacccggccaaacccaaaaagctgcgaatttgagtgactgtcttgggttgcttccaatcagtgacggcggtcactgtttcggggtccacagcgactcctttagcagatatcacgtgccctaagaatttgacttcggaaaaccagaactcacacttgctaagcttggcatacaattgatgttcccgcaactttcccaacaccagacggagatggtgctgatggtcttcctctgattgtgagtacaccagaatgtcgtcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttagggatatcttcttcacgaatacgtaattggtgatatccggaacgaagatcaatattggagaatacagtggcacctttaagctgatcgaacagatcatcgatccagggaagagggtacttgtttttgatggtaacttcattgagagctctgtagtcaatgcacatcctctttgtcttgtctttcttctccacaaaaatcacaggagcaccctagggggaagtactcggccgtatataccccttttctttcaactcttccaactgtttcttgacttcggccagttcatttgatgccatacggtagggtcgcttgtacaggggagtggttcctggagcaagatctatccggaactcaatctctcgcttcggcgtcataccgggtagttcttccggaaacacgtctccgaactctctgacgatggggatttctgacagtcctatctgatgaagttctgaactaccgacagaggttgggggagcaaagaaaacaaccggttgttccggccctcggtaccgagtgacagtgcgtcttgcacaatccactactccttggaattgagccaaccaattcatcccaaggatcacatccaagttcttggtgtctagaagaatcagatccgagggaaaaggaattccctgaatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtgccaacgatgacgtctggagttgtcagcacatcctcggccgtcacgtggttcacccgaccccgaatgacatccttaccaccgttgttggggcggggaggcgcttggccttgctggcgcctcggctttgggcatttatccgcaaagtgcccatgctcgaagaagttgaagcacagacgctgctgaccttgaacgtccttgcggccttgaccaggctgcacggctggcgtaggaggatggggcgcacgagtcccttgctgactctgctgttgctgcggctgtgggacgcgcaccacgaattgaggtcggggcgcggagcgaggttgctgctgctgttgctgctgcgaggacgatccccctggatagggattggtgtagcggaccctttggttaggcccctgttgattgcggaaattcgccaagcgacgcttgtgcgactccagttccttgtgcttggcttccaagcggatgctcttgtcaaccaaacgctggaaatccggatagtccccggagaccagacgcacggacagctcagggtccattcctgccaagaacttctcttgcttctcctcatcttcacgaacatcctccggggcgtatcgggccaggttgttaaactcatgcaaatactccatcacagagcggttgccttgtttcaactctcggaattcccttttcttaagggccatgactccggcgggcacatgggttctccggaaagcggcggtgaagcgggcccaagtaataggctgcccttctggctgcgtagcctggaaatggtcccaccatagagatacgggcccctgcagttggtgagcggcaaagatgactttctcctcatcgttgcactgcacggtgtctaactttttccccacagcatgcaaccaatccaaagcatccacggggttattggagctagagaaggtaggcggacggatgcggaggaactcggcgagtttagagagttgtgggggcggtggtggagcattatattgtggcggattttggatgtggaggaaagcagccatcatgttggcctgctgggcgaggatttgggtggggatggcgttggtgtctcgtggtggtggtggaggcggaggaggaggtggaggtgggctgccatggttgttgtggttgctaccttcgggttggttgccatcaccggtattagcacttctcctggtcgtcaccatctgaaaatcccacacagaaccagcaaacagagagagctgacaattaaagctaaccacccacgactaccataattcttgaatttattactgctattaaattggttcattaaggttcaagttgcttaagcaaataaaataaagacaggctccgacacagttataccacacaccggcataaccatgccccatacgactctagcagaaaaacaaacgagaagaacacacgcgcaagcctactaactgctcgatcacccatcccaaattgctccaggccaagcacgcttaaccctagagttctttggagattggcttccggaaaagaaattgcagcttgttgatatgagtattctattaatcctattaagccctaggccaggatgttacaccctcacccccttaagagagatcgacgcccccgtcgatcaaccctaggccaggaacgtcctctcttggccacgtccatgtgtccagtgctagcgcatgtgccatgctgtgtaaccactcccggtctacaccagccatgcgcaccatgcctgcgcaactgcgacacacgtgcccgtgaaaccgcgagaaatacatcctctaaattatgcctagaataattaaaatccgtgtgaaagcctccaacaattaaaatgtgcaaagttaaaagtcaaataaggcttgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggctcggcccatctccctctcctctccccgcggcccatccggcctctccccgcgcgcgcgccgctgacgggcgggcccgcccgccaccctcgctgacgggtggggcccacctgtcatccccttcctcccgccgcctctcccgcgccctagcgccgccgccgccgccgcgaatcccgccacctcccgccgtccccgcgtgcaataaagagggggaaatcactccccgtgatcccctctccctttccccccatttttccctctctctctcgcgttcaaacgggcggatttgcccccgcaaatctcgccggcgccattgatggcggccggacctcccgcgcctattccttccccgcgggccgctctctcccccccttccaaccctatttaaaccctccccgcacctcctccgtccatttccgcctctcgccgcccttcctcctcgccggaatcgagctcgcgccgtcgctctctctccgccgtcgccgccgagctccggtccaccaccgtcgtcgccccagaccacctcccacctcggcgccgcctccttcggcttcgccgcatcctcgctgacctcgtccacccctccgtttcgctcgtcgaccaccggagcgccgccgtccccatcgacccgagccgcgccgccgccttcctccgctccggctgccttttcgtcgtcgccgtcgacctagggtgagccgtggaccaccgcctcgtttccccctttccctcccctctctcggccgccgctccgatgtgcccatggccaccgccggcgaccataggggcgcgggcgcgccgcctcccgccggccgcgccgacgtggccgccttcgggcgcaccgagcggctgccgcgtggggcccggccgtcagccgcccgcgccctcgggtgcggctcatgcgtgggacccacggcgccggccggtgtgagcccgagtgcacccggtccaccgtggaccgtgaggctgccgcgtgggccccactcccgtggacccggtccgcgcgccccctcccctcggctgacgtaataaacccttttaaaattaaaatttaaatgaagaaattcgcaaatattcatttaaagagcatataaacttcaaatggccataacttggccattcgaactcggaattagaccgttcaagtctctaatttttccttaagaagtcaagaacctttttttgtgctttgttcctgcttgttatatggagtttattagagtaaaagccttttcttttccgttggtcgtgtagacgctgcagcttcggaagatccgctcttcgtggaagttgaagtcacatcatccttgaacatattgaatcccagtttataaaattatgttgatttaaattattgcattatcgctttatttaaattcccgcgttatcactattttatctagccatgcctatttacctttgttatgaccttattattgttattgttattatttccttgttcaccctagaataaacaaaaccccaattagtggacactctactcatggtaccactactatgattttaggtagatgcttcgctggttaattaggcaatattaggtggttttacaactctagactttgggatattcgtatcacctagacactatggaatggtttgattattgtggaaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgccgtaggtggggttgggtcggtactcttgtctatggctaggatgggttggaaactatgtcacgtcttccgtccgtatactgtggtggtatgtggcacgtggttacacgtgaggaagatgtgtcttgtgggtaaagatgtacacctctgatcagagtataatctatttgaatagccgcgccctcggttatgggcaagccgagcaatgtacccaagttagtgttttaattcttaaaacatgcttaacaactaaaatgtggaatggttggcctgggtttgcttgggacgagctgggacccagggtcgggttgctagttcggtctgaatcatcgtaggccttgggttaaggcaggttcgtgtgggttcacggccttgactaataatattgtatagctctggaatcgtgtttacaaaatagctttgagcaactaagtgtcttttaatgctgtttactacaaaccctaaccctttatattataatccccttgtactcccttgcatttatcctgcacttgtgggtgtgtcttgttgagtacggtggttgtactcagtcttgctcaatttttcccaaacccagaagaggagcccctagaagatgaaggctttggtgtctagctcgtgcctaccgtcaagcgcctgtggtcgtcgccctagtattccgctgtttcccgtttgtctttgtgtgtgctgggccttcgccgcccatgtaataaattaactatttacgcttccacttgataaactctgaaatgtatcaacttttggtgtaccttgcctcctgggacaaggaataatacacgcacgtaaggaacgcccgttgggttaattccggtcatgacaagaattctatccatacaagagtgggccttaaacttcatcgaaacatcagaaaataggcccaactacctgagaaatggataaggcaagctgagagagagaacaggccaagttctggtcctgttgggcccagccagggttcggccggactccaatctcgaccgttcagtctagggttttcatggacgctccagatgctctccggatggtggttgcgggacattttcaataattcgcatagcagtaaccgccatacttgcctataaaaggagttaatcacttcacttctcagacacactccaagcttgagctgagttataagaggttctattgtactatattgtatactagaattagggagagagtaaagtagaagaagttggcggaattccggagttgtcggtaatcctctcttatttcttatactttgttaattactctgttttaatagaattatcattctgagtaattaagatttactcggtgagaattaattcttggttagtttctaattagcgtgcgggatcattgttcactatagtcctttaaaatatagtgattgctttagtgtttagctagcgctaaagtaattaattgtgtagacgtggtgccagggtaattaatttccggtggttgcttcgtatcccacagtaggtttgaggtgggtgtagaggtggtgacatccctcaattacactaaagtcctccttgtccgggtacgcagtagagtgacatctaggagcagcgagctggccagtgcctgaagtactaggattaaactgagctttctgtagacactatttctcactagtaaatcctctctatcctttgcttacctttgcttcgtgtccttggatgaacctgacaaggagctgagcacacacgttccctagggaaatcgataccttggaatacttccaggtgaagtgctacatcggtatcttccgtgtgcttgcggattttatctatgacgttaaaaaataccaacaaacatttctggcgccgttgccggggaatggttgatgttcatctccgaaccttgttcatcttcgtatcatttttacttttcattcttcaaccttcacccctgctatccccaataagtattcttgtaaaactcttctcacccatggagccacaatctatctttcaactatctgctccacggggcaaatcttttgagccacctccttcatcggggccaatttttacaactggctatgaaagtcgccccgaattaataaggagtctgcattctatctaggcatcactaccggaggatcattcatgcaataaactccatctgaaggaaaagtaagtctagatcggattctagaaaatacttccttcatggatcaatgtaatgaactcctcccggaagcatcagtgtctaggattgaggaacctccgacacccgaatcttagtctgaaccatctacctcaaccgattcggccgaggaaccttccgccgagccattgcctgttgagaacgaagaaattcaaactccgggatgtgctccaacgttcagggatgatctttatgaagattatggaaacaccttgaactattttagtaaaaagaaaccacctattcccttgccacctcctgatccgatagaatatcaatatctgaaagaaacggttcgggagctgacatccatcatgagtgacgaatggttaaaggaggaaaatgttgatgcaaaaaacacacactagcctaggagatctgcttagctccagtgcaggtcctaagaattgctttagggttttgagcatgccagctggtttgatcatgcaaccaacaagaaataaaagaagaacaattaagtccgcaaatgatagccgatcggctgtgttgccgatgatgtttcatttgatatcaggccgatgtgatgtgaaccagatcggcaataaaatactaaacaagatagaattaaatctacttgattggctgcagatatcaatgatatataatctttttctaaaaatatgtctaaactaagcgattgggatagatcggacagtgagccgagacagtataaatcacttatgtttaaaagtactttaagacaaagattatatatatttatagcttagccaatgaggtaaatctaagatatatcggctaatactctgataccatctatactaagatattaaaacagacaaaatataccaaacaacaagcttaatatatttctaagcaataagatcttaatataaagggcaagtttagcatgtcaaacaaataaaacaactaaaccaggtaagatcggctgaaaccccgatactatctctatcaataatcatagaacaagttagatattataattctagatattacttaatagatcgaacctaaccgatgcagcattaagtacaaaaagaagcataagatctagacaaaccgatgaaaatctctttgagatggtagatatactatataaactagatcaacgttgatatctaaccctatcggccgccttcttattaatagatattaaccgatctagggttagatagcaatattgattgagattttatagcgtatatgataactcgacgattcacataaacaagattagagtatcatgaagatgtaagcactaatcccgagaacgcaagccgccatgacaagttttacctctcatcggagatcgaaaccgatgcagcccaactcgaaagcaagaactcgtcgaaatagtgaaagtagaaaagggtggcaatgcgccgaaagtgttattgaattgtttttgtcattatacatggtcttgggttatatttacacccaaaatacataatgtatccttgccggacacgactctaaatctgttacaaccgtaagatacggacaagtcttttaggcagactcttgccggtaaatatctctaaggaaactacccacaatatcctaattaatagatacaattgcctatccgtgagctcatctcaatcatggcaatacttgtgcagcacgtcgatcaatcccaaagatgattgtagagccaccttagcgagatcggctccatcggctatcctctatctgattgtcacgcccagaaattcccgaatagaattccaagcaaaatgtacattaaaatccccgtccaggaccagccggggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctcgacggcacggacaaagcctactcctcggagaaaccttcatctgacccgaactcgaaatctggggttgggaaaagtagagcaagactgagtactacccactgtactcagcaagtcataccggaataggggtatgatgcagggaatcatcaaagaagagctgaagtggttcatttgcataaagcgagcatttataaacagaaagtgaaagatttaaacagttgtaataattaattaacatcaactatccactgtccaacgctaacccatgttgcgacaggcccaaccatccacctaaactatccaaattaaaagattgcactaaggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggaccctttgcataaccccctctagcaaagcacaccacacctcaggtttcacccccgtccccagcgggcaacgggcagtcccctctcgtgcctaggtgaatccggaagcgacagaggtcgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaaacggtgtcactaatccaacaacaccattggaaccaacagtctaaacattaatatgattttccccgttgtgaactagttgaactaagcatggctaagcaattcctagtccaaactctaatcatgttataaccccaagctaacaaaggagcatggtatccgaaaagcatggctgtaacaataggtaaccatcccatagtaatattataaaacaatgcaatatttgaaagaaaacaatagagcatttgcaatatatgatcaatatgttcaagtgacaagcatgacttgccttgctctgctgctggaggaacctcggcgactatctcgaagtaccccggagcgtcggaggaatcggaatctagcgacatacaaagcaaacattgcaaacaggctataagactactgaaacagggaacaaaaccatttttaatggattctgcacagttttcttgatttactgagacttgaatgggcttaaacggagctcggatgaattagttatggattttagaagattcactgtgtttattactataacagaaatccttaaataatttattgcgcaatattttccagggctgacgtcagcacaggggaagcggcgccgacatgcggggcccaccggtcagcggctcgggagagggaggaaagggcaccggcacgcgggcccactggtcagcggctcgggaggaaaggggcggcggcacccggctcggcttggctcaaggccggccgaccggccgcggcgacggcgacggcgcgcgcgcgaacgcgttgccggcgacggcaaccggcggcgaaggcgacggcgcaaaaggcgacgcgaaggcggctgcgctaagtggcggctaggaaggggagggaacgggcggcgataaaggcggccgccggctcggctcggcatcaaagccgacctgccggccaggtctagcggcgacggcatgcggccgacgacggcggcgaccggcggcacggaaggcgccggtgacggccgaaggcgacggtgcgcaacttgaagcggcggcgcggcactaggaggagaggaaggggaaaagaggggagggatgcctcaccgagggtggccggcgcggaggaagacgatggcgaacggcgacggcaagccacgggaggatacggcaaccggcggacgagcttccgggtgccctaaggaaggagaagagagggattagatagagggagatgaaccacggcgaccggtattcacggccgaaagcggcggtagcggttgaactcaccgcagcgcgaggggaggcgaatttcggcgacgaaactcgacggggaaggggcggccggggtggagcttagccttgcgaacccgacggcgaagacggcgtggtgcggcggcgaccctagcggcggctaatggcggccggagtagcggaaacagcggcggcaagaggttgcacggcgcgggagcgatgggaggctcgggagaggtcggcgaaatggggaaaaagcgagagggggcgacggagaagattaaattgggagagagagaaccggacgtggccgggagaggcgggaatcgccggccgacgtggggagtgggggaggagagagaggcgggattcgaaaatcgaatcccggccatctcggacgcgggcgcgggcgggagagagaggggagtgggcgcgggagacgcggcgcaagcgcggacgtggtcgacgtggcccgaaggaggcggagacgtgggcgcggcagcggttgcgggcgcggtggcgcgccgggagcggcgggaggtgggggaaggacccgacaggtgggccccacctgtcggcgaccccgagagaggagggcggcggggcggcctggctgggcctcggcctgcggccggcccagcagggagggggggagaaaggagagaatgggccggcggcccattcgggaaaaaaaagaggaaaagagaggaaaaagaaaagaaaaaaaaagaaaaaggaaaaaggattttccctagaattaaaatattgcttgctcaattttaattggttaaaattatttctagagctctgaaaattccactaaaaatcctgttaatgaatttcgacatgtataactcaagaaaaattccacatgtcaaatccgattattatttgcattactttcttagggttttctcttgatttctcctgcattttcttggggtcgttttaaaaattaaattttaggcttgggaggagaacttcggggtgtgacaaacctaccccccctttaaacggaatctcggccccgagattcggaggagctgctgaagaggtgcggatgggcggctttcaactcatcttccctttcccaggttgcttcctcttctgaatgatgactccactgaactcggcaaaacctggtgaccttatttctggttcttctttcgctggtatcaagtatacgaaccggcttctccacatatgttaggtcctcctggatatcaatgtgctccgaatcagcctgttcttcaggtacccttaagcacttctttaattgggacacatggaacacgtcatgggtgccgatcatattggatggaagttctaactgataagcaacttctccccttcgttccaagattttgtatagtcccacgaagcgtggtgccaacttgcctttcgtctgaaaccagtgtactccccggagcggagtgacacgaagatacacgtaatctcctgcctcaaaagtgagctcccttcgacggttatccgcgtagctcttctgtcgagactgagcaatcctcaatctttccctgatgattctgactttctcttctgcttccgctaatacttctgttccgaacagttgacgttcgcctgtctgatcccagaagagaggtgtgcgacacttccggccgtataaagcttcaaacggtgccatctgtagactggcctggtagctgttgttgtacgagaattccgcatatggcaagcttttgtcccaagctccaccaaaatcaagagcacaagctctcaacatatcttccaagatttgattgactcgctcggtctgaccatcagtttgcgggtgataggccgtgctgaaatttaaacgggtccccagttcttcctgtagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacaactacccagatcgattcgtgacccgatgatgtccggggcagtcctgttataaagtccattccaatctcctcccatttccattccgggatttgaagaggttgaagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcagttccttgtcgtcaggtacacacaatctttctcccaaccagattgtgccatgctcatcttcgtggaaatcccgggcttttccgacactcatgttctttttcagctctgctatttcagaatcatttgcttgagcgtaggccgtgcctccagagcggctacgaacccgagttcaacaattcccacgttgagatgctcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaagtcatgagttggataattcccttcgtgtggacgcaactgccgtgaggcatacgcaaccactctgccctcttgcattaggacacatccaagtccgtgacgggatgcatcacaatagacttggaagtctttcatcgggtcgggcagaatcaaaacgggtgcggatactaatttcttcttgagctcctcgaagctcttatcgcactcggctgtccatttaaacttctcatccttcttaagcaactgagtcatgggtcgggcgattctggagaaattttcgatgaatcgacggtaataaccttcaagtccaagaaaacttcgaatctacgacacggtcttcggtggggtccatttggtaactgactccacgttcgatgggtcgactgccacaccctgagctgtaatgacatggcccaaaaatttgacttccgtcaaccagaagtcacacttgctgaacttggcatatagctggtgctccctcaacttctcgagtaccagacggaaatgttgttcatgtttttcttcggactttgaatagataagaatgtcgtcgatgaacaccacaacaaacttgtccagaaattccatgaacactttgttcatcagattcatgaagaatgcgggtgcgttggtgagtccgaaagacataaccgtgcactcatatagcccgtaccgagtggtgaaggccgtcttcggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgtggtaatcaacgcacatcctcttcgtcttatcctttttctccacaaaaatgaccggagcacccaaaggtgaagtacttggtcgaatgtaccctttctgcagctgctcatcaacctgtttcttgacctctgctagttcgttggccgccatcctgtatggtctcttatagattggagcagttcccggtgccaagtcaatccggaattcaatctctctcttgggtggcatggtagtgaggtcttcggggaacacttctggatactcgcagactatgggtatatcttccaattttctcgagttcttctctacggtgtccactgggatttccgcttcaatctgattcaaagagacccctttctttggcgagactagagatttgtacaccacggtttctcccttctcgttgatcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcattggtgtgctaagttcctctcttattaacagatgcatcccgacaaatttctttgaaatgaaagaatgcgtcgcaccagaatcaaaaagtactgttgcagggattgagttaacagggaacgtacccagtacgacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgctccagtctccttcttggcttgcgcgggcgggcctgactgtgccggtgccattggtgggcgtgaagctgcaccgcggttggactgacctccatggtggttctgactgccactggcgccctggggaaagttgctagggttgaacgggcggtgctgacgaacgatcatggtggtaggtccaccctgctgcccaggagcgaagcgcggcctctggtgacttccctgaggtgccctgaactgtgcggccttcctcttcctgtccatcttgttgcgttgatcctcctggcggattgccttgtcaaccaacctctcaaagtcagcgtagtccccggatatcagttggttggtcagctcatcatccagacccgccatgaacttctcctgcttctcggcgtcggtgcggacatcctctggtgcatatcgcgcgaggcgattgaactcgtggaggtactctgtcacagtcctgttgccctgatggagtgcccggaattccctcttcttttgtgccacgaccccgtctggcacctgcgccttccagaagctacggcagaactctgcccatgtgacttcagtacctggtgggcgggtggccatgtgattgtcccaccaagctgacgcgggaccctgaagctggtgtgtggcgaaagcgaccttctcctgatcattgcactgcaggcgattcagcttcttctctatggcatggagccagtcattcgcctccatggggttggtggtgcttgagaaggtgggtggcctgacgcgtagaaactctggcaacttggactgagggggagggggaccaaactgctggtgctgctgttcgacgtgctgcatcatcctctggtgcatctgctggtgctgctgctgcatctgctgcatcatggctgccatcatctgagtctgatgtgccataacttgggcaagggtcggattctcgggaagtggtggcggaccattgccggaatcactgctggggtgcacaccatcagcgcgttcttcgccgttgctgccctcgcctgttgcgcggctaccattcctggtgtagaccatctggagggaaaagcagacggggaaaagaagaaaaacagatgctcaggaactaagctttattacaaaggaattaaaactgcaattgttctgatctgaattaaaacacttaaagagcaagcaaaaatccttattaagacagccatatcataggcacatgatatcgactgtcgactaaccccaaacaagcaacctaaacacacaaattaacaagcagaagctagacagtcgataaactaatggaaaacgagcctaatgctcggaacggctcctgcggtcggtggagtcgaagacgtcctcctgctcgtcaccaagtccctctgagcgactcccggagcctggcagataagtctcgccactgcctgactctgagccactgggagtagcagacaaccaacctccattgccactggctggacccctggcggctgatgcgggagcgaaggagagagcggacgcaggagctggagctgcaggaactgccggagctgcgggcggaactggaggtgctgcgggagctgcggatggaggtgggttcctgggcgcaagctggatgcgcacgggtgccgtcgtcgtcttgcggggcgtagtgcggatccggactcctcctggcgctggaagaccctttagctgagcgttctccctcttcaggcgcgctatcttgtccttcagagcgacgatcctcatgagcttcccatcgttcaaggccttggtcgccttgtgcaggtctgagtgcatcctgtccaatcccctcatcacagcacacatgtgaccaaaggtggtgtcgttctcgccagctgtcggatggaaggagctgacgtcatcaccgttggctcgacgggggtggaagcggtacgccgtgtcgtggaagatgtagttgtggcactcccgtagtctggccatcatcaagtaggctgcctcctgacaggcgtgatctgctgtgcctccagatgcctcgaccaccatgttagctaggcaggtacccacgtagccgtggacctccaagcgaacacggtgaggaagctcgccactgagcggtggaatcgtcgtatactctggcgcgttggggtagcccaccaccaatgtcatgcgtgccaactctgccacaaagtcgatcatgccttctccgcggtggttgggtgggtggccggccatctagagaagacagaggagtaggatcaatgcatgctcaaatccaagtttaaataaagcaataaaagactcaaataagagaatcgaatgaaagcgaaatttttatgcatagatcattttgcatgagagcgaataaataagacagactcacataacgataaaataatgagaaattagatacatactaataataacaaataaagcataaataccttgcaacccatgttcctgagctaggacctaatgcatttcacccatcaaatcccaactgactgacgaataaatctcaacagttttactaaaaccctggactgacttgttttgacaaatctcactttaaacgagcgaccaagatttttcccttgaaccacaaaaactgatcccaattttcccggaataaaatccaattgcaaggaacatatgcaatgaaaaggattcagagggctcttaggtttttccatttggcttgtcctacggtcaatgtcggatctgataccaacttgtcacgcccagaaattcccgaatagaattccaagcaaaatgtgcattaaaatccccgtccaggaccagccggggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctcgacggcacggacaaagcctactcctcggagaaaccttcatctgacccgaactcgaaatctggggttgggaaaagtagagcaagactgagtactacccactgtactcagcaagtcataccggaataggggtatgatgcagggaatcatcaaagaagagctgaagtggttcatttgcataaagcgagcatttataaacagaaagtgaaagatttaaacagttgtaataattaattaacatcaactatccactgtccaacgctaacccatgttgcgacaggcccaaccatccacctaaactatccaaattaaaagattacactaaggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggaccctttgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaaacggtgtcactaatccaacaacaccattggaaccaatagtctaaacattaatatgattttccccgttgtgaactagttgaactaagcatggctaagcaattcctagtccaaactctaatcatgttataaccccaagctaacaaaggagcatggtatccgaaaagcatggctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatctcgaagtaccccggagcgtcggaggaatcggaatctagcgacatacaaagcaaacattgcaaacaggctataagactactgaaacagggaacaaaaccatttttaatggattctgcacagttttcttgatttactgagacttgaatgggcttaaacggagctcggatgaattagttatggattttagaagattcactgtgtttattactataacagaaatccttaaataatttattgcgcaatattttccagggctgacgtcagcacaggggaagcggcgccgacatgcggggcccaccggtcagcggctcgggagagggaggaaagggcaccggcacgcgggcccactggtcagcggctcgggaggaaaggggcggcggcacccggctcggcttggctcaaggccggccgaccggccgcggcgacggcgacggcgcgcgcgcgaacgcgttgccggcgacggcaaccggcggcgaaggcgacggcgcaaaaggcgacgcgaaggcggctgcgctaagtggcggctaggaaggggagggaacgggcggcgataaaggcggccgccggctcggctcggcatcaaagccgacctgccggccaggtctagcggcgacggcatgcggccgacgacggcggcgaccggcggcacgggaggcggcggtggcggccgaaggcgacggtgcgcaacttgaagcggcggcgcggcactaggaggagaggaaggggaaaagaggggagggatgcctcaccgagggtggccggcgcggaggaagacgatggcgaacggcgacggcaagccacgggaggatacggcaaccggcggacgagcttccgggtgccctaaggaaggagaagagagggattagatagagggagatgaaccacggcgaccggtattcacggccgaaagcggcggtagcggttgaactcaccgcagcgcgaggggaggcgaatttcggcgacgaaactcgacggggaaggggcggccggggtggagcttagccttgcgaacccgacggcgaagacggcgtggtgcggcggcgaccctagcggcggctaatggcggccggagtagcggaaacagcggcggcaagaggttgcacggcgcgggagcgatgggaggctcgggagaggtcggcgaaatggggaaaaagcgagagggggcgacggagaagattaaatagggagagagaaccggacgtggccgggagaggtgggaatcgccggccgacgtggggagtgggggaggagagagaggcgggattcgaaaatcgaatcccggccatctcggacgcgggcgcgggcgggagagagaggggagtgggcgcgggagacgcggcgcaagcgcggacgtggtcgacgtggcccgaaggaggcggagacgtgggcgcggcggcggttgcgggcgcggtggcgcgccgggagcggcgggaggtgggggaaggacccgacaggtgggccccacctgtcggcgaccccgagagaggagggcggcggggcggcctggctgggcctcggcctgcggccggcccagcagggaggggggagaaaggagagaatgggccggcggcccattcgggaaaaaaaagaggaaaagagaggaaaaagaaaagaaaaaaaaagaaaaaggaaaaaggattttccctggaattaaaatattgcttgctaaattttaattggtgaaaattatttctagagctctgaaaattccactaaaaatcctgttaatgaatttcgacatgtagaactcaagaaaaattccacatgtcaaatccgattattatttgcattactttcttagggttttctcttgatttcacctgcattttcttggggtcgttttaaaaattaaattttaggcttgggaggagaacttcggggtgtgacactgatccatcattagccgatgcagtcacttagctgatgcctttcgtagctgatgcgtactctgtttctgagaaacgatcctccgccaaatccgattcgattttgatgcatgtcctaccaaatttggtcatcaacagcagagctttcttccagagtaattcggatcattaccactcctcgaaccattccatgttgccacgtcgggtcttttaactgaaatgcatcaatccacaatactagtacctgctctacaatctcagtggttaatgatgcatgtcagtatgatgttactaagctatgcgactcttttgtgcggatccttattatccgccgctcttctaatgattagatttcgaaagaatttagatttcttttcgaaaaagaagaaaaatgttttgcttaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatacatatacatatacatatacatacatatatatgtataatgtatataaattccagaaccctttgcgatcacttacctgagcgacaagacaattacaccgactaacaaattcttcaagcatcccaacgggaatcttattgaaggatttgagattgtccaggatgtgcccatcattcatgacgacaaagaggcaatcttgaaatcatgtctttgaaatccatgaaattgatgttctaatcaggcatcccatcgagaaacttcttatcaacaccctcgattaggcagcctcaaattctctttaggagggaatgagttttcaatcccattcaagcaatcaaggttcgccttgactgactccattcctgaagatgaatatgcggaggaagtaacggttgttctaccatctgagtcccctgaaccatgtcttgagaatgatgtcccagacttctgttgatgcgaaaaacacacactggcctgagaaatttgctttactctagtgcaggttcaaagatttgctttcgggtttaggtcgtgccagttggtttgatcctgcaaccaacaagaaacaaagaatccaaagttaaatctataaacgatagccgatcggctggattgccgatgacgtatcgtttaacactggaccaatgtaacatggatcagatcagcagtgaaatatataataatgaaagaattagatctactcgatcggctgtagatatcaataatatataatcaatgcttcgaaaatatatttaaactaagtgattgggatagatcggacagcatgccgagacagtataaatcacttatgtctaaaactacttcagagcaaagattatatatattcatagcatagccgataggataaatctaatatgtatcggctagtactctgataccactttgtactaagatatcaatatagattcaatataccaaacagaaatcaatctaacatcgggataacttaaaaggttgataacaagtttaatatattttatccaagtgagatcttaatataaatggtagatttagtatagcaagttaacatatatgaaacaaaataactaaatcaggtaagatcggctgaaaccctgatactatctctattgaaaatcataaaacaagtgtaacataccaggaatttcacctagggaaaattttttgtggaaaatttaaaactttctgaattctaaagttttcggtgaacatagaagcatactagagcatataactcccttaaataaaataaacacatagtctagttgggaaaaatcaaaccaaagaccaaaataaaagtttacaaatcttgtggtaataaatttcaaaataaaatattttgctttgaccttaaactggaaacctaatcttcttggttttgaattgctaacctaactaaaaataattaagtcatatataaaacaaatggaaaggtaggtttcaaaataagcacatctgaattgagataaaatgaacttgcttggttgtgcatattattgttttaagattgtttttggatcttcttggtgcatctcataatagattgcatatgcatgtcatgtctaaagaaaattcttaaaaatagatgaatcaacaattaatcccacaaaaattctcataaatactacacaacaccctaatctcccagtaattttagtttgaatttatcacatcaactagtaccacaaataaattcttcaactcagcaataaatctgaaaccagcataccaattagcctactttgcataatcatcaaattttaaccataacttatttatcaaagccccttgtcagaatgttaattatacattactctacaacctgatgcaatggcttcgtctaattcgaaatataaccaaaggaattgagagccaaaagttaggtaaacagtattctaaaatgcaatcaacaatccacctagtcaactttactaaattactatggtaaaagcaaaagtaattaaatcttggaacttggcacatttgatacatcacatacttgtctagctttctgtctccttgtcccccccttaattaaaaattgaatggatgggaggatgagagtaatctagtaaaatgaaatagtgccaacacttgggaaaatttagagcttctagttctctctttctacatctctcccttacatgtgggaccaagtccttgcggggcccactcatcatacaatcacagccaacacatcatctactcttcactcttttaaatcttcttttttttctcaaaaggtgagagaagggtttaaaatcaattttcacttaaagtaccaccttacgtctcgtacatttctaggaaatcacttcatagggcccaattgtcatttacatcacagccacaacatctcttcacctctctttgtttatgtgattaaataccatgaagggggagaaaagtagtccgaaggagtagttgctaatttctatttgatggtagtttaccctagttttctagggtttcttttttcctcaggcggcgcccccgtctgagttctatcgttcaaaacaatctggtgtaaggtgttttctccttctcgcgaagtgagagatcgttaaacccttcgctgagaaagttttctcggggatcaaggtagtatggcagatactcgatcatctgccgaggatgaaaccaagcgccctacggaggaggagactgggcgtgatggagagatgggatccgaaccaaatctggaagagagattgaagaggttgaatatgcatggggaggaggaaactgacctagatttctcggaggaattggaagggctgatcaaggacgtacgctggctcgctctttttagggtttatactacaaaaccctttagccactcagcgctgttgaatgctatgagaaacgcctggtcttcggcacaggatatctcgtttaaggtaatggattcaaatctctttatggtacaatttcaatgccttggtgattggaacagagtcatggaaggaggtccatggatctttagaggagctcctgtagtccttaaagaatatgatggcttcactaatgtgtttgattataagttggataaaattccagtttggacgcgcattcatggggtgcctgatgggttgatgaagaagagagaactagcagagagggttgctaagaaggttggtgaacaaccattcacagttatagtagatgaggggagaatcaatcctgttaaatacctcagagctagggttttcttagatttgagtaaacccctcgtgcggtttgtcccaatcacgatcaaggaaagaatattgtatccagtaacttatgaaaggatgccaacgttctgttacttctgtggaatgattggatgagcaaaaagagattttgttacgcattgaactcattctagagcaagaggaaatctactggattcagagagcgagagcaaattggttgaaacatggtgaccgtaacaccagtttctttcaacaatttgctgcacagagaagaagaagaaagaaaattaagggacttattgatgagaatggatgttttcaaaccgatgaagacagaatgagtaacatagtttatgggtacttccaaaatctcttctcggctgaggttacacaaatagatggatcttctttgctggatgtacagagaaaagtaacgggagatatgaattttggattactagcaccgtatacagctgaagaggtgaaaaatgctctgttcagtataggtgatctgaaagctccgggaccagatgggctgcacgctgttttctataaaagattctgggatatgttggagagtgatctggttaaagaagttcttgatgcaataaatacaatgaaaattccagatggatggaatgacacaactgttgtcatgattccaaaggttgataaaccagacagagtaactcaatttagacccattagcttatgtaatgtggtctataaaataatttctaagatgttagcaaaccggctaaagtgtcttctccctgaaataataagtgatcagcagagtgcttttgtcccgggcaggttgatcacggataatgttttggtagcttatgagtgcttacacacaatgaaaaagaagaaaggaagaaaaggtctgtgtgcagtgaagctagatatgcacaaagcatatgatcgggttgaatggatgtacctggaacaaatcatgttgaaattaggctttgatagccgctgggttcagttaataatgtcttgtgtttcttcagttcagtacagggtgaatttcaatggtgtattgacagaggttattaagccttctcgaggcttaaggcagggggatcccttatccccatacctttttttgcttgttgctgagggtctatcgagtatgctgcaaggagctgaaaatagaggagacttagtgggaatcagagtgtgtcgtgaagcaccgatgatatcacacttgttatttgcggatgattctctaatattgatgcaagcagacaagaataatgctgatcatctgaaagcaattttggatatttactgtcaaaattctggacagaaaatcagtgaagcgaagtcgagtattttcttcagtagaaatactgcagtcgaagataaagctgctgtctgtggatctctagatattatgactgaagctttaaacgacaaatatcttggactcccagcgatgataggtgttgataagagtgattgttttcgacacctgattgatagagtcaacaaccggataaatggacggaaggagaagatgttgagtacaggggggaaggaagtgcttataaaatcaatcgctcaggctataccagtttttgcgatgtctgttttcaggataccgaaaaaaatatgtgactgtatctctgaagcaatcgcgcgattctggtggggtgatgatgaaaatcacagaagaatacattggaaggcttggtggaggatgtgcattccaaaacaaagaggtggtctgggttttagggacttatattgttttaatcgagcgatgcttgctaaacagatatggagattcctgtgtgatcctgactcactgtgtgcaagggtaatgcgatgcaaatactatccggatggaaatattttgagggcaagaccgaaaaagggtagttcttatgcttggcaaagcattctatctggttcggaatgctttaaaggctacatatggagaattggagatggatcccaagttaatatatgggaagatagtttgataccttcaagcagtaatgggaaggttttaacacctcgaggaaggaacattatcacaaaagttgaagaactgatcaatccagtaagtggtggatgggatgaagacctgatagataccttgttctggcctattgatgctaaccgaattctacaaatccctatttcagccgggagagaggattttgttgcttggcatcacactcggtcaggaattttttcagttcggtctgcttaccattgtcagtggaatgcaaagtttgggagcaaggagagactgcctgatggtgcaagtagctcgagcaggccggtctgggacaacctgtggaaactggaaattccacccaagataaaaatctttgcatggagaatgttgcatggtgtgattccctgtaaaggcatcttagctgacaaacacattgcagtccaaggtggttgtccggtttgttcttcaggagttgaagatatcaagcatatggtttttacttgtagaagagcaaagttgatttggaagcagctaggcatatggagcagaatacaaccgattctgggtttcgaccggtcaggatcagttctggtggaggagatgataaggaagggtgggaaggtttcgcatctgaatgctattggaatgacggaattgatcttaacgggagcttggtatatttggtgggagagaagacagttggtgcagggggaacgaatacagaaccctgctcggtcggcaatgtctattgctaccttaaccacaaactatatgttgtcaaataagaaaggtaaaacaaaaattcagaacggttggaagaaacctcctgaaggaatgctaatgatcaatgttgatgctgccttcgattttgattcaggaagtggaggtattggggtggtgttgagagatcacttgggagcttgtgttgcggcttcgcaagcttttcttccacatgtccttgatgcaccgatggcagaggcttttgcgctgagagatgggctgtccctggcacaacacattggtgctaaaaatgttatagtacaaactgattgtatgcaggtggtttcaacgatgatggatggaggattttctgctacagcggctatgtctgtgtttgatgattgcaagctgatgtgggatgggtttggtacaatttctattgagcactgtaatagaaactccaatcaggtggctcatgaactggccaggttagcgtttaggacaaaaaattcttgtacttgggtcgatgaaccccctggctgtgttctgaaccatctggtaaatgatgtaacaattttatcctatcaataaagctagccgaatggcattcccccaaaaaaaaatataccatgaagggggagagagagggaaaaaaggttccaatatccatttctcacccaattcctccctccaccctatctttcatctaggaaacatctccatggaccacttgacagccattatagctagtttgggtgatgtaggtgaggttgcaacgccctaaactcagccaccatcttaaaaacgtgtatattccatattgacacctagcatgtcattgtcttcactttcaccatttagtgagccacttcgccactgaattcatctatcatcctaatcttgttccatagaaataaacttcaagaactcccatgtattgccaagaatgttctcttctttctttccatcgaagatgtttgatcggtcgcaaatcttctctggtgagcttcgccgcattccaaccatggaaatgtgattcaattcccctacctgatcaatcatgtctcttaacaccttgtgccaagctcgacgccgctctcagtgtccagagcgccgccgtcggccacttcgccgttccggtcgactcgagcctccgctgaccaagccattgcgccaccgacgtcgcctaggtccctggagaaggacgcgtaaagaagatcgagctaaaacgccgccgttgaggagatcgaactcttcttccccaagtccggccgccggccatcgtcgtcaattccccgctcccgggtgagcttcggcgctattcctcgcatatgaagcatccttaggtgatctttgatccatttcccttctcttcttggcagcccaaagaccggaggaagccgacgccgtcgtaccgccgttttccgccgccaccggagcgttcctcggttcaccgtcgtcgtccaagcttcgtcggtgtacgtgcgactcaagtgagtcttcaggagtcccgtagaggcacatgcatgcacacatttggcacaaatcgagccgtagctctaaatggcgcatcaccccgaagcacaccgccgctcgcgctgccgccgtcgttgactccagccaccacagcccgcgataccaccgccattagtttcgccatcttccactctacattttctcttttggctgcatcgtgaggacggccaccgttcgtcgccggcgccggcgagaagctcgccggggcgccacagccctgtcctcctccacctagtgtcactgacaagcgggacccacttcattgggtgctaagaatttgattagtatgagtttaaatcttgtaggattttatttctaaatgttctctgcatgacatgttgacccaggacctattagtaaaagtataaaacttggagcactctttatgaagatagtattaaacatgtgataaggacttcggcctatattcctagaaacctcagggacttttctgcatatttactctcactcaccagtggaccccattttttaaaatctggaaaataataaaagaaatacccaaacaaatatatgtttaacagaaaaatgcacaaacttggcacatgtagtacaattttgaggtaattccagttgctatagattcacaaagatatgaaatttaatataaaaacctaaaacttggcacacgtagtacaatttttgcctctaaaattcatctaatataaatcacacataaagcttgctcaaacttagaaaattcatataaacttcattttaactcattttggagtgaacaaagttccagtgtgctcataaaaccatactcttaattttcatgaactaaaacttaataccttctgtaataaaaacatcaccaaataattaattagtaaaataactggtatagtgcaaactagaaactacaaaatccataagtaatttgttttaactccaattgagacaaactaaaatttcttagtttgataaaagaatgtatattagttctgtaaacaaatctatagaagaatccatatccgaaaacattactaaaatttgaataatgaattaatattaagaaacttctaaaaattcatatcaaatttaatacaactccaaatgaggtgatttcagatttgttagattagcaaaatcttggacattagtttttataaaataaaatatagcacttacagtacccaaaacatatctaaaatgcgaaataactaataactactatagtatatcacttagcttgtaaaatttataataaaaacattctaactctacaaattgtgaaaccaattttgttgaaatcctgagaatatccttttcactgcagtaacccagcatttcataaaacttagacctaaaatgcatctatgtactattagagcttaattaatctagtgctagtattaaactttgaaaattaataactcccaaatgcaaagtgataaaatataaattccttcaccacaaatcttacccacacagcacctaatcacactagtaaactcatgcattttagagcattttgaattattgcatgttttggtatttatcgttacttttatttcttttagacggcgaaatcgttaccggtgaaggagatggattatagctaaactcagttaggtcatatatattctaaggcaagttttgcccttccttgaatcctatgttttcgggctaaatgctttgattataaagctgcacgtgtatttttgattataaacatgcatgaaaccccttttgaaaatcaccccttgctgttttgaaccttaggatttatgagagtactttaattgtgctcatataagtatactatacttttacaaaatgcaaatgcttagcctagcttagtaataaataaaaacatggttatggatcacttattatacttttgaaaacccttttgaactttatggacagaggtgattctctgattatttgtgaaataaaatgagataaaatatgattttagacttgggcgggaagtggtatgcatatgtgatgtgaccatggctactatggatacaaccaccactcacatcatggatgaacaacaaaatatcaagatcaagtcctccaagtgctggaatccgattcgtacaactgctacactgctgacttcaaacggccaccgaatctgtatacgacctccgtttttgccccgtgagtacttgatggaaagctctcggagtcctctttccaatggatccagcctcattaccaaattccatctcagtcggcagcaattgaagaaacaagttggtgcgacacctgtaatgggcctatgggcttgtaacttcatataggacgccggcccaagtgatgcccatctggggtgcaccccaatctagtggagcacgaccctaggagcctcttggtcgtcctcccacctctttaaattgctaggtaccccttcagggtttctcgggttttgttagattaaagtttaaccattgctacttgcttgtagcgtgcatgtcggctacaccgtccgtctgcttgttcttcagaatcccatcttatcatttgtattcaattactatttgcaatatcagattgcttttatcttgttctttcttgtttcttcgatttgcttgcaggaatagggttgatttgcaccggcaagatcaacaacccacggagaggtgtatcgatcactaaagcgcaacgcaacgtcttgtatggttgtagtcgggtcgtcaacttttctcccaaatcgtagttatctcaactcaccaaaagatcgggccaacaacagccataagtgtcgagtggaactcagggttcatcaggtggtatcagagctttcgttgcccggtgagtttttatctacctataaccggaaaattgccatacaaaaaaaattgcatcctgtacctagctatatttgtgccatttcattgttctttcagtttttgctttgttgagttttgtgttgcatcgttgcgttgagttgctggtcttagcgtctagttcgtttagagtttcgagttcttggcaggtctactaccactgtcgtcgcttgccgccgtcatctttgttgtcgtcgggacctacgaaaacggaatcgtctttccgtcaaggttctatttttgtagttttcaaaagtttctactcatcggttttggagttgttgagttgcaattagggattgccagcttggccatgtttctattttggccgtgcttgtgtcgcgcacgagaggaggaaggtgaattaccaaatctgattttggaagtagtcaagtttgttttggaaagatatagtagattggattggctggaaatcagtttcccttttagattgcaccaaatccgaactctaattgcggccgtatccatctactccatctaaccaccgtaccttccacctcctcacggttgtaccggagttgctacacaccttgatgaaaattttttcggtgtcagattcaagatctgtttgcataaacagcactggcataaattcaacattccattttttttttgtataatttcaatttttaggttcggacttttacatttgagtccctgtaattttatctttacatttgaatccctataatgttgcatccgggtccttgagtcggtttttgttaaaaaaaatcagaaaaaaggagagaagaaaagacagaaaggtgcataaaaaaagaaaaagaaaagccgcaccaaaaaaagaaaagaaagaaagaaagaaaagaaaaaaaaagaaagaaagaaagaaagaagggaaactaaaaaaatcagttgtatctttgagtttggtttcatatatcagagtgtgcttaagttgtttctggtgttatcttgtggtatcgtttgtgtctaggctcgcgtctctagtacgttctagcctaggaccagcactgtagttgatttattcaactttgcattctctgatttgagtatttgctattcctttgctacatatttaagcctaccccgagctccacagatttgattgcagccgtacagcaagtgtttgccaaggcatcgatacatctaacctccattggggtgcttggttgtgtcggtgtatgtcgccaccattctgcttgcattggtaagatcttgtaagagcttggttaaatgtttgagtgtgtgtgatatttaagcttccactacctagtagtttaataggaacatgtatatttttgtgtatgtttcttgctttctactaacaatggcagggatacgcaagaaaacttgggataattgtgctgaacatgaacatcttcgtcgagtgatgaggaatgatcaacatgaccaatatgaggtaagtgatgttgttctaggtaagatcaaatctgcactaccttattttgaaggaaattatgatcctcgtgcttacattgattgggagctagcggttgatagagaatttaggaagcatgaattgtctgagaaacatatggttatgtatgcctctagtgttttaattaatcaagcttctaatgattggaaacatctttgtaggcataataaaataccacaatcttgtaaagacctgaaacgatatatgagagatgtttatgttcccatgtattatgctgacattttgctcaataaactggaatgtttaaaacaagataatagaactgttacttcatactatcatgatatggatgcttgtttattacgttgtggttgagatgaatgcgaagaagttatagaatcgaggtttttacgtgggcttaaaaaaaattcaggatatgctggcttgtcaaagatatagaactctttctcatttgttacaacttgcttgcaatgctgaaagtaaactagaggaggacatgaaaaagcaacacgatatctttttgcctcctattactaactatttgcaagaagtgcataatcacggaaaagaagagagagacatgaaaaagccgtcgttcccattgttcacactcaaattcgatgcacctccgtcatcagaagagcgaatcacaggtaatctaaatggtgccgtaattaatcaaggtgagtgtgccgttaatgaattgaatatgtctacttttcatgctatagtagagcaaccattattggaaccaattgttgaaatgcctttgtcacaagttgatttactggctgttccttgtgataaagaagagttgtgtgataatgtttcacttatattcgtgccacaactagtgaatgaacatgctatttctaatgtcagttctaatgaagtagtggaacgtaaattgacatcttctttaaatactttgggctatattcagtgtgatgatttttgtgagctcgatagtttgaaggagaaattatttgctaaataatatttgccctgtccaactaatgctatttttcatatctttggtgaatataatgatagagaaatatatttggtgcatagaggttatatatgttcggatttagtacctcctgtacatgtggataaaatttgcaagctagagagacatgttatttctaatcatattacttcgagtttctcttcttttgattggatgaaacaggttgttttaaatcgaccacgcgatgagcaccatatggaaaaaccgatgacagttttccatgaagaaggggaggatgatgtgaccatggctactacggatacaaccattgctcatatcatggatgaacaacaagatatcaagattaagtcctccaagtgctggaatccgattcggccacctgctacactactgactttaaacagccaccaaatctgcgtacgaccttcgtttttggcctgtgagtacttgatggaaagctctcgaagtcctctttccaatggatccagcctcattaccaaattgcatctccgtcggcagcaattgaagaaacaaggtggtgcgacacctgtaatgggtctatgggcttgtaactttgtctgggacccaggcccatgtggggtgctccccaatctagtggagcacgaccctaggagcctcttggtcgtcctcccacctctttaaattacaaggtaccccttcagggtttctcgggttttgttagattaaagttttgccattgctacttgcttgcagcgcgcgtgttggctacaccgtcagtctacttgttcttcggaaccccaacttatcatttgtattcaattcctatttgtaatatcagattgcttttatcttgttcttgcttgtttcttcgatttgcttgcaggattaggcttgatttgcaccggcaagatcaccaacccacggagaggtgtatcgatcgctaaggcgcaacgtaacgtcttgtatggttattgtcaggtcgtcaatgtttctcccaaatcgtagttatctcaactcaccgaaagatagggccaacaacaaccttgagtgtcgagtggaactcagggtttgtcaatatgatagtagttgcataccaatagggggagtgttcgcctaagtcgattaaggaccaaacttcatatcatccattatgtttaccgtacatccacatgcgttttgatgggggaaccttggcctattaagttaagtatttgcctaatcttgcattcgggaggccgttgtagtataggtaggggccacgagtatactatgggctacctagaggaactacccatgtgtgtgttgaattttaggacgagtgtactgttcctaagtgtgtgatttccgtgaggggacgagtgtaatgttccgccttacagcatgggcgtctaagtctgtccaatacaacgatattgtgccacgtggagggttcgcgttgtgttcgccacctcggtgttatgtttaaggcgtgagcccgccacttaatggttctaggtcatataacgtatatggcctaggatggaggaacacgtatcgtgctcatgcaaggttagacaacgcttaatgtaaaagccttgttatgagctctaaaacgcactcaatgtgtagagtgtggtagtgctttggccagcacaagtcaaactagagtgttcatatcatgtaggtaaagctgtacaaactctgcagagttctaaaaactaatcgattagccatgctcacagtcatgagcgacatgatgatgtgctatgggtataatcttgtgttttctaaatgcttttgaaactaaattttttgagatgatgatgagattggtatatatgatatgattgccttacttcccattgagttttaagggaatgatgtctatctacttatgttgaccatgccatgattgttatgctttacattttactaacatgttttgcttaaattacgttgcaaatggtttgtgaactaaaatttgctttatgctaaaaattgagatcacaaaaagccttcatttgacttagagctttcatgtatgtaggtttgatagtgctcttgccagtacattaatttgattaatgtattgagtcatgccatattttgtctaatttatgttttgcagggaatagacttagtttaatttgagtgatgcgggtttcgattgcttcttctaggatttgaacttaatggggtaaacccctagtctgttcttgtgtttgggtagtcaagcttccgctgttatctgatataattatatttggccagttggcccttgtaactattaataattgtaatttcaaattattttgctatgtatctccatgcttaagatgaaagtgtgaatctagtgcacatcctgggaactagaattcacatgagtatgagttaaaaatatttgagatgttgttgatctttagtcattttgtcaagtctcctgaatgtgtaacacatttggtcgccgcctttgagtgatttgacggcacatctcaggctgaagttgactggcaggctaaagacccagcaatgtctccaatatttttctctctaggtgtcggatatttcattatgtttgtttgatgacttgaattatttagttcatccttcaaatataatgagtggtccggagagcttacgacaacaagctagatatttgttgatatgaaaaacacacactggccagggagatctgcttagctccagtgcaggtccaaaggttgatgatatgcgagcgtgccagctagtttgatcctgcaactagcaagatatgtaaacaacagatcaaatagccaatcggctgtcaagccgatggagtaattctagccgatagccgatattagccgatgccagcccgatgccgatagggttttgagcaatcggctaaatcggctgatgacaataaaatgtagtaataatataatccaatagataccaatcgtctaataataatatgataggatatgtacaaattcgaaggttaaagtatacatcgactgaaggtccgatgccataaaatccaaacgattagataaacagtgaaacctttgttgcaatcggctaaatccaacttgtatgtaatccttgtaagacgatgcgatgtctagataatttatcagctagcaccccaataaaacattagcgtgaacctatcgccttaacaagatttatattatcaacaacaatctagaaggtagaacctaaccgatgctgcacgagattgtatatgatagtctaatactcgatgagccgatagatctgtctaatgtgatagatataacaaatctatctagaacaacattgtgattatagagatatatcggctaggacagaagatcagacctaaccgagacagtcccaactaaaccgatgcgtctctaaacacaatgcaattagagatagaattgagatatcaggtaggcaaatatatcaaccaaaccagagcgatccaagagattgaagcgatgcagccttgaacaacaccaacgtagtcgatagatatacgagggccggcggaacgtaggacttaccccttcgtcggagatcgaacttaccccttcctaggtgccgaattccgccagatgataagtaaaaacttcgggaaagagggtggcgatgcgtaaagagtagtattcatcgagagatattttacaatgaccccgggtgtacatatttatacccatgggtagatactagtccttgtaggacaagaaaaaaaattttcttaagagaaaaggaaaacataaagtccttataggacataaacacactttcctaaagataaaagtaaacaaacaaactattcctaattaatagataacttgtcatgctgcatccctcttgaattcggtcacatttggataagcttcatttaatagattaatttccttaaccgattatagcaggaatccgactattggcgacgtgataattctcataggggcttaccaaatttcaccgttaacaatattatggttctagatattacttagtagatcaaattaacttaactgatacagcattaagtataaagagaaacataagaactaaacaagtcattgagagtcttcttgagatggtagatatactatataatttaattcaattatcagtatctaatcctattggctgttttcgatgatagaggctagccgatgatgttagatagcaagatcggtctagattatatagtatatatgataactcgacaatttacaaagacatgattagagtgccataaagatgtaagcattaatcccaagaatgcaaaccgccataacaagctttaacttttcgtcggagatcgaacccgatgcagcccaactcgaaagcaacaactcgtcgaaacaatgaaaatagaaaagggtggtgatacgctgaaagtgttattgaactaaagttaattgtttacaaggtatcgggtcatatttatacccaaaatacataatgtgtccttgccggacacgactccacttctattacaactcttaggcggactcttactgaaaatatctataaagaaactactaaaatatcctaatagataacaattgccttcctcggactcaatccatgcttggcaatacttgtgcaacaccccagtcaatcccgacaatgattctagaatcatcttgccgaaatcggctccatcgacttctccctaaccgattcggtattagccgatacagatggtagtcgatgtaaactttagccggcgcttaactttaatcctaatgaggtacttcaggcactagccagctccctactcccagatatcgctctactgcgcacccggacagggaggacttcagtgtcttgagggctgtcaccacctttacctagacaccacacctaagcagattaattacttactttaatgttagctacacactaaagcaatcactatattttatttgattattgtgaacgacgatccagcactctaaataggaactaactaagagataattctcaccgagcaaaactaaattgctcaaaagataactctattataatcagagtaattaatagagtaggaataaagagggagaggattaccgacaactccggaattcctccgacttcttctactctactcttttcctattctagtatacaatataatataatagagcctcttataattcagctcaagcttggagtgtgtgtgaagtgaaaaggcgaggtctttatataggggcaggcatgacggtcatagaacgcgaaaagtccattttgcccaacaaccgccattcaggagcttatccagaccgtccacgcaaaacccttgatcggacggctgcaggggtggttcggccaaacccatggctggcccaacaggcttcaactttggcctgttgctcctccatttctacgagtggaaggcccatttgaagatgttttctcgtagtttctggcccactcattatatggataggaattctccttcacttaagtctatattccatccaactttggtggtttattatctgcattcaaatatacaccaacacttgtggaatatgttagaattaaaccctattactatgttggacgttttatttctttgatttatgcaggtattggcggcataaaatttgtcattaacagccaccaacaaaccccccacacttagctctttactcgtcccgaataaaggttagagctaaagttgagaataaaattctccgagatatagtacaagcacataatttattcaagaccagtctcatacctatgaacttcatcggtggctaacttaccatcttgggcgattgaaagaaggaatagtcttgaatctggtccttctcaaactccatctcagacttttggggttttataaattttcgcaaatcagctttatctcctcataatgactcatcctcgatcactcaaatattttgtgctgtttgtgcatcctcaccaaggcatatgctgccgaaattattccctaatctaaaggctgtatatgtggagtttgctagggataactcgggacatacatgcatcatatatattgcaaaaccaaatatatggactcaagaagataatcgatcatactctcggatcaaggattgcataattttttgggtggaaagtgtatgatatgtgtagaaaagatcggaaataaagaaaatgcttctcctttgtctatacattcttctccagttttctcctttataattgtagagggggcatggctattttttttctttttctctctgtttttttttttcaaattgctccacattttagaaaagtattatattttttatagccacgcctttccctacttttatttttctttttcaaggatttttcttaggagaagaaggcataaactaaatggagaatttattcatcaactatatttttcttttttcggtggtagtggaaatggatgaaatgatgctaagttccagagtagaaacttagcataatggttgtgcaaccttgattgagagagcatgagagacatctaacacgagtcactataatttggtaaagctcaatataatgaaaggcagtcatacacattgtcgacgggggatacccgtagaccggatatagagggtattggggttcgttggtacgaggatctacatagtacgatatcaagcaaacaaaagacaagggtcatactagtttaggccccttagtaggtaatagccctaatccagttgatatgggattatatgatggaaaccacagattacaaagggaataacagaacttaatgataccgatgagaccgtagttgagttggttcgactagatcttccggcgacttggctcctgtaggctccgacttcgtaggctgtggtggatgtgtaggcggtaatattcgatgccttaggtcctacccggggggtcccttatataccgcgggccagttgatctccaggtgggactcggagatatcggacccctcgcgatatggaaaagacccagtattatccgagtagaacttcttccgtctatagataccatatctaccacgtgacatatttccttaatgtatacggaaactatccgtatacgcgtgggtacaccgtgtcagtatacaacgaacatccaaggatagagggtataccttatccgtaaccctgacagtagcccccgacttctgcttaaatgaactcatgttatcgatcacgacttctgatgtcggaattgttgtcgctctcatctggtcgatctcggtgtgaaaaccgtagagacaaaagccatcgacaacaccgcgtgaagttcaacggtcatgagtgaatttaaattgaagtctgaaaactaccgcgcgcaacggacccagaattttccggcggcaaactctctcctttccttggaatacgcgccgtcggtagtgcgcttatttgaagggattttgggaattcatttaaagtccgtttgccagaaaacactcttgccttctagcgcccttcgtcttctccgctctctgcaaagaaaaccctagcttccttctttcctcttgttctccggcgatcctctggcggcgatggatcttgagaagtctacctcaaccaccgggtccttgaagaagctgcaagacgacggtgccctccctggtcgcaggaccatgcagagggaggcatgaggttaagaacctaaacccatcttgggccgcatggttgtagtcgaggattacatttcttgcggttttctttcttcgcctttcaagtttcttcttcttggcctgaatttctatggcctttctttgccccacttgaaccccaactctatcggctttctgagtgccttctctcacctttgcgaggcctacattggggtagagccctttcttgacctcttctgtttttactatgagctgcttgatggaatctagcagggtatctggatgtgttggattctgacttcgggatagcttgaagtcgcgttacatccccttccagtgcccctcttctcgcagcaagtggtggacgagatggttctaccttcaaatagagaactcggatcccgtccttgttgtccctgaaggtcagccagaaaaaatcccggagtaggccgccaaacccgccctaactcccgtcctttatcgccctcatccatcatctccgagaacgggggttgtcggggtacgaagtcgctgccgacttcataggtaggtggattcaaccgctgtaggcccacaaaggggggattattcagagcaggctcaatggacaatggggatggaatagctgttggatggttaggacatcctatctttagagataaagaagggcgcgaactttttgtacgccgtatgcctacttttttttgaaacatttccggttgttttggtagatgaagagggaattgtgagagcggacgttccttttatgggagaagttgatcgttgaaatgataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatatccgcatcgatacaacaatgtattggtcctgaatatgctggccccctgggactgcttcaagctatagcagatggaactaagctactttttaaagaggatatcttgccatcccgaggggatattcccttatttagcattggaccgtctatagcagtcatatcaattttattaagttttttagttattcctttgggatatcgctttgttttagcggatcttagtattggtgtttttttatggattgccatttcaagtattgctcctattggtcttcttatggcaggatatagctcaaataaaaaattttgtcgttgtttagtaatagcttctttttcactccacaaggatcaagatcaaatgaatacttattccttttctgttgacggaaggtatatctttggcctctcgatggctgatgatgaggtaagacatagactgttggatacttttggtaaaaaagatagggaaattcttgattattcaatgccggatcgaatcatgtccaatggtcattggaattttgtctatccttctattcttcaaaataatttggatttgttagcaaaaaagcgaagaaataggttcgccattccattatagtatcatcaagaacaagagaaagaaccaatatcctgttttgggatttcgattgaaataccctttatgggtgttttacgtagaaatactatagttgcttattttgacgacccacgatacaaaaaagataaaaatggttcaggaattgttaaatttagatataggaccctagaggacgaatatagactcgagagaaagactcagagaacgaatacgggagcccagaaaacgaatataggaccagagaggaagaatgtaaaaccctagaagacgaatataggactcgagaggaggagtaaaccctagaagatgaatatgggatcccagagaacgaatatgaaaccctagaagatgaatatggaatcctagaggacgaatataggactcgagaggaggaatccgaggacgaatatgggagtccagagaacaaatataggcaccgagaggataaatatggcactttagaggaagactcaaaggacgaacatgggactttagaggaagactcagagaacgaatatgggaacccggaggaagattccgtcttaaaaaagggggttttgattaagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaacacaagaagtcggctgggtggattggttcgagtgaagagaaaaaaaagccacgcccatccggcctttgattactctgggccagaggacacgaccagggtctctcctcggggtattttttctcgcatttctatttttgttctgagcgcatctgtttctcctgacgtatcgagttcgtattctcgatttacaggtctggacagtgacaccgtgggacgccgcgttggtcagataatgatcagcgtgcccacgaaggcgggcgatatccccatcgcactctgtgataaggatgtgactgagcgcgccgccgtgattaatgtaagtgtagtcgataatacctttatatcttccttgtctagattgcgccgtgacttcacgttatgcaggccctccctctgacggacgtcatcgggccgctcatggaccaccaggcggcagcgtcgttgaaagagagcgttgccaaggagccatctaacgttgttgctgccaccacgagtggtagcaacatcccaaagagggaaaggaaattctcctccgtactcgggacccgtcggaaagcgccgacctccgcggtaagcttctctctcgttttttagcgcgtagtcggaagaacttctcctcacaccatttcatcctactcaggactcgaacacgtctcctccgcctcagcgaaggcaaaggttggtgacgatcggcgagaagtaagtaaacgttcttgatgtcttttcattttcaaagttctgatcacctcgcctcatggggaagaggaaaatctttgcagggtggcgtgggaaaaggtggcgcaaggtggggctgatgccgcatccagcgcgtcccctgcagcgacctcgtcgggagtcttagtcactgctaaggaccaggaggcagcaccgagtggccctgccgttagccccgtgcctacccggggcccgtccaccgatgccctcacctggggggaggtccaagcggagatggagcgcattctccaggccggtgctcatggcgtaggtcgcgagatcgaagaggccagggcggcagcgttgtcggcaaaccagtgtgccgaccagctggcgcgcgacctagcggaggcccgcgaggacctcctaaagatgagggagctggtggccggcaacgagatgcaacggcgcggactcaagcaccggatgtcggagctcgagggtcacatgatcaacatctgtggttcgctgtgaacatcgttcaccagcctgcaccaactcgccggggagtgtggtgtcacgactaccatcccggcgcaccccgatgagttctcgctgacgtcgtcgcttgcggaattggctacggcgatggaggagatcccctccaagcacgcggccaggatcggcgaggagacgtccaatggcatctacaccggggagtgccatgtccttgcgtgcatgaggctggcatatcccgatctggaccttaagaaggctttggatcagggggccaccgatgacgcgcgcaaggctatgatggaagaagtcggtgacttgggggagtccgtcctccccctttttgaacagtaggatatttgttttcccttgcaccccttagccttcatgctgtaaaacttttctgtggatctgaattgctcttatctgaatagctgtctccctagtttccttagcatgtgattctgagtactttgttgttgttgtagatatgttgatgtcgaggacgtccagcagcgcgggcagcccgatatgccggtgatcgttccggcgctcacactcgagccgttcgtgctgcgggaggaaactagtcaaagcctgtctgcggaggcgagcgtggcgatgacgtcactaggtttgtatcttgctctccttcactccttgtgttccgtttgacttaattagctatgttctcggaagagaagaatagcttgacttagtcttttccgtgtcgggtagattttgagaacatgttggctgactaagatcgtcgaatgcgatattggaagacgaaactcgaggtggccaaactcgaaaaaaccatggtggaggtgaagaaggaccaggccgtggaagctctccggggtcgcgaggtgtggttcaactcgtacctcaagagctgctgcatggcgatggcgagggtttgcaaggagctccgagttccccgcggagatcccgaggagtcggcggctggttatatctcgtggttgaatggggcctgcgcacagctcgaagggattgccagcgcatcgacgatgtcctgaagcaggagtgtcgtcgagcgagccgctacgctagaggacatgtgctagcctgcatccgagatcaccgtccgcagctgcacctcgagaagaatatgtgacctcgttttatttctaggctagagaaattagtttctcagtaaaagtccatatggggtccctctattttctcactagacccaatattttgatcctctgtagaagtccgtttaggatccttcacctttggaccgagcccattatcatcgtccctctacttccctttacttccttacacaaaggcccaagaaccctctccaatacaaggaagtctgtagttacttcctctattttctcagcccaacccgaaggaccaattcccataagtctgcactagctcccttccctcgttcaggccaagcccaacaaatattgtgcattccccagataagtctgtactacctccctctatctttctagataactctatgctgcctcccccctactcctccctataagtctgtactgcctcctccaccaagcttcgggctgaaacccatagacgatgtccccctccttccaaagtttcattcatacccctctttaatctggtgtcgatcaagaagaataatcaccgacacgtagacactctgaaccagctgcaataagaagcttcgatcataaggaacgaggacccccaaattaggggtgtaagtggctaacccgcgaaacctacttataagctaaaataagccgcggacccgcttattttgacctataagtgggttcgcggctgacccacttacacccttaccccaaatcgtacccgaccgtgcgaggactccagaaaatccggaaaccactgtgtgctaacaacacacttaggagcatgacaggaaccctgacagacaggccctataggaactctgaccgataggatctacagccacgcactatccaccaccaataattgagaccgaccataccctgagacgcgcacgtactaaagccccagtgtctggtgcctataaaaaggaaccccgagcgctctcaagcaagcgcaccagccatccctgaccccgcggtaacatgggttgaacccccttgggaaatctctcaaaagctccctgaagggtatgcccggtagctggaacagctactccgacagctcgttggctttgccgagctgatgcatcgtgtcgagcagattttcagggatcccagaagtgctggaaggcgaaactcctcctttccttccctagagagaaagagcacgagatgatctctttcgaaacccgccatccccggatcaccatggaggctgccttccaagacgtattccgcaaagctctgtaccggctttgcaagctctctgccccgttgggcatagaccatgactatggcttgcacccataccgcactgatgaagacaatcggtaccacctccgtatggccggattgcccaaaggatgtcggtgcacgctcctctctaagatggcctgctctgccaagaacgcctacgagcaggcacttgaggagctggacgaacttcgtgatcggtacaccaacttagaagcccgttaccagcagctgccccacaagaacacctccgctctgctcgtgcaggcacgcgcgacgaccaacatgatctaggcccccaacttagaaggactcgcaggaagcctccattaccgatcaatccactttcacctccaccatctctctaagtaggattaggagtgtgagcccctgttgggcgttgcattgttagttggtagtcccgttctccccttttggaatgtatctttcagtgcccgatgtaatatggaatgaagctagttagtccgccatatctctatgtttttggagctgagtatttttattcacacctaaaccaaattgtctccctttggaaagcccttttgcgccggtagaaattattttggaattaatcgataacccctcgtagtaagaaggttatgccgacacacgcccaagttttggatttatcatgcctctgacatagaagcaaaagtctcaaaaataaacccacaggatccatacaactaaggatacatgccttgatctgacaagcaagacaccgactatctagcttacagagtatccatataattaagaaagaccacgggtgccaacagaatgaggagaaggatcgccacccagagatgatcatcatggccatcgtctgtaagctcaagcaataaaccccatagaaaaaccatatgatacactacccaagtcaacacagtacaaatgactattccaaaggaccacaccttgacccacacccatcgccaagcggcgactatcctcgccaaaaagttgccaatgcggttcccttgctccggctccaccgccacccggacgccaccctcgacgatggcatcgtccgccacatgcgccggctggatagctggccgctgtaccaagagcccggcagccgccaacgccgaccatcggcaaaggccatcctcggccgaggcaccttgcgccgcagcaccatgcctcacgccgttgccagcaccacggccggctgtgcctcgctcgccgccatcttcgtcgcctcctccgccgattcaccgctccatcccctcccttcgagctacaccaccctccacttacccaccgctcgtggtgtcacatcctgattttcgttttaggatttataaattatctaataaattattattagaatttatattaaatgttcattaatatacaagtgaagttaaatgtgggaaataaaatttcctaaatataaatcatggatggatttaatttttattaaattctccatggttaattatactctctggaattttctcggatttttcggagctcaactcttaattttaatcatacaaacaacatttcagtaattatccacatattaaattaatcattaaatggtctggttttaatatttttaaatactttgagtgtccaagtatgttcaagatttttcttggaattatttgagcataggaaatatttttaacaattcaaagatcatttcagtgattaatttaattggtaaagtaataaaaatcctcctcctcagcttgggcccttttcagaccattccctcttcgctctcctttccttagccgcagtagcccactctccttctttctcttggctcaagtccatttcaggtccctccttcagtcgggctggagaaaaaggaagcccagccaaagtctactttacttcgccggtattgttcatcttccagctccagacagcccgagccagccatcccgagattgtgcagcgccgttttctcctccaaatccggtctcctctctcgtgttatttcaaaattagttgaggggaaatattcctcttatcctcctctatcctttccccccaagaatcggactttatcccgaagaaatcaacgcggaattgagcttgattcgtgtttatctctccaccaaaccctaggttttcccggcgcgattccttgcgttccaagcccgatctctctctcccatggctataaatagagtcccctccctctcctctttcggccaccacctctccctctctcccccgtcgcttgtagcgccgtcgccgcgttcgtcttctctctcgctgccggcagccgctccagccgccgtttgccgccgcctcggccgtcgccctcctgtgccgccacctctctcggctccgcaaggtcaagagcaagcccggcagcccgttcccttgcgccgaagaccccgggaagcccatcgtcgccatcaacccgaagctcgccgtcgtgttttgatctccggcgaggctctgctgctcctcccgtcatcgccaagcttcgccgccgcctccattggattcgcagctgcgaagtggacagtacctcgccgccatctcgatctcgtcgtcggccgtcttccgtcgctgtctgtcatcacgtcgtaagtgttggtaagaatcgccgtcgccttctctacctcccggtgccctccgtttgcattgttgtgtcgtggttcgccggtaaccgccgctcctatgtcgttcaccggtgtagtttatccctagggtcttaattcaatataatctaattcgtgattggtctagcgttgtcatctccgtgtgttgctgtcggaacattgtcatcatcccttcctctccgatcgctttggttcggtgagacttctatccgttctctcttttcaatggcatattatttctttttaatatatgtcatctaccaaatataatctaatcttttctggaggttgtttaatcttttctctcagttataaatcatttgtaaatggtttaattaatttggaatagtcttttctttaataggtttaattggaattaaatcttgtaaaattcatatctaattcatatgaagtcggaatgaggccgttcaagtctctaaattcatctaaaatcatgatctacatgtttgtttactttttatgtactgtttatttggtttttattagtctttttctctattttgcgtgttagcttgtcgtttttgttgttgcgaaggttcgcgagtgcgttggaagtggttctgaagactaattgaagactgattattgcaaggcaagtcacacagatcccaaacacgattcctttgagcatgttgatcctatatttaaattctctatttatttcaactgtgcatttattttcgaatgtcaccgggtggtgttatcctattcttttgttatggccaatttgcattgaatgccctattccttgataccttggataataaattgattagcttgaactcgggatggcaatcgggcgcgacgggcacgggtagtgcctacccatacccatgcccgtgagattatttgtgcccgtgggtatacccattactacatgacgggtaagaatggttgcccatgcccattgcccgcgggcgccttatgcccgcgggcgtgcccgtttacccgccacaacaaaagcagtggaacaaaaagtctacaagctactaagttcgaatcgaacttaaaacatcaaatattctccgcctcggtgtcgtgtctctcctctggcggcgatagagtaagaggagagaaataataagggaaataaaagggaaaccgtagaaaacaaagaacgtggcttatgtattctagtggattttgctcctagcctacatgtaagttagatttcgcgggtaaacgggcaaagcgggcatgtgtagtgattacccatacccatgcccattatccatcgggcatagcttttgacccaataagatatccatgggtataaaatggagaacaaacccaaccctaatagggtttttacccgcgggtaaatgggcaaacgggcacaattgccatccctagcttgaaccttatatattggtttggttcagctaaatgctatatatataattgtttagccatgcctagaaacattagttcattaatgggatgaatcatactacattattatttgtggttatatttaatgctagctcacgatgattaatcgtgttatgataattaattgataattaaaacttgataatggtgggttgtgagcacatggttttgaaggttgtgctcatgacaattaagggccgattcgctagctactgttgtgagacattaaccgtgccaaccacaagccagcgtgggcaacggctttaccttttgtatagcatggttcattgcggggcaccagactgtgaagcggcgagaagtccgtgggggtcgctggggagtccatgcctctggttattgaggggatgattatgatccagggacggtgcgctgtggtggattgtgttgtgcaaggggtactgtcacagttcctatccgagatatcgtggtggtattgaggcgcatggtaacatgtcgtggagctgtgtcttgtgagtacagtggtacatctctagctagagtaaaactattcgaatagccgtgcccgcggttatgggcaagttgagcaatgtttttcgtgattaatctcataataattatggatgctataactagtaataatttatttagctcctggtttggagtttgatctgtatagccgggtatggttgttcagaatggttgggcctgagcagcatgggcgtgttgttcagagttgattaaaattaatgattaaattactctactgtttcactactcttaaatctttgctaaatgctgctattgcaaatgagcctatattatgccatgctttggtatccttgtgcacttgtatatttgctgtgtggcatgttgagtatgtcatatgctcattcttgtcataatcaatcagcctcagttgaagaaaaatgatacagaaggagaagatgtttgacttataccccagttgagctgcctgtgggggtggagccggagcttcgctagattttatttttccgctgcagttttcttcgttgtgaggactaagtgcctcttcagtaagtattaattgctttagttattttgatggatttctatattaaattgtcagttatgtacctcggctgattactggacggggattttatgcacaaataagttcgaaaattactagtgaatttctgggcgtgacacgtggcaaccgcacggagaagacacaaagcagtccccccccctctcctccgcccttttttttcgaaagcggctcgcccgcaaaataaaatgattacctaagtgcacaagggaaaagagatattttcgaaaatcagtgtattttgaaacaagccgttgcttatcaccacccgcggattgcctcggtcaaacggctataaaccccgcagaggacacaaggttccactacgacatccgaccgtcgcacgccatagctgtggcctggcacgcgtgcctacaaaaggatgtcaaaagacatgcaagccgtccacctaaaaaggagacaagatattccaagctgtgcactgagccatgcattttggaaaccagcgtgccttatcttctttgtttcttcaagtatcttcctaaatctgtttctaaaatctcccacctcataagggcatgtataaaagtagagtcagatatgagctctacattatctagagactagtatcctacaacagttagagataatatggtctctaatcattaatgtatcaaaatattttttcttacttttctttcctttctttcaccaccatgcaataaaatttgctctaataaatgctaacagtcgactctgagccgttgtcatgcataacaaccatactcctttctctttcttccatatcatcaaatttacttgcatagcaatagagagagaccaccaataaaaaccgttgtacatgccctaaggagcccgatggaagcaaggagaactcccgaactgcagtatctctctccctttatctgacccttactaatctcgaggacgagattattgttaagggggtaggttcgtaacatcctgaaaatttcgattctaaaatacggaattaaaaattcagaataatctttttaaacctttttgcatgctaggatttattgttcattcatgtgtgtttaggttgtgtgccaaaggtcttgattaaatcttatctcctaaagggacgccctctatccaacatcatttcattcccttattttcacggtctgatttattaagtgcttcgatactaaacaaaccacagacctgaatatgtaactcaaaaatgtttctttatgtcacaatgcgacatatctttctcaattcttaccctacggttattttaaaccattctattaattccactcgatcattccctcgaatatctacaaatgatcgacgtatttatttatcgtgcgtcgattcaatatttgattctattcccaccgcgacaattggattcgtatgccacgcgtcgtccctaaaatcacttcttcgtttccgtcattcgttcgtacgagcactctcaaaataatcctacgacaaccgatgaattcgttgttgagattataggcatataatgatttaatatattccataaataaatcatagcattgcagatgtataccagcattaacgcatcattagatctacacatgtaaactaagcagtaaaacatgaaaagatcaaatatgcgcaacatattgaacacgtaccgaggtggtagaaagaccggctgctcggcaggaacttttcgcaattgcagatgtttacgaaggcgcgcagcacgcgagcgaagaggaagacgagccgtcgcggacgaacagggaacagtcgcgctaagcgcttcccaaaaaccttattgccgccttctcccggtgcaggacgtcgaaggcataggttccggagacctgctctcccgatcgccggtgcacgccggcgaacgggatggagtaatctacgagcgacggcgcagcacagagtaggaggcaaaccctagattgatttttcgtgtgttgcgtgaagacggcgagtcggtttatatagagaagggtcgcttgatcagggcgcccgcacgatctccactgcgcgtaaccaaaccggataagtcgcgcgtaacttatccggactccacgccgttttcacgcactggatttttcggaacatttccaaaacaaaaacgaatccgaatttgcagcaaaacaaaactgtaaaaggagactgcatctgcgcaaggtgaggactaatttttggcagaccattcgacgcgtacgtcgtgcacacgcgccgcctgcccggcaaggcgagcaagcgcgcgcgtgttccccctcttctctccaccacacatgtttcaagtggctaggagggcatcctcccttttaaggaggtccccctctcctagaataagcaaggtggtactaaactccacatgcatgccatcccatgaggtgggcttttatgattttccaaagaattaatcttcgagtgggctaagccccatccattaattccaacattcgtttgtcaggcgttaagcctaaactcctatttggcaacacggtgcatccatccaaacaaacaagtctcatattgcaatccatttattccgccctcgtgcatcctcgaaagatctataccaacccaaatatagttattgtccaagttacagtttgccacatacacaacccaatgtacggaccaattacagttcgtgcacatatgtcagtccagaccacaagtcccatttataccatcccatttccaaagcactgcccaaatcacatcgtcccatcccaaatacaaagtcccattacagtccattgtacagtccaaattatacagctcaatttgtaaatacactgtcaatatacaactccaaatacaaataccgctctatattcaaatccctgcaaattacaaaagctcctattacacttgggccattcttctctctgccaacacagcccatttcacacccaagtccattttaacccctccgcattgatttagaaacgttttatgcaaataaaacttgctttatgctaaaaagaaccatattatgccttccttgattatatgccttgcaagtagggtgttaggcttgtgttggtgcttgccagtacattatttctaataatgtactgactcttgctattgaattaatcttttgcttgcaggttttagacttagtctttgagtgatgtgggtaatcgactgtttcttctaggactagaacttaatggggtaaacccctagtcggtgtgcttgtggattgggtagacaagcttctgctgttctatatatttatttggccggtcagccaatgtaactaaagtagatgtagtttataatcgctttcatcttatttgtgtttgctatgtataatcatgcttgagatgaaagtgtgaatctagtgcacatcctgggaactagattcacatgagtatgagttaagaatgtttgagatgttgtagatctttagccatttttgtcaagcctcctcaatgtgtaacacatctggtcgccgccttcgagtggttttgacggcacatctcaagctgaagttgactggcaggctaaaggcctagcaatgtctccaatattcttctctcgaggcgtcggatgtttcattatgtttgtttgatgacttgaattattcacttcatccctcaaatataatggaaggtccggaaagcctacgacacgcgcgcggctagggttttgctcaaggagggaagtgacagctagagtttctcacgtgatgcaatatctccggcggtcatacccctcacgaatatataggatccatcactcgagcctccaaggcccgtaggactcctattcggatccctatccgaattaagctcatattggatctccatccaatctccttattctggcccattaagtgtgcgaccctgtaggttcatgtatactcggctgtaacttgaaaactccttttcggtccacgcgtcaatagcggcccctagcagaacgtattgacccaccgggcatacataaagatcatatcgactgaacctctaatgtatacttgtatgaacccctttgtctcacgatatcgattaagctcaaggctagatatgtgccatcctctaatagctcaatcattcactcgaacctctcgatagattatataacttgtgattgactccttaatcacctttggcatggccatgcgcttccataatctacaacatcgaggggcccagagatatctttccataggaggggcaaatcccatcttgattattcatatcccaatacatgtttcatagcatactcgaaaactacttttataactatccaattacgaagtagcgtttagcagtccctaagtaagctactacacatgttgggaaccatgataatctcagtgtctcatgtttggtctatcaaacaacatgttcactaacatgtctccacattgttaatttggtatctatataccatgatccatgagacatgatcatcaattaatacatgtgctgatcatctaatcatatttgttccacatttgatatttgatcaggaatcctttaaaaatagtaacaaacaacataaagagtctcatgaaagaatcacatatttattaaccaataatgagtttatctatttcaaggaacaatgtcggataaatatgtaaacatagtataggatacaatcatctctatgattgcctctagggcatatcactaacaccaccatccttacctccaccaaccgccagcctccccatccacgctgctgcgcctggcagccgccgtcgcgccaagccaccgcgcgccgcgccctgccgcgccaccgaggtcggccgctggccccgccgtgcacacgccgccctcacctctctctctgttgcacatggagaagaacgagagagagagcagaccaggaagagatgagaaagatataagagagaggagaaagattaagaagaggaaataaaggagaatgagacttacatgtaggacccacagtggaacccagtcggttgacccctcactcctcttgacccacaaaccctagtgaaagtctatattggcccccttttactttagtatccttcatttaacaatcagacaaagcccaccgtagccacctcatactaaagcccacataccacatcccctatacaactcaaagcctctcagaaagtctaaaccacctcccttcccgagaatgctccctcctcggtttataaaaccttccaatttcgaaaattcatatctctccaaccgtaactccgattgactccgttcaacttccataacctctctaaaatcgagatctatttaatggcaccattagttgtattgaatgttgttttattttatttcttttaggattgtgcgtggatattctttggttatttattggacgtgtcggatatttatcgatcgcgggtattctagttgtccaactgtcacagacatctcgaagacattaggaacctatagcaaggcaagtccctacgctccattccttgaacatattgatcctacatttacaaatgtgttgttttacaaataaattgcatgctatttataaattgcgtacctacatttgattatagcctgccttgatattgttacccttgtacatattaatgtatgcctttgaatacccaattcatttatttatatacggtcaattattgacaatgcttagcaatgctattgtagacatacgtatactccatatttaagctagatgattacggatgtgagatcactcgatgtgagtgattgatgatttgcgggtggagacatgagcgccacccgccacacacaaaccttttgtgaaaaccaaaatttaatacaacaaaactattttgactggggcagcatgaatagaatatgggtgggtctggaaacggttagtcgccgaccctggtcagttaaggaccgagtcaggaagctatacaggaaacgaacagagtacgaccgcatttctcaagtgggtatagaccggcggattaggaagctctcgtggagcggcacctaaatcgggtaggttctatatcagtgtggtgatgagtacagtgtcggaaaggtaaaggcctagatatgaacttaaaatgaaccctataaatatatatagtaaatatcccctattccgtggagcgccaggactcccttcaccatccagcagtaggggtttggagtgctggggtgcaatgggggttcatagtccttggagcaggtgccgaaatgcgagagcaactgaaaagtcgggccgtggcaagtctcatgtgttgggactaggctcatatgttgggcaagccgcggggtgcgggattaaaagcgtacatccgctgcagtgtgagtaaaccaatctattcgaatagttgtgctcgcggttaatgagcgccgagacctgtagattttaatactgcttagagtagatatgggagagatgtgaaccttgcccaaatagtgggaaggttagtatagtagagttggtataagatgaaatgtgagggtaaatcgaaccaagcgaggcttggagaggtggatgaaccctggataattacaacttcaacaatagtgttgtttttcagttaaaactgctaggtcaatagatttgtgaaatgaattgtgaaaactagctttatgcaaatgaactaagccatccttgaaccactgtgtgcattagattcattttgtagtggtggcttactgtgtactcactcttacttaattaaatcttttagaaggagttggcgtcgattagatttatgccatgctgctgtcaagtacgtgttgaagatgatggattagggaccataggttcaccagtcgttgcttgtggagttcgatggaccgccgctgcttcgctttcccgttgttttatctattactttggtattttgtattgtaagtgaccatgcttggtctttttcgggacccaatgaggttacccttatattattactgtagaaacaccggtaaacgaagtcagttgtgatattatactgtgctatgtgtgtaccacctactgatccagggagtggtactgtataacacatgggattaccggtgtataaaaccgggggtcccacagatatagggtattatttacttaggtaatgttataaaatgtttttgctatgtgatttttattagatttgacttcacataggtgtagagatgtgttttctaggacttgcacattttggtttcataatttttagagttattatgaattccttatgtattttacaagttatagcgtgttacaggtgaatagttttttgtattcatatagttttgggacaatatgtccagaatgttttgcttcctgttttagttgcataatgtgaatgatttgttgaccaactaatttttattttacaccattgaggcttttagtattttgcttcgcattttataatttaggggtgctctaagtttgtaactcaatatatcaacctaggaatattgtatgtgctgagtaccataaattttggtaagagaggatggtgttgtagcttttctggttcatctaggatttatttgttttatttggagctagggtgcattctatataatttgcttaactagtaatatgtgattagcactcagtttattaatttaaaatttagagatatatttgtacagaaggtgccacatttcattttactgggttgaagctcactacttgctggttagatagaaatttagttcaatccatttgaatctaaaatgatttttttttacaaaatttccaagtttaagtgtgcttatgttgattgttccttatatataagtttaggggcttttcatgtactgtaagcggatatttctattttataaatctgaaatgcacaattttttgattctacagaacttgagttcatttaaaaaaaggagtcaaaatggattttatacgactttccaaagttcagcttatctaaaaccaattattttgtagataatatttttagaggcatttggtgcaaagtaagtatatatttttatttctccttaccaaagagtgtatgttagtgaatctgtagaatttgagtttgtcccaaaatgggttaaattaaattttctatgtattttataagttcttacatgttttatgtttactttttcttagataagttttagatgtagattttgtacagtaaataccactttttaagttgtaacattaaagctcatcattttgtgaatccatagcaactggaatcatctcaaaatgatgtttttttattttatatggattttacaagtttaggtgttttcttgttaaaaagtacatgtttttttattttattttatattttcagattttaaattcccaataagcaaaaaggtcccgcaggtttcagggaatagatcccttggtccaaacacgtgtggaaagccaagtttattaagagtccttgagttttaatgtatttataattagatccatggtcccacatataagtctaacacattttacacttcaaaccttgcatgttttaaatttttactaagtgtggttctcagagccaaatcatgtggggcctgcagcctgcttgtcagtgagacaagggaagaagagagcagggatcgagtaggggaggagcacgccggcgagcttcccagcgtacggtgacggtgaacggaggccgatctcgacgagcaaccaaaagataaaatgtagaacctttgattgtgaatcaatatgtgtccttctagcaagctacggtgatcgaaatcagtggcgacggcggtgcgagcggcagtgaccttcctggtggcaatgcatgtcactttagaggccgggtctaggtgaatagagtgcatgcatgtgacactaaagccttgagggtgctcaccaaaccattggggaggaatgccgagacttggttggcaatggcggcttgcggatgatatttgttaacgaagtttagctgaaacctacatctccagggctctaattatgggcgctcctctccaaccaatatagcacctagccgctacgagtccatggcctcgccgcctattgacggtccttaaatcataatatttgaccatcaatacctgcatataataaaataaaatatggtatccaacttaatggtagggattattactaatcaattccactagtgttggtgaaatatgtgtgtgcaagtagtttaaggagaaaacacacccgtcatgcaaggaaacacacctccggccaatcaggcgcaagtacacggattgaagggcccacaagtcaggtaaaaccgccatggaacggatcataactgccataaccgccatcagggcccacatgtcagcctcctagccaaagaagaggccaagaggtggggcccagggttcgaccgaaccatcgctggctcctttcatcccgctcttccacgtgtacgctgcttatgctttcccaatgacggttgagggcgttttggacaattctcatagctgtaactgtcatatggaggctataaaaggaggagctgatctcacttcactcatacaactttgacctgaattaaaagaggctctattgtattttttgtacattagaaaataggtagaaagtgaggggaagctctaaaggagtgcccggaagtttagcgctccctccgacttctacctcgacaaatgtagctttctaggaggaattctggaggagtaccggagctgtgatacactctgctctgggttcggagaaacttcttctattaagtaagcattcaggatccattcttatgttatttaattacttagtataagtaagatagatttttcatctttgcaggttcattgtttagtatttgtactaagtgctttagtattagaactatggataaaaaaggaagttcctgcgcaagtattagagtagtaattgataacttaggtatggtatctaggttagatattacctttgtttgttgtatatcccacggatttgttagaggtagacggcaggtggtgacagccctaaatcctgtcctagtaatcctccacattcggatacatcatagagctatagccagaaccacgctggcagaccagcaggggtcggtgcctgaagcaacaaataggaaattacctttgcttagcttagacaattaaaacacatagaatgtcctctctagcctaactagcctaccattaattgttgtccttgaatagttttagccttaggtagatttcacacgttccctaagttcgatatccttttggggtcacccgaaggtgaagtgctacagcggtattccgtgcgcttgcggatttatctgtggtcgtaagaaataccaacaccgccattatcttcccgtgtgtcaactaggggtggaaatgggccagctcggctcggcttgcagtggctcgtaacaaactaggcttggcttggcttggcttagttagggaaacaagctaaaacttgagctcggctcggcttgtttcctggctcgagccagctcgagatggcttgcaagccttcccgttgaaacacctcttcatatatatttgtaattatttaaaaaagcaagaacaaattatcaacatgtaaaatttaaataagtttatatattcaattcttcaaaatcttaatgataaatttcaagttaacaaataataacgctataaaaagtaaaataatcaatataaacacatgatggcctaggctcgtgagccaaaacaagcggcttgaaagctagctcggctcggctcggctcatttccagcaacgagctaaaaaggaggcttgggcttggctcgtttggcttacgagccaagccaagcccgaactgagcccatgagcccgagcttcttttctacccctagtgtcaatgccatgattacattgtgatgtctcctctctatttaagacagcctatgacagagtttgactctaactcagttttacacatattccaactctaattttaactcttagtaggattatatattctgacacatattctaacagctggagctgtcgtgagctcgtgactcgccattggtaagtgaggacacaggcaggaatttgttaggctatgttcagcaggaggtgttggcaaccccttctttctggcacacaaaagatgtatgcattaacgtatgattaattaagtattagctaaaataaatttaaaaatagattaatatggtctttaaagcaattttcatatacaaaatatttgaaaaaaaacacactgtttggcagtttgaaaagcgagcgcgcaaaaaatgagagagatgagttaggaaagtgaccaaaagaactcattcttatggcatccataatgtgatgcaaatgtagtccacaagtaatataatatttcattcagccacctaggccccgttctaaaaaaaccaacttttcctcactttttaatagcatgcttttcaaactactaaacggtgtgtttcgtatgaaagctttttacatataagttgctataaaaatcaaataaatccattttcaagtttttaataattaaaatttaattaatcatgtgctaataacttgtctcgtttggtgtacgcacttaatcttcatgcttgttggagaatcgaacgggatcatagtactattgtgcaactagtccatataaaaaaaataataaaaggtacccatatgcatatagactacctatatgaaataaacaatattatttatctctacttttctcttttcttctcatgctatcttgtatttgtgaggattgctatagttaaagtttaaggtgtgtttagttctttgggtgtaaagtttttgaagtatacggacgcacatttgaagtattaaacgtagagtaataacaaaacaaattacagattccgcctataaactacgagacgaatttattaagtttaattaatccatcattatcaaatatttactgtaacatcacattatcaaatcatatcgtaattaggctcaaaatattcgtctcgcaatttacatgcaaactatataattagtttttttttcatatttaatgccccatacatgtatgcaaacttttaatgtgacgtttttgccaaaaaaaatttttatctaaacaaagccttatttttatttatatgagtgatgaccagtgtagatccgacatccaaaattcgactgctgtggaaagtccagcaattaaaaaaagaaagtgatctgcatttgttagttcaccagcacttcacccactttatttcgcttgcaaactgcccctgtcctttggcttttaaagcaaattaagacctttcctcctccagactagtctagagcttaccaacccaaactaccggaggaaagcaaattgcgagcctgtcgcactcggtggaaatggcgcttgtcgatcccaaggccggggagtcctcctcctccaccgtcacagctcaccacctgttcgtcgttgtgatcgacggcgtggagacgtccatccacgagggcagcctccaggccagtctcggcggcacggtcaccatcaccagcgcggggaacctctccgccagcggcgtccgcagcgtcgtcgtgcgcggcgggggcgggggcagcgtcagcttcaccctgtgcggagacgcggtcgccgacggcgtcgactccgcgtcgttcgtccggtgcggcgcagcgcgggcggagggcgcgcgggcggtgtcggtcacgcggtgccgcgccgcggacttggagcaggccggcagggtgtccctcgagcggtgcagggaggcacgggtccggggcggcggcgcgctgcgagcagccaggtgcaggcgcgccgacgtggagagcttcggcgaggtgcacctggcacggtgcaagggcgcgcgcgtcgactggtgcggcagcgtggaggtcgagatgtgcagggcggtggatgtcagccggtgcggggctgtgaccggcggacggtgcagggtggtgagcgccgtcggctgcggcagcgtcgaggtggcccatgccgtggtgaacattcttgaagaagaacagccacaagcagcacaacatcccgtctctccatcacactccagtcgatccagtgacagtgaatgaaggttagcaccagtaagactcggtgaatctggtgtttagtatattcgaaattgcaatctcatactgaatttgctccgtaggttttttcttcttagtttcattcacggtggatttgtttttaattaaactgaatttgatttgtcgactacgggtaaaaggtgtaatatataaatagtcttgacaagctgcatcttaatctgaactcgagtaatacgaatggagataggattttcatttttaaatgatagttttctgcattctctttcaaataaaatattatttaggcaatttcagttgcaaggttgaaatatcactgaaggttacaagttgatttgtgttgtcgacaagctcaaattacagagactcaattttggatgctatttctgctcccaatagcaacctgatctgaatcgtcatctttgggtgttctgcacttctgctctgccgcctcttgcagtcttgcccatttttcattccctgctccactcgaatgggccatatgcaagttacttcttcttgtcgtgctcaagagtcttgcctagtttcttccattttcctttttatagcttgtcccaaatctttctactccgtacttcaattattttgccccatgcacgtaccgagtactcccaattcacaaacgagatcttttagggagttagcgagatacttaaatgtattaaatggttgatcaatgtgaaccgttgatcaaaagaggggtaaagtacactggtggagagaggggttgtactcccgattgaaaacccctgtagtttcggtttttcaacatctttagtcccataaccccccctatagtctcagtttttcaacatctttaatccggttcgtaacaccaaccaggactaaagctttttttcttttctcatgttcaatatctccaaatcattataataacaaataacaaatcacaatcgcaccacaaatcacaaataacagaaagcacgaatcatagatacacaaatcacacatagttcacatataacatatctcccaataccattcacaaatcacatatcgcacaaatcatagtcattcacatcacattaagaaggaaaaaagaagaaaaaaagaaagaatttcccatgccaccgttgggcggccctccgcgcctccgccgcctaccgccatgggccctccgcgtgggcagccgctgccgccaggcctccgcgcctccacgaccttccttcgcggcggccgccgccgggaagacagggttgagggaaaggggaggaggagaaggaggaagaggagaacgagtgatgaggagaacgagtagaggagaagaggctaagggataagaccaagggaggagggacagacatatgcgtgaagagataatgatcgcgtagcttggggtgaattttagtaccgggactaaagatctatttttagtcccggttatttataccaaccgggactaaaaataattggggcctgacacgacccaacaacttcttcaaccgggactaaaaatgatctttagtcccggttggtaacatcaaccaggactaaagatgctttttaatcccggttttcattggaaccgggactattgtggaatttggccgaccgaccaaagatggtttctccagcagtggtacgaaataaaattattgtaacatggtgtcgaaactagatttcggcagtactaaaaagggatagggaacaagctatgaaagtggttggattatgagacaatggatttatacaggttcaggccttctcgatgagaagtaataccctactcctatagatgaacgagtcgggattacaagatacggaccttatcccttacggtttaagctctatatatattttacaattgtaaccgactaagattacgtgatacttccttgatatacaagttaacgtaatacccgagtcctatctttacatattctattactatgagttacccccgataactagtcgggtaacgcagccctgtgggtatatggtacccataatctccacagtagcccctgagaggccgagaccttcacagatgataaggtaatcttctcccgagtggtttaataaaaagatccgagtgctttagtcattttcgccacaactcctgagtacctcaatcatctcaagctgtgaagggctaaaaaagaaaaattaaggtgcatcgactagatgcacctaattagttgtagcccccgactatgtgatttgttgaacaaactaaacatatatagtcaaggaaaaaataaccaaccgagtggtttctaatgattatagtcatcaaaacgactaaaccaaataccaagcatatgcagcttaaatccccaaaataatatgatttataggatatgccgactgctttttatacaacatattaactcaaaacatttagcctaagcttaaatgctgatttaaaaagctcacttacgtgataacgatcggggttggctagggtt

SEQ ID NO: 75086 - DNA, 1348 bp, Oryza sativa
gtttgcacaaatgttgcaacacaataagttttgtgtgttttcgtttgcagaggtacttgcttgggtgaaagaaaagagactgagcgtaaggaatgcatggatgattgaagaaattgattggggaccaaaccaagaccttctccaagtcttctttcatctcaccatgtcacttttagcccatagaagacaagagatcaagttgtacacgttttggattcggattcgggcctcctgatagcatcaacttcaaacggatctagccgctgatctagaaggaatttagaggcccatgagcacttgttggaaagattatgaagtctactttcatatggttttggtcccatgtcaaaattcctaccgagctgccgacaatcagcaaaacaagacacatatctcatctagtccgaatctgattttgagttttgggccttgtaattgtgtcgtgggcttagcccaaggggtgtgcgccctagggcaaccctaggacgtccctaagcacatttattccgcacgggttctcatcgacggaggcaactccattaacctactcttcaccagcaccttggacgcgatggggaccccacgaagtgagttgacgcccactgatcaacccttccacggaattactcctcactcatcgtccaagccactgggcaagattacgctacctgtgacttttggccaagcaaacaacttccgaacggagcagatcacctttgatgtcgctgagtttgacacaacatataatgccatcatcgggaggactgcactcgcgaagttcatggccgcatctcactatgcgtatcaagtgctcaagatgcctgggccgaagagaacaatcactattcaggaaaacgcgaagctggcggtgcagtgcgacaaatggagcctcgacatggtcgagcatgctcccaacccgcccgccatagctgagccacccaagaaagtgaacaaaaccaacaagacgtcgaagccagacagcgcaatcaagatcgttctgctctccagtgccaaccccgataagactgttaagatcggggcgtcactggatgagaaataggaactcgcgctcatcaccttcctccgcgacaatgcagacgtgtttgcttggcagctgtccgacatgccgggggtccccagggaggtgattgagcacaaactcatggtgcgaccccgatgccaagctagtaaaggaaaaactgcggagattcgcatcagatcggaaatgagccatatgagaagagctcgacaagcttctcaaagctggtttcatccgagaagtcctccacccagagtggctagccaatccaatcatggtgcgtaaggccaacgagaagtgggggctgca

SEQ ID NO: 75087 - DNA, 11783 bp, Oryza sativa
ggtgcggcacagcaagctgttggccggcgcggcgggatgggcagccggcgtgcgggcggcgctcggattgcatctctctctttttcttttgcttttcttcttctattcctcttcggtcatggcgcgtctgtggcagtggcacggcatcttgcagaatgcggccgatgcacggcgaggtgcggccatctcgctaccgttgtgcatggtgcaaccttgctatcacacaatgttggcgtgatgcatggctagttccgatgcgattcgtcaatcatgccggcgacttcttggcagcctcgaaaggactcgcaaccaatcggcaagatgccggcgacttcaagtcggcaatggtggtgttggacgaaaatcgcaaaaacggaacaagaacgaaaagaggaattcgttttcgcggtagatcggcgagatgcaatgcggatctgcgagttcttacccttcttctttctcggtctccggtagaacatcgtgctgataacgtattacgcaaccctactgctacacgaagtagtccaagagggtcccgtaattctacaaaaagtggagacacaagatatgagggtgtgttatcctttctcattcatccattgcattctcaagtgtacaatcctcctctctactcctttatttatagccattccctcttccaccttttcatgtttagtgatgggcccaattagtgggtaaccgggccgggtcttcgtgggccggcggtttcctaaccgttactactctctaaatattaagatttaaaatattttagctctaaaaaacattactactgtagtaccactgttactatgcatgttctttgttactacaaattttgccatgttgttactgccaaaagtgtagtaacaacctataaattttgcagtaacaacctactgattttgtagtaacgtatcatgttactacctttctgggataatgttactgctgactcatagtaacaatgtaattattacagtaacataactggttctcacataatctgaatagacatacaaagcatgcaaacaatgttttctattcacaaattgtcatatggtgatttggttaagaaagcttgccatgaaccatgagatcatgggttcaagtaatgaattcatcaatttatttttaatttttataaaaaaaagaaaataatagaaggaaaaatgagagatgggaaggagagaaaaaatcaggaggagcgatcgtggggaggaggaggagcgatcgggagggggaagggggagaatcgctgggagggggagaggaaggagctgggagggggagggaggaaggagcgatgggaggcaggaggcgggaggaggaggagcgatcgggagggggaagggggagggggagggaggaaggagcgatgggaggcaggaggcgggaggaggaggagcgatcgggagggggaagggggagaatcgctgggagggggagggaggaaggagcgatgggaggcgggaggaggagagagagataaggagggagtgaggggggaggggaggggggtgtagaatagttattctaagggagagtgtataatagaactatatatatatatatatatatatatatatatacctttaaaaaaataagagatgcttccgtcgtttgtcaaaaaaccggtgaaaataaaccgggcgaaaaaaccgtaactgttcgatagaaaaaagggcgaaaaaaaaatccgattccgtgaaaaaaaatataatccgattccgtgccaaaaaaaagggcgaaaaaaaatctctatctctatctctacatctacttctatctcttctctatctctactaagaggtatttcggtcgtccgtaaaaaaaaccgggccaaaaaaccgagcgaaaaaaaccgggcgaaaaaaagtccgaccaaaaaacggagtgaaaaaaaaaacgggagaaaaaaaatgtctgataaaaaaacggagctaaaaaaaaggcaaaaaaaaaaacaattctgtccgaccaaaaaaataggaacggggcgaaaaaaacgagcgaagaaacctggcgaaaaaatagtctgatccaaaaaaaatcgaagcgaaaaagggagaaaaaaatttccgatcaaaaaaaaacggggcaaaaaaaagcagaaaaaaacgaaacagtcagtaaaaaaagagcgaaaaaatttaaaaaattttccgattccaaagaaaaaggaattatatatgacacggtaaaaaaaatcgaccgagcgaaaaaaagccgagaaaaaaaactgggcgaaaaaaagtccgataaaaaaacggggcgaaaaaaaaacaaatatgtccgacccaaaaaaaggcaaaaaaaaggaagaaaaatcgaaacgaatccgactctgccgacgcggtaaaaaaagggcgaaaaaaatttaaaaaattgtccgattccaaagaaaaaggaattatatgtgacacggtaaaaaaaatcgaccgggcgaaaaaaaaagcgagcaaaaaaactgggcgaaaaaatgaaaaaaagtctgataaaaaaaacggggcgaaacaaaaaacaattatgtccgatccaaaaaaaaggcaaaaaagggaagaaaaatcgaaacgaatccgactccgtcgacgcggtaaaaaaagggcgaaaaaaattaaaaaaaagtctgattacaaagaaaaataaattatatgtgacgcggtaaaaaaaatcaaatcctattatgtctagaaaggtccgacactataataaagtggtgaaaaaaaccgttcgaaaaaaaatgcacgagaaaaaaaataaaaagggcggaaaaaagcacggcggaaaaaagtctaatttctattcatcgttttagtagtccgtttatatctcttctttatctctaatctaatctaatctaactatagaagtttctatggtatattaaaaaagaaaaaaatgtgcgagaagattaaaacggttttaaaaaaacgcgtgaggaaaaaaatgccagaaaaaagcgcaaaagaaaacacgttagaataaaaagttccatagtcccaaaaaaaacacgcgagaaaaaaatatttccatcgtctgtaaaaaggaaaaaaaaaagcatatgaggaaaaaaactgttagaaaaaaacgctaaattgatggatacttggtcggataggctccatccacttttttccatctcttacacgacttttatttgtcatctattctcctgtagtggagaccctgcacatttttgtaggcaattatcatactatttttgtgaagtatagctattattcttgataacatattatagctcttattcttgattacatattatatggaaataatcttagaaaataaacatattttaattgttatttagagaagagtgcacagtgactctattttgtgtagacttgaccatacgagacagtgtaggatttgattggttgtaagaatgagattaaaagaatattttagattatatgcatgttgttatataaataattcaattattttaggtaaagcaaacatcgtaaggttgccatcatcgaggttgggctattacatttaagatgttccaattttctgattgtcatcgacatggttatgaatgaaaaacgtgtatatatatatatatatatatatatatatatatatatatatatatatatatatatggcaaaatctaaatcgcgtgcgctctctgttttgtcttatcgcgcgacacgctcatcggccgtccgatccaacaagcgctggtgcgtccgaacatggcctggtgattcatggacgtggcatcatctagagtaatccaaattggaagccatgtgatgctctacgctacgccggcttcaaaaataattttctcttaaactaatcatccgatctacgatccgattacaccgttgtgttcgtaagagttgaatctttataataagatctcacatgattatattttgatgaaaaattagaaattactttcataatatatctaaattacttttagatttcactaaattacttcttagatccataaagtaaattcaataaagcctaaaagtaatttacatatattaatatataagtaacttagaacaaaaagaaaataaccttatcatgacattaaagtaaatccgttatggaggtaaaaacatgagtttatatagaaattaaatttaatcagcataaattacatcattgactaaaaatgattataaaataaacaactcacaacatgaatgtacagatttcttttaatgccgtaacatgttactttactcacttttgttttaagttacttctataatataggtaaattacttccaggctttattaaattacttttatggctaagaagtaatttaatgaaatctaaaagtaatttagatatactataaaagtaatttctattttttcataaaaatatagtcatgtgagatcttgttataaagatttaattgttatgaacacaatagtgtaatcggatcgtaaatcggatggataatctaaaagaaaattccataagaagaagaaaaatacatgcacttttgagtatactagtagcaactggataagcgattgaggtagctggttatgtgtgtgtgtgtgtgtgtgtgtgtgtgtgtgtgtgtgtgtgtgtgtgtgtgtgtgtgtgtgtgtgtggttctatactcctagggagtaagtactccctctcccatccaccgttcatctgatcgatcagatatgtactccctccctcattataacgggtttggctcggtggatccgattagtttttctaattaaaagacggactgcttatcccgtaatttggggtttgctcccaacaggccgaactgcttatcccgaaaattggggttttggggggcggcgcggcgacggaccagcgcgacgatggaccagcgattcagcggcgactggatggctggcggcggtacagagatagcagctcgttccttcctccagtgatgactcctccccttcctccagcgatggctcctctctcaacagcatgtgttcctgaagcagaagtaatcgatttggagtcggctgaatgcaggagcggggcaaccatggcaaaatcgacgggccatagcagtggatttcatccaaagcagcaggttagtattcgtttatttttgtatggcaagatcaagacacgttgcctaaaattttctccttcgccgcagggtcacaggaaaatcagtttgtcaccacagtccaaggtatgcctcctgaaattgaatatatgtatgcctgtagagagggattaggtgtatagttcggttcatgtacgctctcagtttcagatgctaatttttccccttttagtgcatatgatgtttttttggttgatgaagtaaatgctgttttagcccccacccccctaaagaaaaatgtagatggtagtacgtactgaattttcaacggtatatactcattttttctttggagggatacttattggaatctgctagacggtattatgtaatgaattttggtgtggcagggttcttactgaactctctgttagacgatagtatatactgaatttttatgtggggagctttgttctcaactttgttagacgatagcatatactgcattttccacatgtatactgaatctttccacaatgatttatagactgaactttgatacgcaccagtatttactgaatttttcacagatatactgaatttttctatgggaggctttgtactgaactttgttatacgacagcatatagtatgtactgaattttctatgtggtacatactgaacttttctagaagatagcatatactgcatttttccacatatatacagaggcttttccatagtggtttacatactggaccttgttacgaagaagtatatactgcatttttacacagagaggtatatgctgattttttacatacagtagtatgctctaaactgtgcatatactgacttttctgtcagtacacatgattttttttatttagagggtacacaaaggtagaatttgctacgcagtattatgtacttcatctttccatacatatatgagtgtatgctgttttttttaaaacagaagtatatgttgaatttttaaatacactggtccatgtagtattgtctatttatgaaatgaaaaactaattatctgcaggctttgaaggtttctggcacaagaggcagcctaaataagactgttgcacgggtggtatccaggtatcggcaaagcagagttttaaatagacagaagaaagacaacactatctttggtatcaactgcaggtgtcagcccaaatgcgtagtgaatatcattaaagaattcgatgataggaagaaggagttgattggtgaaattggatttgatggacttttggatatcaagcttactaaggtaaacaggcagtttggggcatggctactaagcaaagttgatccgaaatcatgcgctactgttaaagatgtcaaccaggagttgccattcggttccaatgatgtgaatgcagtttttggcttgccatgctcaggtcaacctattatcccttgctctcaagatgaattggatgggaagaaacaaatattgtgtgaaatatttaagataccaaacttttcacacctgaaaatatcactcttaaagagaatcctaaagaagcagtatggttatcccatgacaatagatgaaaagagggttttcatggcggcttttgtgctttatgtcacaacgaagcttttggcaccgcaatcctgtgcaaacttcatatctcctaggtctattatggctgtttctgatgttgacaatataaaacagtacaactggtcccaattcgttgtagatgaggtgaagaaagcagcagaatcaatgcccacctgctttccgaataaggctcaactatccattaacgggtgtatcatctttctaatggttagcatttaaaactgacttgttaatgcagcatataatcaacacacatattgtcattgtgaatcattttttcaggtaaaatacttgagaaatctcctgttccggaaggttgggatcacatgtgttaaaacatgtcacatttctcagtttgaggatgatcaaattgctaggatgattcaacaagatgtagttagtaaacataacccaggattccccttccctcgttatgggaaactccaggtatgtacgataccctggccgtaatatgcctatttcgggctgcaaaatttagctaatttccaacatacatgctgttcagttgatgaaggatccaagagaaaacaacccccatgtgccagagctatctcccctaaacttatgctcctgttcgaagatcccatctagagccattgatggcggtaaaaatttaataaaattcctggtttcacacttctcttcgttagacgtacatagaagtgtcgggtcacaggtatgtcaaccatccgtatgctatgttacttgattgtttcttcattaagttgtaattttcatatgatcaagggattttaaactaacatgtggtatatatgataacataaaacaggcatacgaggagttgaaatcttccgttcaggatggattcgatcggatcgataagattttgcctaccatatcagatttcgtcgacataagcaccatgcaaactgctattcacgcatctaacctattcaagagagctttcaagactaatattacagtggcagttaagatagtgataagggcagcaataacgaaagttattgataccattgaggatatacaagggcctctccatccatggggagacacaactgccatgggataccacacacccacaaactactccacacatgctacaaaagatgctagtcaattggaccaaccaaccaacacggtcaaacgttaaacgtgaatagtgtaaaactgcacttattttggatggaggaagtatatctttaggccgtgtttagttgcaaattttttcttcaaacttttaactttttcatcacatcaaaattttcctacacacacaaatttccaacttttccgtcgcatcgttccaagtttaaccaaacttccaattttgatgtgaacaaaacacagccttaatatatcaccaagcttacactacaaaaatgaatatatcttcaatcaccatgtgaaaatattccaaaaatgatatgtagatatatcaggtaacctaaaaatatgtcattcgttgagacatgtcattagttcagacagtagccttcactatttgtaaatacatttccaaaaatatacatagtttttccttaaaaaatagatagcttcagacaagtacttgcggcggtgttccagacacaaaaacatcccatgtatgcacattatttgtgccatcatataattgatatttatatatatctccattcaccaaaaaatgcatgcacattaaggctgtgtttagttcacgccaaaattagaagtttggttgaaattggaacgatgtgacgcaaaaagttggaagtttacatgtgtagaaaagttttgatgtgatgaaaaagttgaagtttgaaaaaatatttcggaactaagcatggcgtaaggctgcgtttgatacttggggttaggaacccaactcgaccgcacggaaaatggagcggtctattagcgcgtgattaattaagtattagctaatttttttaaaaaaaatggattaatttgattttttaaagcaactttcgtatagaaactttttgaaaaaaacgcaccatttagcagtttgaaaaacgtgtgcgcggaaaacgagggagaggggtctagaaccttgtggaaggaacgcagccaaccatggaaataaaccaggtgcattacatccaaaaaatgagagctcattcttgatccagttgttttaggaaaaatctaggcactgtgttttccagcccagccaattggcttattcatattttggtaggtagaagctggaaaataaacaacagcattcaccgtttctatctacttgctgacaagctttgtagaaatggtatatctctattcagcaaaaataatgtttacaaacttacatacgatctattatatgtgtgctgacatttttatttttagagatgataaaaatagatgggcagatggcacagttctagaaggcctagagggtgagcatttcagcaaaaacaaatagatccatctagggaaaaaaaatagtgtcagatcaaaaaacatgatacatctgtaaatagcatttcaaaaatacatttctctgaatcaacgaatgatagatttctaattgacagtcagagcatgatgtttctaagccccataattttcaaaacatttcagagctttgacacctgttgggatacgcgtaggctacaatagtataaattaaaattttctatcgcgtaaaccaggaaccatgcaagtattagatcatagatcgttaccactcgacgcactgcgcagtggaagaagacgctgagaagtcgaaggaactctcgcgaagtagcgcgcgtcgatgtagaggaagtagtcgatcgcaccagctcgaccttctcctcctctgcgttctcctcgccgtactcccacgccgatcagcaccacaaaccagcagcgcctctaccggtatccacacgtatagggacggaacgccacgtgcagatgtgctagcacccgcgcgtggctagggttttgctcggggagggaactgatggctagggtttctcacgtgatgcaatgcctccgccggtcacacccctcacgaatatataagatccatcactcgggcctccaaggcccgtaggactcctattcggatccctatccgaattaagctcatattggatctccatccaatccccttattccggcccattaagcgtgcgaccttgtaggttcatgtatactcggctgtaacccgaaaactccttttcggtccacgcgtcaacagcggcccctagcagaacatattgacccaccgggcatacataaagatcatatcggctgaacctctagtgtatacttgtatgaacccctttgcctcacgatatcgattaaactcaaggctagatatgtgccatcctctaatagctcaatcattcaatcgaacctgttaatagattatataacttgtgattgactcctcaatcacctttggcatggccatgcacttccataatctacaacattgaccgcaacagcagcaactcttgctccattgcccacgcgaatgtccactttgcctcttgctaagtgtcacgcccagaaatttccgaatagaattccaagcagaatgtgcatttaaacccccgtccaggaccggccggggtacacaaacgacaaagttgacaaacagatccacgtcttacaaacattataaaagtcttacataaatgcagcggaaaattaaaagataaatggagctaagccttgacttggactgcagcgggaacaccactccataggcatcctcgacggcatggacgaagcctactcctcggagaagccgccatctgacacgcactcaatctttggggttttggggaaaatagagcaagactgagtacaaccaccatactcagcaagtcataccggaatagagggtatgatgcaggatataatcaaaggatagatagagcggttcatttgcataaatcgagcatttataaacagtagttgaaagcagtaaaatagttgtaataattaatcaatattaactatccactgtccaacgctacaccacgttgcaacaggcccaaccatccacctaaactactcaattccattagactaagctagggtgagactaatcacggtgaatctggttgaccgcccgtaaccgcgggcacggctattcgaatagttttactctgatcagaggtgtacaattgtacccacaagacacagccccgcgacacgtttccgtgtgccgacatgccaccatgacataccggaaagaggccgtgacaggacccttcgcataaccccctctaaccaaacacaccacaccttaggtttcacccccactcctcgcaaggcagcgggcagtcccctcttgtgcctaggtgaatccggaagccgcataggccgtcgcagggcccatccaaactccatcacgcccacccttgcctggatgcgttagctagaggaaagctacactacaagcccagccgttgcccacgctagcttgtggtaagtacgaggaattctttcagggtttcccgcgaaccggtccttaagtgccatgggcgtgactatcaaaaccatgcacccacagccgacaatttaatacattttaattaaccaacaccggagcggtggcaataaccaacatcattactagaatctgatacctatggattaatgtagtcccccattttgtactagttgaactaagcatggctaagcacttcctaatccaacagcgaatcattttacaaccccaagctaacaaaggagcgaggtacaaaaatagcatggctgtaacagtaggtaaatatcccatagtaacaatttaaaacaatgtagtatttaagggaaaacggtagagcatttgcaatatatgttcaatatgttcaagtgacaagcatgacttgccttgctctgctgctggaggaacctcggcgactatttcaaaatacaccggagcgttgggagagcaggaatctaagcgacatacaaagcaaacaatacaaacaggccataagactactgaaacagagaacaaaaccatttttaatagattctatgcattttttcttgatttactaagacttgaatgggcttaaacggagctcggatgaattttctatgaattttagaagattcactgtgttttactataaagagaaaacccttaattatttattgcgca

SEQ ID NO: 75088 - DNA, 11668 bp, Oryza sativa
aaccagtcaagacatgtgatgcccataatatactggaacaatagtaacagatgaatacctgaataatgttatcgtgctcttaaaataaccaataacagtccaggtgtcaggattttcctagtaaggataagcctattgtaatcatagaatacaaacacatgcacattaaactaacatccttaaaaaactaattgggatttgtgggccatggaaccaacatccttcagcatctaaaactgttaaatagccatggtccgatgatcatatcatatcgcatatagcaagacaaaaagagcatatgagacaagaagccaaacaagtatgacaaaaagggccagggaaggtaccctgccatgtatcctttttatcacaatagatagatagggaaatcaaaccggataactataaatgtcaaataaacaagaaagctattacataagaatgcacaataatataatgtgaaaagaaaatccataacctgattttaatactcatcacatgatcctgaccttgcatcataaaaaatgtacacagttttctatcaatcatgccaacagtgcctaggactcacattttctttttttctacaaaatgctattccatgatttcatataattatgcactgacaagtcaatattcataccctaaaattaaaatgcaaaacgctcctcacacacccgcaccacgacgcaaaaccgagaaattttggcaagcagtacgttcagcgcctcaagatcgatccatcacggtctcactgtcaaatcatgcgccccaaaattttgtataaacaattcaaaattgccgtaggaaacgaagcacacaaagagggattagatcctgacgcacctagcactccggcagcggtaggggtcggaggagagtggaatggatacggaccagcggcggttggggatcggaagagggtggaatgaatggattgagaaggggaatcgcctcggagaagtggagaaggggatggaactagcggtagtgagatgaacgcgggagagggaagggccacactagaagcggggcgatggtggccatttttggtgggtagcaacaatgtcggaggcctggctgataaaatcctcacgttctagtacttttcctttttttttttgattatttttcttatggatgcgactacagggagcgcatgcactcggttgtgctaaccagcgaccatgctttttaccaaaaatagtgcagtgtgtaatcaacttgttacccttcttactaaaagtagtagcacctgccacttgcatcctcattacccatctaaatttcaaataattttttctcttaaattacttatctgatctacgacccgattacatcgtttcgttgcaattatatctgtacatcaagatcttacatgattatattatgatgaaaaaaatatttatgcttgtaaatcactttaattatatactaagttacttttatcatatatatatatataagagttggattttttgcacgcagttcacatgtacccacaaggctagtatattaggtgctaacaaaatgtaacatacatgttatactatattttttacaagtgtaaaataccttgtttatataatttttgtatttcttatgcaaaacttgtttatgtagtttaccttgtttatataaattatcttgtttatgtagtttttgatggtaggatatatatcattttggaaatatcatttttgcaagatgacaatttggtgatatagtagatatattgttttctcattttgactaaatatcatgttataaacaaaataagggttagaaaaatacaatgcactagatatataaatgttatatatgattattattgaaaaatttatttggtaaaaaatgcaacatacatgttatacatatagtgaaccaacctaatcctaattatcttttctccctatagtaagcattcatttcgttaaggttagctacattttgcagcaggaatcttggaacacatcaacagtgtagattgtaggtacatatgaacccgagtgcgaatctgcattatacacacacacacaagcaaaatgcccatgcgttgcattgggtgaagcaaaaaaaagaaaaagtagtaatgggtgtgtgggaggagtgtaaagccaccaaggttaattgagctcctcatagtcaaatcgaatattcccggtgcaagaatgctctaaatccacttacatggattattataagaaatcaattaataccactataaaatctctataatataaaaaaataaatttttttgccggtactttagtacgtcatccgtgtatgagtcggtttttaacttcgtttacttttggaaatacattttcgtatttgagttagtttttaagtttgttcgtttttggaaacatagaaggagtcgtataagaaatctctttaaaaaaactcgcatgctagcttgagatgatcggactcctaattgcagcttatgactttctaaaaatatatatatctaagcaaatttaaatagtgaatttcacattaattaaacagtataacaataataagattaaaataactctcatccattgcaatgcacggggatttttatagtgaatactaaaatttgaaaccataaaaagtatttatttttatcatgagtcagttgcaatgtacggttatttttttgtcattgatattgataaacacttttttatatcataaagagtacccatagtagaagaaatatttttagctagctatcagatcaagctcactgcactccagtagcagaatcgttttcactaaaaaaaaacagaaggaaatcgtacgataaatagaaaaaaaaagtgacgtggttaggtgtcctacggcgaatgagaaattgacgcggaaaacaatcttgatgcaaacacaattaattttgttggtgattacgtgtttttcttgaaaaaaaaagcatgcgattgttttttatattttaaaaagtaaatcattttgttggtgattacgttgttttttattttatttttaaatagtaaaatagcatctatttttatctgatctctggtacacgtgagtccaaactttataattcagtgtttataacgacgtgcaagcctcatatttaagcaggtgcttgagtgcttctcaagctgtggggaagttattcgtgttacagtaccacgatgctacagtctcggttgctacagtaccgtgcagtactgtgctggctggtgctcctctgttatgtgggctggctgttgggttgagactgctgggccggccttatactgctttggttgggctgcttgctagctttctgttttttcttttctcttttatttgtgggtgtaagagatctccatcacgcttacggattgtggattagcgacaaaatattgtgtgggcccatgcttaacgacggacgaatgattaaccggaagctttacttatttttttaattaggtactgcggactctaatatgtcgtgttttgttgatgacgaaaaaaaaagatgtttaattttcaaattaaaattgattcattataagatttctgaatcataaaatatctgttgaagaaagcggtgttaaacgtttgatttttcagtgcatggtccgtgctagtggcagagagaaaaaaattgggattaaatagaatttgagatgtgagaggcaaaatagacttattctgagtaataattagtgttcaatttttttaaacggtagtgcagcatatgagaggccggcccgtactcagtgcaaaaggttaggcatatgagaggccggcccatactcagtgcaacggtagtgcagcatatgagaggccagcccatactcagtgaaaaaggttaggcataggaataagtttaccggaggtccctcaacttaacagcgagattttctgaggtcccttaaccacaaaaccagaaatctccacccctaaactatacaaaaccgttcactcaagctccctaggcagtatatatgggtggtttcgctgacgtggcatcctagtcagcaaaaataattaaaaaaatacgtggggcccacatgtcagccctgcatattttttttggcaaaatttgctacaggacatctaaaaaacgtgtaattagttagaagataccgcaagaatgtttatttgttgtagggcattgtaaaaaactggtaattagctgatgggcaccaacaagattattttattatatttggaggaatatgagagagaaacaagcattaaataccagtttacccttgcctcaaattagttagtcttcactaatcacatattctcatcgccaagcaaagagcaagagagaggaggctctctcgagcgcagcagcagagtcgtgtcgtttcctccgagggcagcagcagtcgccgctgccatcgccgctttctcgagcgcagccatcgccgctccctttgcgctgtcgttaccgcgcaccggaccacgtgcaccctctgcgccgtcgtcgccgctccctttctccgcgcataggaaccatcgtcgcagctcccattttccggaagaagcaaccgccgccgctgtcgtttcctttctccgcgtgcagcagctgtgccgccgccaccaccgctccctccctccgcaagttgccgctgcgccgccatgtgaccgtgcgaggcgtggcgtcggcgccggcgggcggaggcggctgttcagtgcgttccggcggctgcgggtgcggtggctagtggcgctgtaccgccgctcgctgcggcggctgcgcgcgtactacaccaaggcggtccaagacctcctcgagggcgcgacggtcatgagcacgctgcactcgtaggctgccacagactgctcgttcggcgccgctttcacgccggtggtcgtcgtgaaacaataacaccagtggttgctcctcctccttcgcttgcaggacatgaagccatggagtagtagcaccggtgacggcaggtgagcgagcgccacgacgataggcgaagcggcggcgagcaaggttgaaggcagcggttgagaacagagagagagagagagaaagaatgagagagggagaaaaggataaggaagaaacaaaaaagaaaaagaaaaaaaatcaaaaggtactccctcgtctcataatataagagattttgagtttgtatttatattgtctgaccacttgtcttatttaaaaaatttgtgcaaatataaaaaacgaaaagttgtacttaaagtattttggataataaagtaagtcaaaaaaataataattttaattttttttaataagacgagtggtcaaacaatgcaagcaaaaactcaaaatcccttatattataggacaaagggagtagaaccgtacttacacagctgtttctctctctaatttttttagatataataaaataattccgcgggtgtccagcagctaattaccaattttttgcagtccctacagcaaaaacgcgttattgcgatgtcttctagctaattacacgttttttgaatgtactgttagcaaattttgcctattttttttcttctctgttcttcctcttctgttctcttttctctcttctctcttctctcttgacttcttgggtgagggaggccggcggcgggcagcgagcggcagcggttggcggtggcaggtggagtggcgggtggtttcgccggcgtcatctcttgctggctcccaatacgtgccgcgacctggagccccgcgcgcgtggcggcggtgctcgagcaggccaccgcgggtgacctgctgaccatcgcgctcgacggcgccggtgagcgcgtccagaacgtcgacaacgtgcgccacatcatcttcgggcggcatgaacggccggagtcggaagccggaagccgagattacatgacttttatagctaagaaaacaaacttcggtcacatcgtacgggcacgcagcacgcgatcaacttaatttggcagccactagctggccgcatgcacgaagctaactgccacacaactcatgcaacacattcatgtattgactagctctaactaatcagctaactaagctatgcatgcacaccactaacagttttgtggttaggtggtgctgaggcgctgagcgcgctctactacgaccagctcaagctccagcagtggcaatggcggaggagacgagggcggcgggtgggacgcgtatgggaatggcgtgatgaggtcatcggcagcggggtcggcgcagaagcaggcgaaggaggatgcggaagcaggcgaaggaggagagcttaagcatgcaggatgctcagagccgcctcctccggcgagctcacctttgccaaatcctgcacgccacacgtcgtctcttcctggaaagaacgaaccagcggtgtggacgtcgtcttgtccacggtggtggcgtgctgctccttgacgacggacaggaggaactccacggcgccgggcgcgccctggacgcaccgctggacgggagcaaggtcggaagaactccacgtacgcgaacgggagcaaggtcgccgcccgcctcacccgccttctccgccgttctcctcgccgccccggtgcgctcgtctgccgtgggcccgcagccgctccgcccaccggccgccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaattcggccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaatgtaaaaagttagggtggtgggaatcgaacccagctggccaaagcaaagtttcactccgctaaccaagttggcaagctgctagttgtgttcaataattcaatcaattaatacatattctatatcaatcgtgattttgaagtagattgaaaatggtccgactcgactattgagccgattaaaaatgattttagcaacgtttgaacaggatgacggacggaaaaaaaatccggaaaccttacgtattttttattaggggtgtgtgtgtctatatatatatatatatatatatatatatatatatacatacatgtatatatatatatatatatatatatatatatatatatatacatatatatatatatatatgtatatatatatatatatacatatatatatacatatatatatacatatatatatatatatatattgtcagggttacggataaggtataccctctatccttagacgtacgatgagtattgatacggtatacccacgcgtatacggatagttccagtatatgttaaggaaatctatcacgtgatagaaacagaatccacggatgtaaggagtcctactcgggcaagaccgggtctttaccatatcgtgagaggtccgatatctccgagttctacttggagatcaactaacccgcggtataaaagggaccccctgggcaggacctagggcatcgaatctcaccgcaaacacatccaccacagctacgaagccggagcgcataggagccaagtcgccgggagatctagtcgaaccaactcgactactctctcgtcggtaccatcgagttctgttattccctttgtattatgtgatttccatcatataatcccataccaactggattagggctattacctatcaaggggcctgaaccagtataatcattgctttctgtttgcttgatgccgtactacgtagatcctcgttccaacggaccccaggtctacgggtatcctccgttgacagtggcgcgccaggtagggcgacttggtgctcaaggttctactactatgacttcaagcctcttcgacgacagcgtcgaccccggcatcaaccaaggagcctcaacttcaacgatgctggtgtggactcaagtcggcgaaatcgtcttcccggtctacaccacgatgccgatctcgaatggcccagcaattaccaggagcgagaatggcgtggttacgaccccggtcgactccacgtcgaaagatcctcctgcagaagcggagaacggaacatcgacaacatttgagcccgagaaggatcctaacacggccaaatcttgtctccccgacgagaagcacgagccgacaaggataacttccgaggcgacaaggacctggtgtcctatccacaagaccaaaaggcacaccttgcaagcttgctcggtttttcccgacgtacaagctgaaatccgtgcctgcaaataacgtggaattcaacgtacttcccccactcgtgatgtctattgtcccattcacaaggcaaagactcacgacctctcgagctacaaggtccttctcagtgccatgaggacgtcgcctcctaaggtctagcagtcacaaatctcccctagagatgcggacaaggagcgaggagtggcgactatttcagatcgattcgtcggggtaatcgatatcgacccccacgagccgtcttcctacatctgctcgaagaccaggcctcatcatcaacaagtacagcacgcaacgtgtacgctattgatgggaccagcacatctacaggcggcaacacggaagcggaggatcaattggctacgcaggcccaacatatcagaaccatcaatgcaatactgagggaaaccccttatgatcccgtcttgaacgctgatcttgatcagtggatgaaacgactacgggaatcagtggccaacctcagtaacgcgttcgaggaagccgctgccagggcaccaccagaacaaccgccgacaggcggcgctaatggggaacagcctgaacagcggacgccacctcgtcaagccacccctctgcctcgcggcactagtgatctccgcgaccatctgaatggccgccgagaagcgcgacgtactcaagataacgaaaatcgttcccgacatcgcgtctcttcgcgacatcgcgagaacgaagagcaaggaaggcatccgagcgagaaccgagaccgtgatgatcgccacaaccgtcgcgaacgcactaatcgcgagcaacagatgccgggcgataccagtcgaggacgacgccgtaatgacgacgacgatggagatcagcgccgggacaacaacggtgggcgatgacaaggttctcaagaacctgagcgtcatcctcgtaatcgcactccgaagccgagtgactcgtcatcatcctcgtcatcttcatcatcttcatcatcgaacaggcatccacgacgagcacatgatcaccgacaacccaccgcccctagcggcgggtgcagagctttcactcgttttctgcgagaggttagatggcctgagaaatttcgactaggaacaatagagaaatacgacagaagcaccgaccctgaggagtttcttcaggtctattccacagtactctatgctgccggagtagacgacaacgcattggcaaattatttgccggcggcgttgaagggatctacacgttcatggctggttcacctcccaccctacttgatttcttcatggacagatctgtggcagcagttcgttgctaacttccaaggaacatacaagcgccacgcgatcgaagacgacctacacgcgttgaagcagaatccgggcgaatcattgagggactatattcggcgctttaatgagtgcagaaatacgatccccgagatcaccgatgcttccgtaatccgcgctttcaagtctgatgttcgagatcgctacactacccaggagttggcgacaagatggatcacgactgctcgtaagttattcgagattgtcgatcaatgcactcacgcggacgacgccctgagacgcaagaacgacaagccgaagacagggggagagaagaaaccagccaaggatgcacctgaggcaagcaagaggaagagtcgcaggagtaggaaaaggaaagctcaaacagaggtcctcacagcagaatatgctgacccacccaagcacctagacccacaaggtgacgacacgaagcaaatatggtgcccgatacacgagtcggacaagcactctctcgagacttgtttcgtcttcaaaaaggcactcacgaagcaactggcgttggagaagtgatgaggacacaactaactcggatataaccatggctactttatgtattaatcaaccaaaagtgcatatgttctatattagatttaccttgctaagttctcaaatggagaaagcggagcaatggcagtaccatgaattatttgaaacaaagtttgtggttaaggatagagcatgtcgtactataatcgatagtgagagttgcaataacttggtgagttcagatttggttgagaaacttgagttgcctacacaaccgcatcctcatccatattacatcaaatggttcaactcttgtggtaagttcaaggtaaatagaattgtgagaataaacttttcgattggaaattaccatgatactgccaattttgatcttgtccctatgcaagcatgttctttgttgttaggtcaaccatgggtatatgataataatggatcgcataattttgttgctaatacatacacatttaaacataatggtcggaaaatgaaattggtacctatgagttttactgaaattttcgaagataatcttgaaaggatgaagaatggaatcgaggaaattttcaaagatagtattgaaaggacgaaaaatagaatcgatgagattttcagagataccaggaaagatactattatgatgccttcaactaagtctaagttattacaaaatgaacgtaatgttgtgcctattgttttggatactaatattttgcaggcatctgagaataaacaaggtaatgggaaagagaagaaagacgaagaggaaaaagacctatctttagctccatgcatgcttgaagaatgtttaattaaccaagcacctataatttctgaagatgagaaaaaaggtaatgataatggtgctacagctacttaaggtatgcatatttatgaggtgccaactatgtccactacttatgctacattagagcaacccacggtggaaacaattgttgaaatacctttgtcacaaaacaatttccttgatgtttcttgtgataaagaagtgttgtgcgatgcttcacttatatccatgccacaactagtgaatgaacatgttagttctatagtagagccaccatgtgttcagtttaaacatgttattcacattgctagtgagaatgaagagcttaaattgctatcttctttaaatacttggggttatattcaatttgatgatatttgtccactcaactgtctaaagaagaaattatttgctagatttgaattgccatgtccttctgatgtgatttttcatattattggcaattatgatagtaaaggagaatataatgtgcatcgagtatatatttgttcgaatttgactatacctccttttcatgatgaaatgtattatctagaggaccgcatgcatataagtaattctctatctagttcctctagtt

SEQ ID NO: 75089 - DNA, 6574 bp, Oryza sativa
ctccctccctctatctctagagttaagggtattttgatcttaaaactctttaaagtggtattttattcggaagacattgtaccgaatggtattttatcctgtgtattatagtaagtggcatttcattaaaatcctacaaatgaagtggcacatgatctatttgctaatggagttgacaccttgccaagtgaggattcgcccatgattatttgtattgaaattatctggatatatacctgaaagcaacagtagttaagaaaaaaaaagaagtggtaaactcatttgaaaaaggtgataataagataactatcgaacaattggtaactcgtacattaattgttgaaactgatttttttaaaaaaatcattggattttctaaaaagatattaaactttttttaaaacacattgatctgttggctgtcaggttcgcaatgtcaagattcatggatatattgaaaaagataaaatcgttaaggccggtagatatattattggattaatttgtaactacaggtaaattaattgataaaacttagtatattttctgtaatttcatcagatttgctaaaaactgttaatttttttaaaacaatcgatttgtggaccaccataaagatttgtggtgcaaaatatggaaacaaaccttgttggttattgtgcggtgtgcctccactggtagccaacttagtaacactgtgtgtattcttttatacattagttgtatgctgatgacattacgatttcttttttaaaaaataacatcagaagttatatagttagtctcattttcattaagctaagttagacggataaatcaaaccaaagtttcatattaagaaaagaataaaaatatgatgaaacagggttctgtgtaagaattccttagagttcatgcatacgcatcctgcattagccactactaaaaatccgagaatgagtcatgattgatagcaccatcatcatcggacataacaaatacactttcttctcccatcctttccgctctactttgctatgccaactactcttctctcctccttgtgattgctttgctcatccctcttcgctgccccactataaggtatagggtgtcgttttgaatcaagtcttaaatacttctatatcgaagcagggatttaggtcgtactacttcatttttattgccctaaaaacataaatataaattcatattagtcagttatactagggtttggtgtttccaatcagcattgtcgtttttctattaacatcagtatgcttctgctccgataggtttgctttagacactagcataatttaatagggcaagaattgccgttttccgattgatatcgacatgtctctgttttcatagttctatttatgatattataacagagagctactattgtatttcttttatgtctgtctgatttcattctatttcatggtaggttaggtcccgtttagttacctaaaagtatttctcaaaaacatcacatcgaatttttaccatatgtatggagcattaaatatagattaaaagaaaaactaattgcacagttatggaggaagatgaatcttttgagtctaattagtccatgattagccataagtgctacagtaatccacatgtgctaataacggattaattaggctcaaaaaatcgtctcgcgatttctaggcgagttataagattagttttttcattcgtgtccaaaaacttctttcaacattcggtcaaacatccgatacgatataaaaaaatttttcattttgcgaacttaacatctcaatcgatttcgaccaatctagccgctatgtgcactccttttcctctgctggttgcccacgagagcctatcgcctattcgcctcctccgctcctcaaatcccaatccccactcccacctcactccccccctctcttcgcctccctctctctctcctccgccatggtcatggacaagtccagcctcccgccgccgccgccgcctcccgcctcttccgcttccgccgccgccgcctcttccgccctcaaagccctgaacaagtcatcctacaagatctccaagcagacctcctcgtcatctctggcttcgatgaaggcatcccaatcgccaccgccgccgccgccgcatcctcgccgcccttctcctcctccgctcccgccgccgccggctcctccttcgtccgcccccgccgcggttgaccacccgccgccgcaaccgcctgtgtacaacatcgacaagtccgacttccgggacgtcgtccagaagctcaccggctccccctgccacctcctcccgcctcaggctcagccgccggcccccgccgccgccgtctccatgctccctccccagcccccgcctcctaccatcatggcgcctccgcccccacccccgccgtcggccattccgacccgcctccaccgcatccggccgccgccgctggctccgccccgcccgccgcccatcctgcagccggcaccgcccgcgctctctccgcttccgccgctgccggccgtctgcatgacggcggagtcccccatctcggcctacatgcgccgcctccgcgggatgccgtcgccgatccacgtgcccacctcgccgctcgggttcgggtgcctgccctctccacggacgccgccatcgcccggtgtacccatgccggccaccagcccccgcgtccgcgacccgtgaccgagaaccagccatgggtgctcctgctgctgctgctgctgcttccaatgtgtagatatggccggtgtaggagagatctggcgaggcggcggcgacgacgaaaggaggaaggagcaatacaattacaatgtgttagcttcaccttaaaatcttagctcaattttttttagcatgttctacctaccttataatattttgttggtgtatatggcgatgaattgatcatgtttggctaattttgtaacaagcttatgcaatatgtagtagcaaaactcaaatctttatatgcaaaatttatttagaagaatttcatggaagatgattgttcatgatctgatttcttaaggtgttggtgaatcatgatcctacatgccttgtactggaaatgttttgaactactccgtaggttaatttgtttgtgtttgtgaagtacagattacacctcagaagctgatcaaatctaagctcggtgcagatgccaccagatgtttgagcttggtctttgatgagtgattggtatttggatcattgttcatgacagattttgttctgtaggcgattgcaattatgcttcgatttctggtgtgatatcgacattttttgttttgttttctggtgtgcaatgtggccatctaattatggctacatgtggtgtaaagcatatgtttggtgatacatcgccgttcagctttgccttttctcctgttaatgatggatttcatttgtttatcgtgagtatcagagcctttgcaggttgcacgctctagaaattgtatgaatcattatatcagcagcggcaagtttcctatcgccagtgaggtaaatgatacaaagtttatttacttgatcacattgacatcttgtaatatggaaatgtgtgaaagaaaattttaacactctagctgatgcttcaataagcacttaatcaattggtgactgacaagtattaagtggaaaatatcacatttttctattctcgattttcactttcagaagcttttgacttcagtgaattagtggtgaagtgtcgagctgtcgacattgcaaaagtggtcaaggactcatgggtgaacacggagggaacatattcgaggtacaagtatatggcctgagcacacttgcttatcttgagctcaaacggaggtgagcttgtgagatattcaacttaagggaattttactgtgtgtcaagttgattgaaaagcaacagccgaaaatcacaggtgtccatttctgccatcacatgaaatccattttaaagagatgatgaaaagatacaggtgtatatggtctgcgatgcaacatctgttctgttatttggtccctttgaattttcgttcttccccgctagcctgtgcttttgttgccacaatatatttcttcctgacattattcgttgtttttgtccatttgttagcttgacgccacccttccgatgttttgctatccaagttacgtggtttcggcaaatcatgcgaacctgcgtaaggtttgaacagcatgggaaacacttgcagctgtatacaattgtttagttcaaagagtctcatttctctgtaggcgttcgtttgtgccaatgactacaggtttgcatccaaattgtatgtcagatctgaagtaacctgtttttagaattaaggaattcatgagtttaaaaacagagaaaaaaaatcatgaaccaactcatctcccacccataaactcagaaaatctgtaaaagtaatatcacaaatcactagccaggaaactagaagtgttaaaggcacatgcgaaactgcccagatgagtggtgtactaccaaatagctgttggtgcttgggaggaagaagtaatggtagaacatgacatgtcctatctgtcccggcatgaaaatcaattcacactgggagcctcatgtgcaacggcaatctttactgcgatgggaagaaatgcatagctgggctttttttctcatggagataaatgactgggattctgtagccaacaactcaagtacctctccattcattccggtttcaggcaatttaccatcctctacactctccactgccttggctggcagtgcttccaaacctgtgcttctttctctgattcgctctgcctacccaatctagctgccaaatggctgcacaattgcactgccattgcactcgtcgttcaagcttgctctggaaccaaacagctactggaggtactcagtctgaaactgcaagacggcggtctgctctgggtcttcacaaggatgtcaaggttggtcgtctgtcagaccagtgtgccatttctagccaagactaaaccagaagccagtgccatcccaaacagagcatgtagccgaacacagtaatactttgccatgaaaatcttgctgttgtcctgaaattgtaatgtcaaccttataaggtgataccgaaatggggacagttttttttaaaaaaaaataaatgggagagtggtatgagagacttacttcatggtttttcagcacatagtccacaacccatttgcccacagggagtgtcaaggcacaaaggacctgaaatacaatagaagtaatggttgagtttagaaagtaagaactggtttgggatcggtatctcaacatgaagcagtaaggaacattggctcacagtgcaagctgatggaagagatttgctcatgccaaaagcagccaaaagaacataaagcgtgacaaccccaagagtcactaatcttgatcctgttttggtgccaattcttacctgtttgtaggttcaaacatacgagaggtaaacgattttttttttcaaagctgcacaagtgaaatgctaaagctaactttaggcgttggtcataatcataaatagagaaaattaccaggggagacattttcccaacagcacgatctccatcaatctacaaaatatcagactccatcactgacaacaacaataatattcatagtcatcacagcacattgctaaattatgccaaaggaattatacctgatgaaaatggctgcagaagagtatcagggtagtcgtcagcccaactagaatggatgaagcaatgactgttttactgagagggagaagagctgttccgctgtaattgaagcatctcaagacaaataatgtaggtgcaaatggccattatatccccttggaagtgaaagtaatagtgggaaccttcttgctttagaggatacctggaaatgtttctgctgctgtttgagaagtagaaagctgtggttgccaatggaccaaatgcagcaaaacataatggttcacctagtcccctgtaacttagtcggaatggtgggcactacacaaagagaaaatacaaaagaagaaatgtctgagatattgaagaaatcgaggtgaaacatagtgaactgctaaaatgcttcagctttagctgttagtagagatagcttcttgcaaaatggcacattttttatgtgctagagttcatgatgattcctccgaaaaagggtagaaaaatttacctgataaacatagccacagatgattgcacaggttaccgataaaatgaacctggcatccccagcttgggcaaaggcccaaaatagccccataaatccgaacaggagagaaatatttgcagcatattgcgtcatcgttcgactgcagagtgcattacgatgtaacatgttttcacttctaaaacaatggttgcaaactatttttaaaaaacaaaagcttgcatagtagttgcattattgcttggtattagcagtacctgccaacgatgttaacaacagattccttcttgttcttatcagccccagtatctgaatcgtaaacatcattgctgcaatgaaatcaaactctcaggaacaagtgagcatgataaaacgtaacaatggatcaatagtgattcccatgttagctttt

SEQ ID NO: 75090 - DNA, 24193 bp, Oryza sativa
ggactctagtctcctcttctaatattccttattttttaattccaaatttcagttatttcctaattgtatttctatatggactctagtctcctattctaatattccttattttttaattccgaatttcaactatttttttcttaattgtatttctatttggactctatactctacctctaatatttcttatttttaattccaaatttatgttatttcctaattgtatttctatatggactctatactctacttctaatattccttatttttaattccgaattttagttatttcctaattgtatttctatatggactctagtatcctcttctaatattccttattttttaattccgaattttagttattttctaattgtatttctatatggactctagtcccctcttctaatattccttattttttaattccgaatttcaactatttctaaattgtatttctatatggactctagtctcctattctaatattccttattttttaatccgaatttcagctatttctaaattgtatttctatatggaatctgatttttctttttctctgattaatatgagaatttctagatcatgagagtgaacgtggtggctcctttttctatccctttaataatataatagattccggtcggcttctctttgccggtcaaaaaaatgtcaccgatccctttccaaatacgagtacttatcactatttattatatttgtttttttaattttgattactcgtagcaatgtaacgttctttaattatgaatcatcatttaaaaattattaatgattaaagttgaaataccgataattaatagtgacaagtaaatgagtacgacgacaacaatagacagatgatggggcattcttgaaagtccctcctccttattctagttgagaacatccttataaggcaacattatacacatgttcatgttatctagcaaccccatcgttggcttattcgagaaataagtcaaacaatatatttgcaaatgaaaataatttataaataaattttttatatatgttcttaacgatctaaaagtaaagactgaaaaataaactacgataaaaatgccccaaaatcaattctaaatttaaggctaaaaatttaaattttggctgataaacataagtataagcgaaaagatgtggcagtttggtcgtgtgcattttttattagtgtagagattggacagtttttgttgtttaatgaaatctttcactatactttaaacaagtaaatgggcgcagagggatcatagcataaaaccgatttgcctttagtgatttttctcactgtatgatagtcccgactacctgagcagtgacttcttgctgtagtatggtttgtacgataggggctgttaagattatagataaaataagggagtagctatacaacattcgacagttttttaaatagaaaactttcaattgtaactactatgtaattataatgtaattacattgtaactactgtgtaactacaatataagtcatctgtaactaaagaaataactctgaaaaaattgatggagcaattggttagttgaacgagcattcaagctgcaagtctcaggttcgatcgatagcaaatccgtaaaataaaccttatcaaaatttgatatttgctaaaattttagtaagtttgtaatattgtcaagttttgataggatttcttatgtatttatgaaagtttggtaataaaactaaatgtatgcatcgttggcaactttaaaaaattgacaagatttgaaatggcatcagtttgaaaaaccactgaattattatgctgtactgaatcctgttcaaaaaaaattatgctgtactgaatcaattggtactactgattctcttactgtataattgtacctggctacctgagcagtgatgacttctttatactactgttgtatactagtttgtacgattgctgcttctgaattaaggccgagtttaattccaaacactgaaccaaaaaacgtcacatcgaacttttctacacatataaatttttagcttttccgttaaatcgttctaattccaatcaaaattccaatttagcgtggaactaaacacaccctaactgtacggaaatactgaatcacaattactgattcactgaattaattggccgtgtggaacgcagcttggcatggcgagcgcgctggagacgctgtgcgggcaggcgttcggcgcgaagaagtaccacatgatgggggtgtacatgcagcgttcgtggatcgtgctgctggcgtgcgcggtgctgctgctgcccatgtacatctacgccgaggacgtgctgctcctgacgggtcagccgccggagctgtcggcgatggccggccgcgtctccgtctggttcatcccgctgcacctctccttcgccttcctcttcccgctgcagcgattcctgcagtgccagatgaagaacttcgccagcgccgcggcgtccggcgtcgcgctgtgcgtccacgtcgccatcagctggctcctcgtctcccgcttccggttcggcctcgtcggcatcgcgctcaccctcaacttctcgtggtgggccaccgccgccatgctcttcgcctacgtcgcctgcggcggatgcccggagacgtggaacggcctctccctcgaggcgttcgcggggtgtcatgctatggtacgtacgcgacgtgaaaccgagaacgttcaattctcgtgtgatttggtttctgtttgatttcacgtttcgtacgttttttgcagttgctgacagaatttgtgtgcttaatttgcagcttggagaactggtactacagaatcctcatcttgctgaccggtaacctcaagaacgcggctattgcggtcgacgcgctctccatctggtaagtcagtaccaagttcctgaatcaatctgacatgcgtctgattgtagctaacctttatgtcttctcgtggacagcatgacgatcaatgcatgggagctgatgattcccctggcattcttcgctggaaccgggtacgtacgcacgcactgccttcttctcagttctcactcgatttgcttacgaaactcgaatataccgaactaaagcagagcacgtgtggcggcgtacgtgtttttgttgtggtttgcagggtgcgggtggcgaacgagctgggcgccggcaacgggaagggcgcgaggttcgcgacgatcgtgtcgtcggtgacgtcgctggtgatcgggctcttcttctgggtgctcatcgtgggcctccacgacaagttcgcgctcatcttcacctccagcgacgtcgtgctcgacgccgtcgacaacctctccgtcctcctcgccttcaccatcctcctcaacagcatccagcccgttctctcaggtaaagtacacacacacctgggccgttgggccttccttttctacatgggccttcagttcccagctgaactggtcataaatgggccggtcatatacgtgcaggtgtggctgttgggtctgggtggcaatccatggtggcctacgtcaacattggcacctactacctcatcggcatccccatgggcattctcctcggatggctcttcaaacttggcgtcctggtacctatgccactatgctacttgatttctgaccagttcaagttaaaccgtgaaaatgttagccatctccggcctgaccatttctttcgtgaaacctttaatttgcagggaatttgggcgggtatgatcggcggaaccgcagtgcagacgctaattctggccatcataaccatccgctgtgactgggacaaggaggtgaacaaaacgatcaatccctccacacagcccaagaaaacgatcaaatgccgtagcgacttgaaattttgacattttttggctgtgttattttgcaggccatgatcgcaagcacacgcatggacaagtggtcgcaagtccggtgatgggagaggacgcacacgttcctgagctaatatgctcgtcaccagattctgccatacgagaggacaagatggtcgcgacgagtgagctgattaactgcataggtgaacagtggacaagacgattcttcatcacctgctcttgttggtctctagtattggcttcgttgcgtccaaatttatggtattggtcttctggctaccgaagagaatttaccatttcggctggccgagtgaagtaacgtatgtatggcaaatggtgacatgtgaagattgaatcgatcttatctaaagtgatttcaccaaccgtattccttctacaatcttcatcttggatttttaccctgcatgctcgccgtattggtggacgtagctgccctgaaaaagaaaattttcaactaccgttggtattcaagacgaattgccatgtaggacgccatcatcctactggtatctctaaggataatgtcagcatgagagttgacattgaagaacgggatagaaaggtgcatacgaacaatcgcgtgcgtacgtattctttgactggatacattctctgtcactgacattcacggagtgcatcggccggtgtatcatatcacttcttcgtttattccatttttgcaactggcaagcctagcacacagtggagcagcatttctggcaagtgaccagcataattaatcactaatcagtactaattatccccattaatctgagaggtactgttaaggatatcctaaaatgttcatgatctaccggaatattaaacctttgtacccgataaactcaaacaagaatcgacgatctagagtagtagagtacttgtttgctaatagaaaattgtgcaaggtagtttatcgttaatttgtattactacaccgctgcacaattagaacgaagcacaagaaaaaaaaagaagaggagaaaacaaaattcaaactcggtttaacgcgtcagaatcggagttctccttgctcccatcggagccggacccgctgggtgtctcgtcctgagctccggcgaccgggtgaacccttttgctgccgccgtgctcctctccggcgtcccagtccgcccggctctgcctctgccacgacaccgatcgccagagcgacgtcagccacctcggcgtcctctccacgctgtccgggtacccggcgaggctcgcggcgcgccggtgcctgcggtcggcggcgagctccttcatgacgtgctccggtagcctcagcgtgtgccggtccggcgcggcgtccatggccgactgcgtcctccggtagtgagggtaccctgctctgtcgaattcatggtcgtgcgtcgcgccgaagtcgatgacggattccggcgtgaaggtggccatcagggacgcctcgtcgagctcctccgactcttcctcctgcaccgcctcctccggcgccgtcaggtcggacggcaggcggagctctcggcggcggcgagcgacaccggtggcgccgtgaggttggcgcggcagagcgggcacgtgacggcggcggcgagccaggggtcgatgcagtccgggtggaacacgtgacagcacgccgggagcacccgtagctcgtcgctgtccgcgaactcggcgaggcacacggcgcactcgagcggccccgacttcgccgccatgcgcgccttcacgtcgccgtagaccgccgtggggaacgcctccacgacctccttgtcgaggccacgcgaggcgcgggacgcggcggcggcgccgccgacgggctgatgggacgccgtgctgcggaacgcccggcgcgggggagcgcgcgcctgggcgcagcggttgatgaggacggagaacacggtgaggaggacgaaggcggtgatgagagccacgagcacgacgacggtggtcggcgtgaacccgccggccgtggcgctccggtggtgtttgctcgtgtcgtcgttgctctgttgcgccaggcaagggcggaacgccgacaagagcagcgtcacgaggacggcgagcgcgatccggcggtgagccattgccgccgtctccggccaaggtggggtggatggatgagccgctcgccggcggccggagagggggaggtttcgagttttcttttggaaggaatggagtaacggaggtgttaactacgacgcggatggtgtaacgcgcggacgtcagggatggctgcgtggcgagtgggccccaccagtcagtgactgcggggacgagcgggcggtgccgctgactccctcactggctgttgccggtggaaatcagctggaagcatttttcgtgtcaccgtttcacgcgtgcctggattttggtcagagttccatctgaacaaacaaacaacaaacctcttggttacagaatcaacacgtcgttaatgtactaatccatatgcacaacttacatgtacggtgatcatgaatgatctgatggctccgaaaattcctagccaacaagaacttactgtgggttcagtacatcgagtagcaatgccgctgtcttttgcacgcaacgttttgtgcccccgacccatcacaaagacgacgggaaagtgcccaaaagtcgccaatatgcagcgattggacggcgcctggtgtggctgggtattcttcactttccgacctatcctgccgcccatgtcaagcatgtagcatgcactcgcgttacaatccctacatgtcagcttcgggattactgacgccatgctctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagcgccatgcttggattagggatgcatttagttaaaaaaatagattagggatgcattattatgaccagttcattctacttgtcggttctaggaacaagctttgaaactgtgtattttgtgagttttgatgactcatgtggactaacgactttgtatgtgtacgaactcaaatcttcttttttttacaacttgtacaaactgaatctaattccgatatttgcaaccaccactgaggtcgtcgccgaaagttttctttttataattttataaagcttgacgtggtcatatgaaatttgtagcagtcaacttttaaccgaacaataatgcgcagttgtttactattatgaatcatcaatcacgtggacatgtggtggttgccttggatcaattctttgtctatatgtcacgtaagttacgtacgctagatcaattagaataacctcttcgcgttgtttcgtcactgctgctgcacaattagcaaaagtaacaaataggcatgcttgtaaaaagaatgctagtcattgacattgaatccttgagttaatgtgaatatggctggcatgaatctgaaaagaaagaaaagcagacatcagttggaacaatagcgcactgaatttgttacctgttttatgggcttcataatgggctgattctgtttcagttaggcttggaaatatggaataagtacagtttgactccctgaaatgaacacggaatctaaatcgtataccttatccgcaatactagaaatcttgacctccgaactgtctaaaccgatacaatttgactcccttgatgattttggagggcggtttcactgacgtggcgcacacgtgacaatgttgacctggtcttcgtaccacgcggcattgacgtggcgcttatgtagcattaaatttttaaaaatatgcgggagccattcacacaaaaaaaaattatgggacccactgacatgtgcgtcccacatgtcatcctctatttatcctttcttcttcctccctctcctcccttctctatctctccctctttctcttcgtgcgtgtggagcggcgtctggatcggcgtcggcaacggtggcaggcgatggacggagcggcatcggcgagcgggcggccgctggagttgcggacccagaggccagatccgcccctcgcttgcttcctcctcccaatagactgcgccatggccggcgccactgcgccgccgatcgtcaccgatgacctcttcgaccatgtgcggcaagcgggtgcgagagcggcggcgctggcggcggtggcttgtcgcggtggaccacgatggtggtggtgccgtcgacggcatcgtgcagccatgcatgaggagctcaggagggaaaggcgagagagagaaagagagatgggagagaggaggaagaaaaaagggtagtgagagagaagataacatgtgggacccataattttttttgtgtgaatgacaaatgggccccgcatgtattttttaattttaatgccacaaaagcgccacatcaatgccacgtgggacgaagaccaagacaacactgccacgtgtgcgtcacgttagtgaaaccgtcctacaaaaccactaagggagtcaaattataccggttttgacagtttgtgggtctggtactgcggatgagggatacaatttagttttccgtgttcatttcagggagttatagtgaacttattcctggaaatatcgagtgtccggcctgctttataccatcaggttacagaagtaggagaagtttagcagtaatgggcctctgtattgactggcgcaaatatttagatgaagtaaaggcccacgcattctgtgcacattatgacaactccttcggcctgagcataaaaactgttaacaaaagaacagggaataacctattttttgccaagtttttttttctaaaaaaactatttggcctccctcatattttgctcttgattgaatcgtcttcctcatcttagcaaaccgttgcaaatcgacttttttgatgtttaggaagtggtttttaacgatgtgacacgttgaccatcgttgacccgctaagtaagcatgtagacccgcacgtctaggactctcaagtctcatctctccttttttttcatctctccctgagggcggtagggaaagtattctatcccatccgctgccttgcttctccttcatagcagcttgggttgctccgtcaccgatctgctgccatcacagtagctcatagccagattgtcggtgacctcggcctgggccctcgggcgtagggacgatgcgggatagaggatttgtgccaccagccttaggggatagatggaaaagaaaaaagagaaaggaaggatagatagaagagtcgctaacatgtaggtcctacttgctggttcagtgaaaagccagttcctaaactactgaaggagttagtttacaccggtttttgaagatgacaaatgcgttatacccgattttgtagttaagatagatgattaaaatgggtgcaagagatagaagcaaaatagatttattccaaataacaattattccattatctaaaaaaattccaaataacagtagggatattgccgcgtgtgagttgtgacagccatatttaactgctaggtggaaaccaatcgctgctaataaatctgatcaagctgatgcttactatgcagagttcaccgggcaaatgggcctaaacttgtaacgccatcacgccgtgtacctccttgaatgcctagcatttctaaccggagaacaagccgctgcgttccaaattgtgtccaatgatcaagttcgtttctgactttatagtgatagagatcttgatgcatgtatatatgaaacatagtggaacacgccacgaaatgccgattggtttcgtgccataacagaataaccttactgcgagaaaccacgaatatgcagtgtaaatgcgtttcacgagtccactgcacataagcactttcgcagaacacaagaaaggatcaccacggtcgcgctgtgtatgagagcaatatccctgcacgaatcatgtatgtatgtgcgacctactagttgcattgcgtgcatagccatggaccatgatgggatcgatcacagttcacacagagctcagctagccatgccgggacgaacaatcatcgaacgacgcggctctgtcgtgtcctaggtagcacaagtggtgtgatataaggccaatgcctgatgtttgaagcgacgggcacgacgacctgcgtactcctacgtcgtacagattatgacacgaatcattccaaggtggaaactgacccgaaacgttggtgcgttccttgtgtcttttttactactccattgcacccatcgcatgattgacgacggcgaccacgacatacgatcgatcgatcgcttgcatgacgcgacgtaccggtcggcgcctcacacacacacacaccggctcgatcgcgttcattattcaattcagtaaccctcatgattcggctggctcgaataacctgacgctgccagtgccacgctgcataacctgcaactcgatctgcatctggctccatatcggtgtggaagttgtagcggacacttctccgtccagaccagagggtccttaattgacaccggccacgcatccactctcctgtagtagtctgtagaccgatccaaaaccaagtttccgatcgatgctctgcgcccggcacgctgggccgcgcgcgcaggagctgaggcgcagctgcaaaccgcggacacgaaacaggaggtcgggaaagtggtattcgcggcgtaatatagcccatggcatgtgcggaagccgcccgcagcagcaggacgatgcgatgagccaagccgccgtataaaaccgcgcgatcccgcgtgtcgtgtgatgaggcgcgcgcctaggcatagcgaccgaccacgcacacgcccacgcacacgcccgcgcggccgcagagaggccaggccccaaggccgcgtacgtaggggcccccgcgtgcgcgtggcagcgcgaggacgtgttgtgcggtaaccaaattacggtcgatgccggagagcgattcgtttctcgcgcgagtcgcgagtcgcgagcaggtttcacttatcgcacgataatcacgcgattatcgcggttatcgtgcttattgtggggtacggtaggagaaatcgacgatatggtttggatgaattttgactaaatttaaaatcccggaaaaaataaaaaaaattgaaaaaaattaaaaaaaaaatcatgtaagtagttcttgatttgtaattatcaatggtgaagaatttttttgaacagagtaagctatattcaaatttgagggcaaaccgagaatagtttacaaattggaaaaggaaagagaatattgggccttaagtatcctacatattcttccaattattctcaatttctagttttctacatatattcaaccgtattttttatttttttcccctatttattttgcatttatatgatttcagttacatagcccgcgataaccgtgcgaataccgcagttatcgcggtaaaccgtgcgattatcgtggtgaaaccgcgaaaccaccgagttttgagttcgaatttttggatgtgatttttgtgcgattttagacgattatcacgcgattatcgtggttatcgcactaccgcggggtggtggtaatctcggcccaaacgataaggtaaaccctggtcgccagtgctccactgctccttgtacggcggggtcagcggaactctgtgggcgtcactgttcgtcacgttggctagattccggcagagaggcagggtccttttgctctgccattttgtgaccggtgtgtgtccgaacgctgcacgaaattacacatcagaaagagtagtatatctgtgactctgttgtgacgacgcgagtatctgacgaccacgtacgtactccgtacacgaaccgagctttaaatcacagccgtcgagatttgcacaaggcataaaaaaaaacacgggctcgccagtagaaaaataccactgcccggtcaattggcgccatgctgacataacggagactgtaccatgcattgccagccacacattggaggtagcaggagacaaacatgcgcacacacatgcatgatcgaacactattggttctattttagtaccatactttacaaggttcgaagtgttaggagcttgactaggggtaagaataagatagattccctgatgtaccaactcaatcctccatggccaagacaaattctctagtagcatttggttttatgcatgcctgcaggccgagctatagattatggtatgattcccgtgccgacatcggttgcagttaacaaaccaatcttctgtagttagatggccttaataatctgctacttctgctatatctactggattatcatttagtgaactagcttagttagcttgtctgttgcatgacttctaattagatgattcagatttggttgcttagctgcagctggcctgtgatggcagcattcccagcctatagcactgcctgatccaagcgagaagagtcgtattaacatcttacagcctcttcattgtcaccgtaaacaacagaatgcatgcagacccaccagtagattaatttatgtccagttatattttttaaataaggtgagaggatgtgtaacatactacatgaatggttgaggattgttcacttgttctaccaaccactttgtgacactatcttggtcagtttgttgtatgtatatttgtactttgtaactgggcataccttttcaagaatccggtgtcgatcttggaatttggcacaacactatgcccggggtcctccgggcgaaagctataggaagaatctttgaaatgtgcaagtacatcgaaagcatttacctgaccaagtgaccaagttgcaaataaacttaagtctctgaacgaaaaaggttgcaattaacaaacttgctagggacttcccaaaggaagcgttgcaaaatccatttattttaagggcagagaggaccccgggagtacgtaggacgctgacccgagacggcagcggttagcaatgcttccaaacttcgcaattcacacttgcaaaaaagaccatcaccaaaccaaatcctcggttacctacttgtccgtccaaattaatcccccacaccggatctctccaagatttgcactgattaacaatattgttcgagcatgtcgtcgtgctgcgtctggtaatgcggcgcatactgcagcaggtatatggttttcttcctcacctttgaactggagaaatgatgctatatgtcaagagagctcagctaacacagctgttttgcctttgtttcgagagaacggtatggtttggtgcataatagggcatgggcagaatggaacaagattgccgaggattacgttaaggatatagtattaattagcgcctacctataacgtaggagctgcacgaccgaattgacattttgtacatgctaaacaacaaactaggtgtcgcacgatttctggaacattgcatgaacaattagatacacaaaaaagatttgggtatatcttcgtttcattagataattggcaatagttaagtatatctgagatcgtttgtgtaaagataagaattcgtaaaaccatgtgtgtgcatagaggttttacgtacaggttcgtgcctcccgcaagataatatccatatattttgtttgtatgcatatacctaaactatatccagattatatgaagtacaatgtgtatatagaaaactctaatctagatctagccgatcataacttttacggtataatatactagtaccggtatatactagcagtataaattaataaaggcaatgttgaaaatttgatagaaaattttatacgataatttttgtaatttgcggttcagatttaatctaattgtaaatgcccagtcctagttctctcgtgtattaatataaccatatgaaagtattttgtgacaactgtattaattaattctattttcacatattacatccttgagatgcacttgataatttactaatcattatattaataaattattattttaccactcataaaactggtgtataataccggataatcactcttccagattttgtctatggactactatacacatcagaaaattttgagaagatatagtatgtcaagtcgagtagtacgatggtggtttgtttaattttagcaccatttatttgatatgttatcgtatagtagtaacactcgatcggtcagaaatggcttcattctagatgactatgtgaaatataattttgtactacagccacttggacgctctgatttattgacacggattcgtatcttttcaccaatcataatttctagttttatactacgtaaaaggagaccattgatgttacgttcagaaccaaagacgaccaggtaaattacgcgtaggaatgttcttatcaccagctgtagtatgagattttatccgagaaatgttaagctgtcactgaataacattttgggtctttatcctactctgaaactctgatagacataggagagtgcttgccagttattgctagccagccagctttatcagcattggcagcaatcaaattcatgcaaaaagaacaaagcattggcgtcatatagtttcatcaaggaaaactgaagcaaaagaaaatgcctggttgccgtacggttgcgtcattgtaagcatttcagtctcgatctgagcagattctcccggggaaagcatccaggctaagctttcagcatctccagggcacaccacgtacccgagagataatggagttcttttagcatcgccacaactgcatccagaaactgatgtgaattgaacaaattgttttaggtacttataattaagaaaggtctcattacattccaagcgtgacacagcagaaataataatgcttcagtgcagtatacctgaagaacagaacaaaatgctttcttcaggccaatccggtgttctgcccctggtttgaactagcttccggcaatatatttggagagcggtttcagttctttcatgggcttgatctaacgtgtccatgaggtcaataatttacaaattgcaagggaacatttgttcttattctccagcatctgtgataaacagtctaaagtacttgtcgtcgtccatagactgatcaactatgtgattagtatatgcactgccaactgttctttttcaatcttgttggggattccaatggaacctgtgtgccgtacgtctttctactgtcttttggaaacaggttaacacgttcttcctggaaaaacaaaaatactacttacagagaagtacgtgttactgaatttttatatgcaaaacacccgtcccaaaaagatgccaacggttgttcagctttgtgcatgaaactgtggcataccacagaggttatggtcctcaagttctccctgcctagctgccgttagacaaaagttagaaacgaacagatcgaaaatgataccgaataagaaaaactttgtgcatgaatgcatctttcgctttcgtttttactgttgctgatgcggctatttttgttggggttagacatgatggggcgcaagttgagccatgctttggcgaacaccatcacgaactgtgcctagatcgatgaatgtgagctccctagcgtacgtggcatggaccccaacacttcaacgagagtatatctgtacatcacaagcgtacatagaagttgaaacttatcgtgccgaatcctcatcctcacggctaactatctagtcataatgtctcatctttcagtacaaccctgataataatatatgattattaggaaaatgtctatactatcggttagaatacgtaatacgtgttgaatatactaattatatttagttacagttggagtacttgaagttagaatatgtgataggggtaaatgtgaatagtacgatcctgagtcatatatttgttatttttgttccccttatataggttgaatttaaacctatatgtttaaggtgtgacatgtcgcatatgatctatcatactccctctgtttcaaattataagtcgttttgttaaagtcaaattgctttaagtttgactaagttttttaaaaaaagtaacaacattttctacccaacacaaatatattatgaaaatatattcaattatagatttaacaaaactaatttagtgttgtaaacattaatatatttatctaaaaatttggtttaatttgaagtaatttgactttgacttaaatcaaaacgatttataatctaaaatggagggagtattaaatttaatgtgccaagatttagcattagtgccttaatctttgttacgttgtgtaatttcctacgtcggactcaggatgatcccatctcacagattttatgcgccaatcagctgtaaaataatcacactacacaaatttgtactacttgtagtacacctaaacatattcctttagagaagtgacatatcatagccgattctttgcaaactcagtgaagcttctttccaaggaaagcgacgggtgatacagacaagtagacatacttgtacaagagggtaatcgtaaatttgatgccgattgaaacatacaagacagtagatcaagccagatcacctttgtaggcggatgaaagccacatgcatgcaaacactgtagtgaaagacgatcacaagcagaattctccaattacgagtccaacaatcaagcagaaatgtacgaaatatatgtgaacagtaaaaatcaacggacgcagtgagtaatcagaaaattcagatcgactcatggctgcacaagatgacctgtacgtgtcgcttgtttgccacgccccctccgatcaccgtgcagcgcagaatgccagaatctctcgatctgagcaaccggcccgccgttccaattcgcgcctgtgcgacgtacgcctctcccgaccgggtgcgcgcgccgcgccgcgcgttcttcgccaagttgccacccctcttgcaggccgcgttaccgcatcaaacaagccgcgccacccgatcgatcgcccgcgcgcccgcgtgccgagccccgtccccacggctccgcagcaagcaagcagatcgcgccccgcccgcgtgcgtgcccgtgcccccgcgcgcgcgcgtcatcttgctttgcttccgctctccgtgtaaatcattgcgttttcccttcccgtccccctcgcgcaaaaggccgcctcgcccctcgcgcgtagcgtacgtggcccccctccccccgcgcgcaatgcatgcgtgcaccactgcaacttgccccgcaccgcgcgcgcgcgcgcctctctcggccacacacctcgcgcgtccccttataaaaacggcggcgcccctcgcgtcgctgggcaactcactctttaattcgcctccccctgaatcgtgtgcgtatcgtatcgtggcgtcgtcagttcgcgaaaaaaaacgcccgttcgttttgccgggtgcgtgcaggatggcgttagaggccgtggtgtttccgcagggccatttcggctacgggtgcggaagggactcgccggcgtacgggatgccgtggtgcgacgtcctggctgctgccggcggcggcggcggcttcggtgagttttacggagtggacgagtgggatgaccagctgcaggtcgcctccgtggatgagtgggaggtggcatccaaggataactcggatgcttccacggagggcaaggcggcggcggcggagcgggcggagccggtggccgccgggaggaggaaacggaggcggacgaaggtcgtcaagaacaaggaggagatcgagtgccagcggatgacccacattgccgtcgagcgcaaccgccgccgccagatgaacgagtacctcgccgtgctccgctccctcatgccggcgtcctactcgcagagggtacaacactaactacgcatgcttcaattaatcgcttttacgcatactgttatgattcgttaatcatcattaaatcgaatccattttctgctcagggtgatcaagcatcgatcgtcggaggagcaatcaactacgtgaaggagctggagcagctactgcagtcgctggaagtccaaaagagcctcaagaaccgcagcggcgccatggacgccgccggcgattcccctttcgccggcttcttcagcttcccacagtactccacgtcgcctcgcactggctgcagcgccgccgccagcgccgggagctccggcagtgcgagcagcgtcgtcatggacgacacggcgggctccgcggagagcggccggcagtcggcggccatcgccgacatcgaggtgaccatggtggaagggcacgcgagcctcaaggtgctcgcgcggcggcgaccgaagcagctgctgaagctggtcgtcgggctgcagcagctgcgcatcccgccgctgcatctcaacgtgaccaccgtcgacgccatggtcctctactccttcagcctcaaggtaaaaaccaatcgacaatttgcacctattttactaccacgactgcatgcttagttagtttaggctagcagcacagacaaattaagcgattggaacgtcgcgggtgagcgaagattcgctcccatttttctacaacgccgatgataatgtcatcgctttcgtttggatgttaggtggaggatgattccaagctgggctctgtggaagacattgccaccgctgtgcatcagatcctgggcagcattcagcagcaggaggccgtcctctccatcagctgacgccgcgatcgatggagacgacaaccgagacggccgccatgtgaagcctctgcctcgtccgtcctggaaatggaaccatggcgcctcgatcgatagcttgttagcttgtaatgtgtgaatgtgattgtaccctagccaacagagtgctgcatgcatgcagtatctccggcgaccttaatgagaaatctataccaacattttgagctcttgtaaacgtacgtacgatgaccacttttgtcttgatggaggtgttgtgcactagtacctcttgcttaactgctaccttcttttttaaaatatattacgtcattgattttttaacaaatatttgattacttgtctttttttacaaatataaaaaatctaagttatggttaaagaatatttgatgattataaatcaagtcacaataaaataaatgataattatatatatatttttaaataagacgaatggttaaacgtattttaaaaaatcaatgacgttatatattaaaaaagggagtactacttgccatttgcataaaaggagggtgactctaaaaccttacgccttctttgaaatggagggacttcaagggtttttcataggctatacactaatgatatatcgaaatttttgtgttctgaaggagcccttgggcgatggtgttcttaactgatgagggtaaaaccattaacacataattaattgagttttaattattataaataaaaaaataggtttatttgatattttaaagtaactattatatagaaagttttaacacaaaacgtctcgtttaacggttttgaaaatcatgctaacaaaaactaaggtagaatctagatcttaattagaaacgaaaatatcatgaaaatagttatgagaaatccagaaggcaaaattgacagcattagtgcaatacctaaagtcatgaattttcaagtgtaaatctgaatctactcattcacaaaaggggaaaaaatcacatacgctaccaatagccgattgctttattcaacgtatagattgattttggatttaatttctttgagatatatcacgtacatttttttctaagtttcttgaaactaattggttacaaatcttgaactgtcctttatgatgtaccaagagatactatattttctagcgtagaggtactataaaataacatcgaaaattgtgataactcttgataaaaaaagaaccgtgcaatcactcatttgattagcatttgaggtatacggctttgtgtcctaaaaagacctgtggcccatttgcatgcatccatctctgtttcggttcacatgaactctgctttctctgctttagagtgcatctgtcaggagctatatatgactggtcgaacagcgtggcatccatgcagtgcagaggccgaatgattgcccgatgatgtgatgagctgcttcttttctcgtgataaacagtaaataatcctcatgtgtgtttggttctgcggtttggtcgcaggagtacataatgctcttcagacaatcttgctctcagggtgcactagcctacagagacaacatgagtgatctgcggcagagactagagattccattgacccgaaggacataagttctgttactaccgtataatctaggactccatgaattcttgatgtccaatgggcgtttgatcggacttgttactaactggctgttcccatgtacgtggatttcagaaaaagaatgaaccattttttcttcctctcgtaatacttgagtaagtttcagactgtcagtgagcctcctattatgcaccccacgtttctcctcacaatataagtactgctacgtactctctccgtcccacgtaatgtaaatgtaaaatgaaataagacacatcctaatactaattaactaatactatgaacctggataaatatctatccaaatttgtttttagatagagggagtacatcttatttctccggtacaccaatcggacaaaattctgagcaaaattcttcgactggtaattcatatcaaccttctattgacgatatagatctaccgaaatatactgtctattaacaatgcaatgactggttctgctcaagtacgttggaaaactcggatgcagtatattcagagtagcttcaataaggcactcgagaaggatgaggattaagtagtcgtatacaaacttgactgcgaggtgctagctgtacgtggccacgtcagtgtcgtgtgtaagctgttgagaaagatgaggattaagccgtgcgatgccccgttttagccagcaggtcgttgccggaacctggggcctaacagctgatgggagtactcagacaagtggcccggcagcttaccgatgattggctttgtagtttgtgtagatcagctcttgcgcacctgtacaactatgtcttgatctagccaagtagcagcaaaacggcatcaagctgttcaagcacaggtgcactgcatcacacggccaagttgtggttgtttccacatcagattagtaagcagctcactttcaccgcggagaagcgaggccaggaaacaatttgattcacctggaaattaaactttccagctattttcacatcacagtaatacagtgtaccggctagcttaattggcacccacaacttgtgagaactttcgtgctgagctgatgcatcgatgccttgaaagctaaccctgctttgtttctatcgatcagtctgaaggggaggaggttccttgcgaacattatatgtgctccccccgtcaagcaaattgctgggatggagtggaagaagtggctggcaaaattccaaattttacactgtgctataatgacggcatgtgaaccatctggagtagacaagttgattgattgattgtgtgcgtcagtgttcttaaaaaagaaaaaaaaaagaatgaatgatttcgcttgttaaggggagcaaatcttttgcgtatactaagagttggaagtttacgttttgactacatttattctacgatgatagttaccatatttgagaacgaagggtgtattgttcaggtaatattccatgcatcagcgctaatttgctgatattgacatgttgcaagttactcgtatgtcaaacctcaaaccaaaccaaaagaaaaaaataaataaaaagtgaaacaagcggtttacttctaggcctggattgaacttgaattggatcttccgtcctggcccatacaaactcctcgtgttctaccctcatcttttcccggcccagtactacttagttgggcctctttaaactcaaacgaactttagactgtccacactcaaccacccgtttcccccaactctctcttcttgacgcagtgacgttctcagactctctcagtgtctcacacggcaccatctcgtctggtgttcaacttgcagcgtttccgtatagcgagccatccaaatttggttaaggtaattagtgtaccgtattttctaggcaaaatttgctattggacactgaaagattgcggtttttactgtgagacacccgaagatcatgtatttgctcgtggacactgtaaaaaagtgataattagctgctgaacactcctcacattattttattatttccggttaaaatgaagagagagagttgtgtaagtaccaaaatacccacttacacttcctctcacttcttttcttttcccttcttcttcttcttctttggggcgacgacggctggcctgagccgggacggctgggccacggccgggcggcggcggcggtgcatcgccgggggcggcggcggcgcatcaccgggacggctgggccacggcggggcggtggtggcggcgcatcgctaggacggctgggcggcggcggcggcgggcttgacttcttcgcatcgcgctcccacgccgctcgcctcgtcgacctcgtcacctcgccgtggcccgcccgcgtcgtcgccgcctcgtcgtcctcgctggcacaccttcgccgtggagctctgcccggtgtgccgcgacagagaaagagaggaactgaggaagagatgaacagagagaaagagacgaagaagaacaacagagaaagagagattgacaagtgggcccacgggcaaatttgtctttaaacaaagtttaataggagtagtgtccagcagctaattaacacccttttaagtgttcataaacaaatacacgattttcgagtgtctcacagcaaaaaccgcaatctttcgatgttctgtagcaaattttgcctattttctaacggtgcctacggattttatccaactttacatgaaagaaaaagcgcgttcaagatttagactgagtttagttccaaaatttttctttaaacttccaacattttcatcacattaaacttacaattttagcgtgaagtaaacacacccttactacgcatatcattttaatttcaactaaacttataattttagcgtgaagtaaacacacccttactaggcatatgcaacaaagccgcttcacgtgcattctgaacaagcgaaagctgttgtctcactcacatgtcacggcatcggacatcggtaaagcaaagggaaaaaaagctagggctgcaggaatt

SEQ ID NO: 75091 - DNA, 9868 bp, Oryza sativa
tccccctagccacctcagcatcgccccgccacgtcggcggtgggacggcgccaaagaggctggcgccgtcctattgaacgacggcgccagccactctggcgcctcaaaaaggaccatttttgggataagtttttctagagatctacttgcgaaataagtttttcaaaaggaccaaaatatgaaaaatccagtatatttgtcgcatacttaattagccacggttatatatataacgaaaggatttttcaaactatgttatactgataagtgaagcgctagttttgcatgtgtgggagatgctatatatacagatacatgtcaatacattaactaaagtagatatagaatacataatctgtagtacttaaacataagttctacggctctattgtatactttaatttagacgtggtcaaaattaaatttacctaagctatatgttatctgaaaaatcaatttttatcacgcgcatttagacaggtgtgtacccaactagaaatgggtatttttccaaaatatgcatttcagtgggtatatgcacgtactcaaatcttgatttcctggaaccatgaggtcccaattcatcttccttgcctaatttattagtttgtactctacaatatattatacctagtttaatagtatatatatatatatgtgtctatatatatatatagtgaatctattctacacccccctcccatgggccaatcccacctccccacccttcctagggcccaaatcccctctcccatatcagtcaaaggctggtcaaaaccccctcccgccggtcagacctcggtcaaacccgcccattgactccctcccccgcccaccacttcgttgttcacgtctcgcaggaattccgcagtaacataacggtcattgtgcagtaacatgacaactttcttgcagtaacaacatcgaaaaatagtcatgatggatacatttttttatgaacatcatggtgcagaccgattagaaaaattctatataacgtgggagatattgctctctaaagattgagatttactttttttaagttctcgtctctttagaacggcgtagtaacgcgatgatcaatgtgcagtaacacaactactttccgtagtaacaacgttataaaagcattattgtctcgatcatcgtgtagtaacaggattattgtctcgttgtaacattgttttaaagaattatggtgaaaacagttctaaaaaataatatgtgatgtgagagatattattgtttaaagattagaattctaaaagtttacttgtactaagcttgctactatgtatctttgtatggacaaagagaagtattttttagcacttgtgttttgcacaagattgagatttaaaaatttagctatgcacaagcagtggtactgtagtagtacctttactatcatatgttctctattactgtaatttcatcatgatgttactgcaaaacgtgcagtaacgacctataaatttcatagtaacgacttatacatttcgcagtaacgtaccatgttaagcacttctgcgataatgctagttccaaattaaagtaagaagcttcgatttctatagtaaatataactgattcgaacaaacatataaagcaaacaaacgataacctgtaatcacttagtgtcataaggtgaattggttaggggagttttccgtgaaccatgagatcatggtttcaagttttaaattctcttaatttatttttcttttttttagaaaaaagaaaccggatggagagattaggaggaggagccgggaagaggagggagagaaaaaaaagaaaaaaaatgaggagggagattgggaggagtagccggaagagaagggagaaaaaaaagagtagcaccgagagagagaaaaaagggggagggaggcgtgcgcggggtcaccaggagggagggaggcgcgcgcggggaggaggcagggaggcccgtggggagggaaggaggtgtgggctaggctggactggtagggagggggtgtagaatagttattctaagggaggggtatataatagagctactatatatataggcaacatatcctatgtacacaggccctcacgtgtacacacgtacacaccaactaaaaaatgtcaccaaaaaatctagaaaaaatcatacacatactttcaattgtattacacctagggttaaaatcttaacgtcaaattcattatattttagccgtaacaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaattgtttgtgataatttttagttggtgtacacggtgtatatacgcgagggcctgtgtgcataggatacgctcccatatatatatatatatatgtcgacgggggataccctagaccagatatagagggtattggggtccgttggaacgaggatctacgtagtacgacatcaagcaaacagaaagcaaggattatactggttcaggccccttgataggtaatagccctaatccagttggtatgggattatataatggaaatcacaaattataaagggaataacaaaacttgatggtaccgacgagaccgtagtcaaattggttcgactagatctcccggcgacttggctcctgtgcgctccgacttcgtaggctgtggtgaatgtgttcgcggtgagattcgatgccctaggtcctgcccagggggtccattttatactaggggtcagttgatctccaagtaggactcggagatatcggacctctcacgatatggtaaagacccggtcttgcccgagtaggactccttacatccgtggattctatttctattacatgatagatttcctaaacgtataccagaactatccgtatacgcatgggtataccatatcagtactcatcgtacgtccaaggatagagggtataccttatccgtaaccttgacagtagcccctgacttctgcttaaatgaactcatgtaatcgatcggaacttctgatgtcggaatcgttgtcattctcatctggtcgatcccggcatgagaaccgtagaggcaaagagtcatcgacaacgtcgcatgaagttcaacagttatgagtgaatttaaattgaagtatgaaaactaccgcgcgcaatggacccagaattttccggcggcaatctctctcctttcctcggaatacgcaccgtcggtagtgcacttatttaaagggattttggaaacccatttgaagtccgttcaccaaaaaactcttcagccttctagcgcccttcgtcttctccgctctccgcaaagaaaaccctagcttgcttcttccctcttgttctccggcgatcctccggcggcgatggatcttgacaagtccacctcaaccaccgcgtccatgaagaagttgcaggacgacggtgccctccctggtcgcgggaccatgtagagggagacaggaggtattaaacccgaacccgtcttgggccgcatggttgtggtcgaagattacatttcttgcggttttcttcctctgccttccgagtttcttcttattgtcttgaacttctatggtctttctttgcttcacttgaacccgaattccatcgcatttcttagcatctttgctcatctttgtgaggcctacattggggtagagcccttccttgatctcttccgcttttactacaagttgcgttggatggaacccaacagggtatccggatgcgttggattccgacttcgggatcgcctgaagtcacgttacatacccttccaatgcccctcttctcgtagcaagtggcaggcgagatggttttatcttcagatagaaaattcagaccccgtccttgttgttcctgaagaacagccagacaaaatcccagagtggaccgccaaacccgccctaactccctccctccagtctttcatcgacatcatcgatgacctctgaaaacgggggttgtcggggtacgaagtcgctgccgactttgtaggtaggcggatccaaccgctgcaggctcgcgcccatccggcctttgattactctgggccagaagacatgacccgggtttctcctcggggtattttttcttgtatttcaaactttactccgagtgcgtctgtttctcctgacttatcgagttcttgttctcgatttataggtctggacagtgacaccgtgggacgccgcgtcggccaggtgatgattagtgccccctcagaggcgagcgacatcccgatccccctttgcgagaggggcccggccgaacgcactgctgcgatcaatgtgagtgtactcaatgactcctttacatctttctcctcgagatcgcgtcgtgatttcacgttatgtaggctctccctctgacggacgtcatcggaccgctcgtggatcatcaggcggcggcgtcattgaaggagggcgtcgccaaggaggcgtccgatgttgctgctgctgccgctgctaccacgagtggcagcaacattccgaagaaggggagtaaattctcctctgtactcgggacccatcggaaagcgccaaacccggcggtaagcctctctcttgttttttaacgcgtagtcggaataacttgacctgacaccatctcatcttacttaggactcagacgcgtctcctctggctcatcgaaggcaaaggcttgtgacgatcggcgagaagtaagtagacgtttttgaagtcttttcattcacggagtcttgatcgcttagctttatgaaagagaggaaaatcttcgtaggacggcgcgggcgaaggcgacgcaaggtgggaccgatgctgcctccagcgcgtcccctgcggcgacctcgacagatgtcgtggtcgctactaaggaccgggaggcggcaccgagtaaccccatcatcagcctcatgcctactcggggcccatccaccgatgacctcacctggggggagctccaagtggagatggagcatatcctccaggccggcgctcgcggcgtaggtcgtgagattgaggaggccagggtggtggcgtcgtcggcaaaccagcgtgccgaccaactggctcgcgacctggcggaggcccgcgagaacctcctaaagatgagggagctggtggtcggcaacgagaggcagcggcaaggacttgagcaccggatgtcggagctcgagaacaacctgtcaaggatccgaggctcgctgcggatatcgcacaccggcctgcaccaactcgccggcgagtgtggtgtcacgactaccatcccggcgaaccctgacgagttctcgctgacgtcctcactcgcggaactggctacggcgatggaggagatcacctccaagcatgcggccaggattggggaggagacgtccaataggatctacaccggggcgtgccatgtcctcgcatgcgtgaggctggcacaccctgatctagaccttaagaaggctttggatcagggggccgccgatgacgcgcgcaagggtgtggtggaggaagtcgatgacttgggggagtccgtcctccccctttttgaagagtaagatatttgttttcccctatacccttaatcctcatgctgtaaaacctttgttggatgcaaactgctcttatctgaacagtcgtttccctcgttttcttagcatgtgattccgagtactttgttgtcgttgtagagatatcgatattgaggatgtccagcagcgcgggcagcctaatatgccggtggtcgttccggcgcttgcactcgagccgtttgtgccgcgggaagaggtcagtcaaagcccgtccgcggaggcgaatatggcgatgacgtccctaggtttgcgtcttagtctctttcactccttgtattcggattgacttaattagctgtgtcctcgaaagagaagagtagcttgacttagtctttttcgtcccaggcagattttgagaacacgatggctgaccgagtttgtcgaatccaatattggaggacgaagctcgagatggccaaactcgaaaacaccatgatcgaggtgaagaaggatcaggctgtggaaactcttcgaggtcgcgaggtatggttcaactcgtacctcaagagctgctgtacggcgatggcgagggtctgcaaggagctccgagttcctcgcagagatctcgaggagtcggcagccggatatatctcatggttgaatggggcttgtgcacagctcgaagggatcggcaaacgtatcgacgaggccctaaagcaggagtgtcgtcgatcgagccagtacaccagaggacatgtgctggcctgcatccgagatcaccgcccgcagcagcacctcgagttccttcacgaagggttctcacgttctcggaggactcccacggagattgatggtcttgagcagtcgatggcgccgcttaccgagaaggtatttcggtccgtggattggcgttggccgtcctggtagtttttgtatcctgtaaaaaatatctcaaagaaacatgtaatatattttggagtatctatgacttgcaagaaacacttgtgaaatagaaaaggaatctatctaactaagttttcttactctgggtatgttgtgtatgagcgttttctcactttgcgacttcgatcagtcacttgagccatacactcttcctagcccctagccttgtcgtcggagaattattctcagaggataaggctcttggactcttgacttgccttggttgaaaaagcgctgaccctagcccccagccgtgaagttggaaaactcaatttccgattacacggcttggttaatacgcacggcgagaactcttacatgaccagaacttacatggtcgtttgtctctacatgatccgacaaggccttatccgctctaggcgtccccagccgaagttcccttaggttcctcagaggccttgtcaggatggcgtaaagggacatgaggataggtttcaactctaggtgtcgtcgtggtaagggatcgccgggaaggaacacttagactgtagtctttacctgaaatcaatctttattgaaatcgtaagatgtcttacaagtatggatactattgatttatacataaaattttcgtaattgatcaatgttccatgaatttgctaactcgcgaccatcgttgtctgcaatcttgaatgcacctggccgcaagaattgcgtgatcgtgtatggtccttcccacttgggtgagagcttgttacgccctgcttggctttgaacccgtcggaggacgtaatcgtcgatcaaaagtgtgcgtgctctgatgcgcttctcatggtatcggcgaagggcctgctggtagctggctgctctgacaacaactctttctcgatgttcctcgagtagattcacatcgtcacttcgctgcttctcctgttcctcgtcagagtacttctgtactcgtgtgctctgatgccgtagctccgtggggagcatagcctatgagccatacacgaggaagaagggtgtctccttattgaacgttgtcggtgtggtgcgcacggcccatagatcagaggggagttcttcgacccacttcttgtcgtgtgacatgaatctgtcgtagactcgggtcttgatcccttgtagtactatgctgtttgcccttttgacctgtccattgctctgagggtgagaaaccgaggcaaaacaaatcttgactcccaatccaatgcagtaatcctggaagtcggcattgatgaactgggagccattgtctattatgatgcggtgaggcaatctgtatctgcagaatatcctttgataaacttgatggcgtcgtcagccttgatttcccccgtgggcatcgcttcaatccacttggtgaacttgtcgatcgccacgaaaaggaacttgtagccgccctgtcctcgtgggaatggtccgagtatgtcgagcccccaacacaagaacggccatgtaagagggatagtctggagcgcttgtgccggtagtcttgtgtgtttgctatgaaattgaaaggcttcacaccgctgaaccatgtcgcaagcgtctttacgcgcggttggccagaaaaaaccttgtcggaaagcttttcctaccaacgtccgaccggcggcgtgtgacccgcacatccctttatgtatgttgaggaggagatgtttgccgtcatcgaacgagatgcatttgagaagtaccccttttggcacctttttgtacagatcgttgccgatcatacaatagatcttggcttgtcgggttattttctcggcctctgcatcgtcctcgggcaactcgtcggtactcaggaacttgatgagcggggtccgccagtcctctgtggtctcgatgtcggcaatgacgtgttctgcccctatagcccccgagctaatgtcggggacaactgtgctatcttcgtcatttgctttttcactgatggctttgtcaagacgtccagaaaagtaccaggttcgagtggctctcgtctagacgcacgccgtgctaggtcgtttggttcaatgttgtccttgcgatatacgtgccggacctcgatcccatcaaaccttttctctagcttcctgacttctgcgaggtacttggataactcggggctagagcacttgtagtctttgtgcacctggttcgcgactagttctgaatcccctttcacgattaatcgcttgactcctagtgcggctgctgctcttatcccgatgagtagtccttcgtactcggctgtgttgttggtcgccctgaagttgaggtgaattgcatgcttgaactgatctcccgaaggtgatgtcaagatgaaccctgtccctgctccttggctattgaatgcgccatcgaacgccattgtccatgtctcgctgtcggtctgactgtctgacctgttgtcgagcatagtccagtcagctacgaaatcggcgaggacctgggacttaatagttgttcgtggcacaaagtgaacgtcaaattggcttagctcgactacccattttgcaatgcagccgacgacgtctctgtttctcacgacttctccgagggggaaggaggaaacaactgtgactctgtgggcttggaagtagtggcgtagctttcttgatgtcatgattactgcataaagcagcttttgaatctgtgagtatcttgtctttgcgtcgtggagagcttcgctgacatagtaaactggtctttgcaccttctctctcttgacaacaatgacggtactcacagaatatggtgtggcgacaatatagaggaataattcttcattaggttggggagcaacaagtacagggggatttgacaggtagcatttgagcgcgatgaacacgtcttcggcttcctgtgtccacacaaatttgtcttgtttcttcagcagagcgaagaaaggttgtcctcgctctcccatcctagcgacgaatctgctcagtgccgccatgcatccagttagcttctggacttccttgagtcttgtgggcgactttatgttctcgattgccttgatcttctcgggatttgcttcgatccctcttccggagacgaggaatccgaggagcttgcccgatggtcctccgaacatgcacttctccgggttgagcatgaggcgatattgtcagaggttgtcgaacgtttcctggaggtcatcaatcaatgagtcgcttgtctttgtcttcacaacaatgtcgtcaacgtaggcctcgacattgtgtccaagttggtcattaagtgccccttggaccgtgcgctggaaggtatttcccgcggttatcagccccaaacggcattttgatgtagcagaatacaccgaatggcatgatgaatgttgtcttctcctcgtcctcttttaccatgctgat

SEQ ID NO: 75092 - DNA, 3954 bp, Oryza sativa
gtggcaactagcaatgaccctgttctaaaaaatataaaaaaataaatagcaatgactctgtccctagcgagattttttttaattttttattaaaatatttacagaaatatttttttaaaaaaacgcacttctagaaggtgagagtcgagtagatttgtaaatttccggaacagtaaaaattgtctttaaaatattttactaaaaaaatgtaaaaataaaaaaaaatctccctagcgaaccctgttgagaattgaactggacgacggttttgccgtggaataagttcactttgggtccctttatttgtcacccattccgattttcgttgcttgaccgcaaaaccggatacgatccgtcccccaacttatgaaaaccgggcaaacgattttccctcggcggttttggctgacgtggcgcctacgtggcttatttgactaggtcttcgttacacgtggcattgacgtggcgcttacgtggcaattctacctaaaaaataataaaaaccatgggcccacatgtcagctgcacacaaaaataattttaaaatagtggggcccacgtgagccccacatgtcagtctcactccactcttcttccctctcccttctctcttcatcctcacttctctcttcttcccctctctctctcttcttcgcgggcagcggacggcgcaggtgggcggtggagcaggcgagcgaggcaggtgggcgagctccggcggcggcggctcggcgtgcgccgcggcggggatgaggaggccggcggcggggtggccttggccgggtgccttggtggacttggcgggtggcgcggtggccggacctggggtggtgggcgccgcggcgggggccggggtggagggggtggtcggcgcggcggcgagcgtcttcttggaggagaccggcggcgtggtggtcgccgccgccgcgggggtgggcggagatggcggatttgggcgggaggtcgccggcccgactcactccccgccctccacgacgcgctcgccaccacccacaaggagcgtcgcaagctcaggcccgatttgggcgggaggtcgccggcgacggtgaggtcaatggaggaggcggtggcatgttcaacgtcgtgccggggctcgacgggaagcccggctccgtctcgctcgagctcgggagcaagcctgggtgcttcttggtcgccggcgccggcgcgaaggtgcaggttggttgcaggagccgcggcagcgacgggttaattaattctttgatcctttctatgctcaatttagtaattagcatggcaaatagcagttgaatgggaaaatgagtttggtttacatgtacactctgcctctcagtgtttactggagtagcagtgttgttactctgcaatgtcggctctttatcttgccattcttttcttagaaagagtatatacctcttgatgcagttgagtatactggaggagaccggcgacggcgaggtcaatggaggaggcggtggcatgggcaccgacgcctagctcatctccgccgagcgccgcagccagggccacagccgccggagccgtgccaccgtcgctagagaggagaggggagagagagtcgaagagagggagatggggagagagagaggaggaagaagagatggctgagaatgacatgtggggcccatgtgggtcttaccattttttttattaatttctatgtaaacctgacatgtgggtcctaggaggtttattattttttggaattgaattgccacgtaagcgccacgtcaatgccacatcagatgaagaccaagtcaaattagccacgtaggcgtcatgtcagtcaaaaccgccgttaaaaccgccgagggatctcatctgcactggttttgacagttgagggacgtgttgtatctggttttccggttgaaggacgaaaatcggattcgttgacaagttaaggaatatatgatgaacttatttcttttgccgttcggttcgattgattgggtcaggcccatcatctgggcttatggataggccgcgttggcgttggcgtacgtacttccggcccatcaccgaatcgatctcatgcacggctgggccatatccatccattaagtagccccgacactgatatatcgatcaatcttgaggcatttgtaaatttaccactatttttttaattttgtaaagagattattcgaattacagttccagtgtcatttcataattttctctagtggtagtcttataataataatttaaagcagtggcaaatttataattgttctcatcgatctcttgatctctcgagtttatcctgagaacatgtcctacttgtgagttgtgactgagtcaaatactcaaatcccattttagacggataaacaacacgaaatatcacatcttatagcaggtacagtaacaggctataaatcagctgtaaacatattttaaacagataaatgaggagagagaagagtagcgggctatagatttatagccagttgtagcacggactctaagacaccggatgtgtataacaggtgggaccagatattaatagtgtagtatataactattatataaataagctattagattgactataaataaattaaagttagtagttgactgtactattaaacttgctcttatgcacgtaacactcggtaactgatgacgaagagtcttgtctgacgcgagttttcgtcattgaaaaataatatcttcgacgctactaaacgtctaccactacaccaattagaccagaaacacacgctaattaatccaatcttatctcaatgatgatcaaactacacactttgtccccgagcagaatcgggatccagtagatcacgcacgaacgcaggcagcatactcagtgtgcattgacagtcctgcccttgcccggtcaaagacgagcttttcggtcaaagcaactccccgtgcgtgctctccatatttaaaaagctagaaagcgaccggagtttaaacaaagcgcgcaagattacggcttcacatagccactaagagcaagtttaatagtatagaccactattagcttcaaattatttatagtcaatttatacaatagttgtatactatactattaatatctggtcacatatattatacatacattatgtcttcgatttcgtactgtgcttttctatctctttgtttatctctttaaaatatatttatagctggcttatagcctactgctctaaacccccacccacctcgtaatctcttgggacttgtctttacgtacgccaacctcctcctctcgtcgcgtcgtcccctttgggaacacatatttttattcccatggagctagctatggttgcagttgccgattattccatagattaagattgctttgctttgcttgcttctgtgctcttctgccgcttttcacttcactctttgcttcggcccgtggtccagccagtgcggtgatggattctgtggtcgtacggtcccgtgttgctgctgtgattgccctcctgtgtgtgtgagatactgtgatctggggccatgaaccttctgatgtttgcttttgtacttaaaaaagttcattaaggagtgattgccatgtgtgtgtgacggaattggaaagctatataccaacgctagggcgatacgtggctggatctgaaaatgatcacgacccatgcagaactgaacatgtgaatttaaacactactactatcgatcaatcacaaagataaatccaggtgggcagtacaaatccatgacaattcctagtcacaaacagaccgacatatggcacgcaagtgcaaaaggttcagctgaaatatccacggcatgagtcagctgatggctccctcaaaatccataatggaaaaccaattgatagtgcggtaagaggaaacataaaatatgatatactatttgtgaggtttcaatgaaatatcattcagtgcaccgataaaatatcacttggcacattatctt

SEQ ID NO: 75093 - DNA, 3734 bp, Oryza sativa
ggggggggggggcaagaattgattcaatcttgtcctgttgtgctactatcttaactagactccttgttttcttctcctcatcaccttttgtgtgtttgtgtagtggctgtcacctgtgtgtgcatgcatgcatagcaatagcattacattgcaatattgcatttgcacaagatgggagcatgcagtgcagtgcagccccctcctgctgtagatctgtgcaaaacattgatgcctttattactacatatctttctgagctaggaggagccccaatcatgtgcttgtcctagcatgacagcaacttggccggccttctgcacaatcacattgtgtagttgtagttctgcaggtttgcaacgcattaataaacggcgtttggcccattgtttaactcaaacctaacctgccactttgctgataaattgttgttcatccatcatcctagtgcctcgtgagcactggattggttcagagcagcagctccagatccagagatgccgcccatttgagttgtccttctcctttgtttggtcacttgggcagcatcaacttgtggattgtcttgtccccgcaagaacagtgctaatgcacagatcacacacttaacccactgcaaacaccacatgagaaagagagtgaggaaaaaaagaggacagatgaacaggagtccattggtgttgagattatggcccataatttttttgtgcaatgctgaatactcctttatttgttctatatataatttgatgatcattgcctgaggagtgcttggtgtatgcaactctctgcatccagcagttcactgcacattttctttgggtcatgcgtttggcatctgttggctaatgagaatatttagggcccctttgaatcgcagggtagaaaaaacggaggaataggaaaaacataggattctgacaggaattaaagtgtaaaacagaggattgcaaaacacaggaaaaacacaggaatggtcgtttgattcgagcgcaggaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggcccttagagtagaaaagcttcagtcaggtatgagtttccatcaaacagacagaaatgtcaagctaatgagattagatcttgccaacttaaatgctagtcatgccagggaaatgtagttggctagaagatgaataatggtcttttgcaagaactgaaaatccctttcttgtcccaacaagacatttgatgtttattacgatcactcataaactgtttcaagaattgtcggtgatttttttaatttaattcatctcaagttttggaaatgaacgagcaaaatcagtcaccagtcacaactgacaactaggttcgatctaatcagcaaagcctaaggacaaatcaagagtataacttcttccagaactatttcatgatgtgtacgagataacgagatatttattctattatcaagaaaatctagtgatgtacgagaaatcactgactaatttactgcgagagtaaatccggtattttccaaaagtataagtcatggttcagattacagaatatgttcttgcaaaccatctttcacaaatacaaagccactttgcttttcctttttcctataaagcaatatactttgctgatgttttgacaaaagatgcgcttacagcgttccatcaagagctttgacatttgcagtagatgattcccagtacaaaacatcagatagagagaaggcaatgagggtgaatagcttttctgggatttagtggagcacttcacttctatgaggccttcatatttcatacaacatgtggacactctgttcatgtaatcttggatatttaggaacatgacactactactacttcaatcagaaaagttgatgtgacagaaaaaataaataaaaccaaggtgttgacacaccataaagtaagcctataaatccaatcttatcactgttcacaagcttggatgattgcaaagccctactactgccataggcccacattggaggaagtagttagcagttaaacttgtgcttgatcgttctataatcatcagaggaaaaaggtttcctgaccaaactagtagtgattaaaaagcttcccaagtccagcagccatatgcagttgtattgtaccttataactgacaagatctgattaaaaactgctctaatgtttctgcacatatggaaacgcacgcctaactttcagaagagattttgcctgatgcacacagaaaaatgatctgttcccatgcatgcagtcttgatggctatagaaaaggagtatcttcttcacctattgctaagattggagccactgaactggtagaaatagggaaaagtcagcagttaaaaaaaagaatcaactttgtgccatcatttctctcctttgccaagcataatgcgtctgaaaaaagctataatttacgtcgtgtttgacaagagctaagacaggatcatcattgacaaccctgaaagaacactgcaagagaagatgtgtggaccatggatgcagttcccaaatatggctctcaacatagaaccacaaatgcaggtttaggtaaacacaatgcaaaagcaaacgcaatggaaatggattcagaggagggtgtaaccagaagaagaaccccccaggttttcagtattaaagccacaagtaatcttgagttcttgacatgaactgtctcctgattacaagtctcttgtctgaacctgaattattaccccagtggtaaactggtaatagctctgttcatgtaaatagtagtagaggcagtaataaagtttacacatatgaaaacgctgtaccaaatggcgtatagcccttgcagctttctgcttgggtgaatcaatcacagtccccctcattactactcctgcgtttgaaacagcccaagctttgcgctttcttccacatcagtctcattcaatcccgtggccggatcgcagcttgttgcgagcatatgagatattgagatccgcattcctcccagatctgaagaaactaaaatgttctttcgttttcttaagccggagtggcaatagtagccaattatttgacaagatgtttcagagatggcaaagggcaagaggagatccatctatagcctcaaatgtaccatcaccaaaaaaagctcagttcagcctcggatgatcagaaagaaaaaaaaatatcagtcgagatctcctgattttaagcacaaaaatttcggacatcttgctttgacaatgagtggctgcatctctcactttcagagaaacctatcaccctttttttttctttggccaaagaatggacagacaccccaagaaaccgaaagagaaagaaccaaaaaaaaaatcatcagaataacattgcacagcatcacatcttcatcttgagatacacacagggagaaatggtcaagggagccaatgagtttggtgaggaaggcttttcaccagctgcagagttttttactgtggatggatccccacttgggttggcatctactactcctactacctgtggactgctcgtcgcagcagcagcagctgcagctgggggggggggggggggggg

SEQ ID NO: 75094 - DNA, 26894 bp, Oryza sativa
cccctagccacctcagcatcgccccgccacgtcggcggtgggacggcgccaaagaggctggcgccgtcctattgaacgacggcgccagccactctggcgcctcaaaaaggaccatttttgggataagtttttctagagatctacttgcgaaataagtttttcaaaaggacaaaaatgtgaaaaatccagtaagccagcatgcaggtcaccagcggcgtcgtgatccatcggcaacttgatcggcatcgatggcgcgcggcgattagatctatgtccacagccacgttgcagcgactcgatcggtgtccacggcgcaggcgctcagccgatcggcaaagccgaaggtgacgaccaatccattggctcgctgaaatcatatggtaaaggcaaaaagcggcgctggagacatcacagcactgcttacagcatcgacaacagcatcgtccaccgtacatcaatagcatcgttctgggggtaggtactcccgttttgattttcttttctggaaaaataattcccaaaattcttaaatccatgcaaatcgatcggaagctacaaccaacatctcgcataaatctggtggtgaccaatttacccagccattcggtatttacaggttgggtgcgtctgccccgtcagcggcggcgagccgtcgaaccctcttctcaagcggctgacaccaccagcaagaggaggctgcaccttgagcatgtagctatccaggggcctgaagcgttcggggtttatacgcgagcggagcgccggcagatccaaccatgcacatgtttatacccaaatttgacacctatgattaaaataggaaagattgccaaaatttagaagtctaccggtttcctccgagtgggccggtctgactgccgtgtgttgggcggtcagaccgccggttgagggccagtcagaccggcggagtgtggccagtctgaccggcaggtccgagtccgactgtgtttcgtcaggtttcgaggtttccttgctcaggaaggcatgttttgggtttcctttagtttctaccccgagttggacgtggaggagggcctgtagaggacaagaccaacccctatataagggacatggccgattcattgtaaaaaaccaatctacaataaatcaatcgaatcgtttttcatattgcttttagttttctcttagtttatccatctttgtcggtttgcgtcgtaaaccgtccgccgccgctgccagagtgcgacatctctttgtaggtttgtcctgaaaaccttccgttttgcccacgagacgggtagttatctagaaatcggctccgctagccggtttagttattaaaacccatctagatttagctctttgctagatcgaggtggttggcgactctaggatcaccgcaagacttaaggtgctgcgatcgtgcttgttaacttgtcaaaaaagttgccaacatgatttttggcgactccgctggggaagagatccgttcatcgtcaactcaacttcgatttcgccatgatgaagccgccatccaagacggaggtggagccatccaatatgataccggtcacattggatgatttcgtaggagaagaccgcaaagctatggaggagtacatcaatgaactcacacgggagacgttgatgagggcaagcaccaggactcgtcaaggtgtgatcatcaagcccgggccacgtcctaagctcgcccccgatttggtaagcaatgatgaggtaacacaatctatccaacaacaagtagcatctacaatagattcatctatgattgcttttaaagataagttagatgcaacttttatattgcgtttgttttctttatctttgtccggtaatgcttttacattgtttacttctttaccggcaaattctattcatacttgggctcaattagaagaaaaatttcatgattatttctatactagagaaactgagcttaggttatgtgatttaacatcggttaagtaaaaatataatgaacctgtcattgattatattaagagatttagggatgttagaaaccgatgttatagcttgtcacgaccggaaataacccaacgggcgttccttacatgcgtgtattattccttgtcccaggaggcaaggtacaccaaaagttgatacaatacagagtttaacaagcggaagcgtaaatagttaatttattacatgggcggcgagggcccagcacacatgaagataaacgaaaaacaatggaagactagggcgacgaccacaggcgcttgacggcaggcacgagctagacaccaaagccttcatcatccaggaactcctcttctgggattgggaaaaattgagcaagactgagtacaaccaccgtactcaacaagacacacccacgagtgcaaaataaatgcaaaggagtacaagggagttataatataggggtggttagggtttgcagtgaacagcattaaaagacacttagttgctcaaagctatttcgtaattacgatcctagagctatacaatattattaatcaaggccatgaacccacacgaacctgccttaacccaaggcctacgatgatttggaccgaactggcaacctgaccctgggtcctagctcgtcccaagccaacccaggccaaccatttcacattttagttgttaagcgggttttaagaattaaaacactaacttgggtacattgctaggcatgcccataaccgagggcgcggctattcgaataggttatactctgatcagaggtgtacatctttacccacaagacacatcttcttcacgtgtaaccatgtgccacataccaccacggtatacggacggaagacgtgacatagtttccaacccatcctagccatagacaagagtaccgacccaaccccacctacggccggaacctccaggacaggtaggcaggactgagcccatagcagtaggacaccagccctgtgccatgacatctcgactaccgggccgcagctcgtgtagccttcatttgccctagagatgtccatcgacccccgacttcgtccatctccatccgtatacttttgtttataaccagactgagccacaaactaagccttacccactagacatgtggaagtacggtagtgctttgcaacagaggcacgagcttaatccttatagtacccaaggtacgacaaacaaaacccaaccacgcacctcgagcccagcctaaaaccattttgggggttttgaatagagggggaggtatgtgtccaattccaccataatccaaccattccatagtgtctaagtgatatgagaattcccaaagtctaaagttataaaaccacctaatgttgcctaattaaccagcgaagcatctacctaagttcatactagtggaaccataaatagagtacccactagttggggttttattttcctagggtgaacaaggtaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgcttttccaaacgtcggcttcaacctccacgtagagcggatcttccgaagctacagcgtctacacgaccaaagaaaaggaaaaagtattttactctaataaactccatataacaagcaggaacaaagtacaaaaatgggttcttgacttcttgaggaaaaattagagacttgaacggtccaattccgagttcaaatggccaagttatggccatttgaagtttatatgctctttaagtgaatatttgcgaatttcttcatttaaattttaatttaaaaaggatttattgcgtcagccgaggggagagcgcgcgcggaccgggtccacgggggtggggcccacgcggcagcctcacggtccacggtggactgggtgcacccgggctcacaccggccggagccgtgggccccacgcgtcagcctcactcgagggcacgggcggctgacggccgggccccacgcggcggccactcggcgcgcccgaaggcggccacgacggcgcggtcggcggcaggcggcacccgcgcccctatggtcgccggcagcggccataggcacggcggagcagcggtcgagagaggggaagggaagggggaaaagaggcggtggtccacggctcaccctaggtcgacggcgacgacgaaaaaggcggccagagcggaggaaggcggcggcgcggctcgggtcgacggggtcggcggcgttccggcggtcagcgagctcggcgtgggggtggacggggtcgacggcggtgcggctaagccggaggaggcgacgccggggcgggagacggtcctggcgagcggagaaggccggccggaggtcgtcggcgacggaggagagagagggcaacgacgcgagctcgattccggcgaggagaaggcgcggcaaagggtggaaacgggcgaaggaggtgcggggagggtttaaatagggttggaagggggagagggcggccgggagaggaaggaaaccggccgggaggtccggctgccatcaatggcgccggcgaaatttgcgtgggcaaatccggccgtttgaatgcgagagagagagagggaaaatggggggaaagggggaggggatcccggggaatgattccccccacttaattgcacgcggggacggcgggatgcggcggattcggcggcggcggcggcgcttagcgcgggcggggcggcgggaggacggggatgatgggtgggccccactcgtcaacgagggtggcgggcgggcccgcccgtcagcggcgcgcgcggggggagaggccgagtgggccgcggggagaggagagagacggggaggggactctttagggtttttctttttataaagcctttttaactttgtttatttcttcttaattattatttgtgctctgaaaattccactaaaatttatttacacattttaggcttttaggaattatacaaaaatactctaagccttatttgacttttactttgcacattttaattttttttgaggctttcacgaggattttaattattctaggcataattttaaaggatatattttagggtcgctttgggacgtgacatagcttgaatataactgacagagatttggctggtcttgcttttaatagtttaattgctccttttagagaaaaactagatggccaacaatttcttgatgttagtcaacttatgcaaagggctctcgcttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccgcttcctctcttgggccggctcggcccagctccctccctctctctcctctcccctgcggcccatcggccttcccccgcgcgcgcgtcgctgacgggcgggcccgcccgccaccctcgctgatgggtggggcccacccgtcatcccctacctcgcgccgcgcccgccgcctcgcccgtgccctagcgccgccgccgccgcggattccgccgcatcccgccgcccccgcgcacaataaagaggggaaaatcactccccgtgattccctccctctttccccccacttttccctctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctacccgtcggaatcgagctcgcgccgtcgtcctctctctccgccgtcgccgccgagcttcggttcgccgccgtcgtcgccccggacctcctcccacttcggcatcgcctccttcggcttcgccgcgtcctcgtcgacctcgtccaccccttcgtttcgcccgccgaccgccggaacgccgccgtcctcgtcgacccgagccgcgccgccgcctctctccgcttcggtcgccgttcccgtcgtcgccgtcgacccggggtgagccgaggaccgccatctcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcccgcgccctcgagtgcggctgacgtgtgggacccacggcgccggccggcgcaagccgcgtgcacccggtccaccgtggaccgtgaggctgccgtgtgggccccactcccgtggacccggtccgcgcgcccctcccctcggctgacgcaataaattcgatttaaaattaaaatttaaatgaagaaattcgcaaatatccatttaaagagcatataaacttcaaatggccatatcttggccatttgaactcggaattggaccgttcaagtatctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattgttattatttctttgttcaccctagattaaacaaaaccccaactagtggacactctactcatggtaccactagtatgattataggtagatgcttcgcttttaattaggtaacattaggcggttttacaactctagactttgggaatgttcatatcacctggacactgtggaattgttggagtattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaaaccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcgaaataaaaatcctttgtatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccgtggggtatccacacggagtggactaccaggccaggccgcttctggagcaggagggtgacgatgcagagccccacgctgcttgggaggtcactgcagtgatcctcgctggctctcccgagcggacttcgctgacagtcaccgcgggtggagactccttccccgccgcttgccagagcgccgctctcctcgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacagaggatgcgctgttgcttaccttccgtcctggcccgtcgcagcagtagacgagcagttagtaggcttgcgcgtgtgttctttctcgtttgtcttcttgttgggttgtgtggggcacggttatgccggtgtgtggtgtaactgtgtcggagcctgtctttattttattcgcctaagcaacttgaactttaatgaacccatttaatagcagtaataaatttaagaattatggtagtcgtgggtggttagctttaattgtcagctctctctgtttgctggttctgtgtggggttttcagatggtgatgaccaggagaagtgctaacaccggtgatggcaaccaacctgaaggcagcaaccacaaccatcagggcaacccacctccacctcctcctccgcctccaccaccaccaccagacaccaacgccattctcacccaaatcctcgcccagcaggccaacatgatgactgctttcctccaccacctccaaaatccgccacaacttaatgctccaccaccaccctcacaacactctaaacttgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgtagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcaaccgctccgtgatggagtatttgcacgagttcaacaacctggcccgttacgctccggaggatgtgcgggaagatgaggagaagcaagagaagttcctggcaggaatggaccctgagctgtccgtccgtctagtctccggggattatccggatttccaatgtctggtggacaagagcatccgcttggaagccaggcacaaggaactggagtcgcacaagcaccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagtatcaacaagggactcgtgcgccccgtcctcctccaccgactgtgcagcttggtcaaggccgcagggacgctcaaggtccgcagcgtctgtgcttcaactgcttcgagcccgggcactttgcggataaatgcccgaagccaaggcgttagcaaggccaagcgcctccccgccccaacaacggtggtaaggacgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcatagaaaccctctgctcatcaccacccctggaggggttatgacagcaaagtattatagccctgccgtccctatagaaattcgggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaactggccgaagttaagaaacagttggaagagctgaaagaaaaggggtatatacgtccgagtacttccccctggggtgctcctgtgatttttgtggagaagaaagacaagacaaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgtggtggttttcattgatgacattctgatatactcacaatcagaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcaccgattggaagcaacccaagacagtcactcaagttcgcagtttcttaggtttggcaggatactaccggagattcatcgagaacttctccaaaatcgctcgacccatgacacagttgttgaagaaagaagaaaaatttgtgtggagcccgcaatgcgagaaggcgttccaaactctcaaagaaaagctagtttcctcgccggtgttaatcttgccggatactcacaaggacttcatggtgtattgtgacgcttcgcgccaaggattggggtgcgtgctcatgcaggatggttatgtggtggcctatgcctcacgccagcttcggcctcatgaaggcaactaccctactcatgatttggagttagccgcggtggttcatgccctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacgtggtcgccgacgctctaagtcgaaaaggccattgcaacactcttaacgtctgtggcattccacccgaacttaatcaacagatggaagccctgaacctaagcatagttagtcgcggattcttggctgcgctggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgagtatgcgttccagataacagagaacttaaacagttgatacttcaggaagctcacgaaagtccttattccatccaccctggcagcatgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgaactctacttcgctaggatcgtaagtctccatggcgttcctaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctggatttcgggaagacctgggataagagtctcccctatgccgagttctcctacaacaacagctatcaagccagcatacaaatggcaccttatgaagcgttgtatgggcgcaaatgccggacaccgctaatgtgggatcaagttagggaaagccaagtgttcgggactgatatcctgagagaagctgaagctaaagtcagaaccattcgggataatctaaaggtggcacagtcccggcagaaaagttatgcagataaccgtcgccgtgacctggaattcgcagtggacgattttgtatatcttcgggtcacgccattgcgaggtgtacacaggtttcggacaaaagggaagctcacacctcggtatgtgggtcctttccgtatcgttgctcgacgcggagaagtcgcttacaaattggagctgcccgcctccttgggcaacgtgcatcatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccccttcctctcttgggccggctcggcccagctccctccctctctctcctctcccccgcggcccatcggccttcccccgcgcgcgcgtcgctgacaggcgggcccgcccgccaccctcgctgacgggtggggcccacccgtcatcccctacctcgcgccgcgcccgccgcctcgcccgtgccctagcgccgccgccgccgcggattccgccgcatcccgccgcccccgcgcgcaataaagagggggaaatcactccccgtgattccctccctctttccccccacttttccctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctccccatcggaatcgagctcgcgccgtcgtcctctctctccgccgtcgccgccgagcttcggttcgccgccgtcgtcgccccggacctcctcccgcttcggcatcgcctccttcggcttcgccgcgtcctcgtcgacctcgtccaccccttcgtttcgcccgccgaccgccggaacgccgccgtcctcgtcgacccgagccgcgccgccgcctctctccgcttcggtcgccgttcccgtcgtcgccgtcgacccggggtgagccgaggaccgccatctcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcccgcgccctcgagtgcggctgacgtgtgggacccacggcgccggccggcgcaagccgcgtgcacccggtccaccgtggaccgtgaggctgccgtgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagattaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattgttattatttctttgttcaccctagattaaacaaaacccgaactagtggacactctactcatggtaccactagtatgattataggtagatgcttcgcttttaattaggtaacattaggcggttttacaactctagactttgggaatgttcatatcacctggacactgtggaattgttggagtattgtagaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacgaccttgataaataatattgtttagttctagaatcgtgtttacaaaatagccctgagcaactaaatatctttaaatgctgtttactgcaaccctaaaccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtctactaatgattacatcgagcatattgtaaatggcatgattctcattctcattctactaatgattgcaatgtgtttcgacgataggttcaatcggccatagatgaaggacgattgaagttcactgatggctccaagatgaatcttgatcatgatccttttccggtgaatacgattaatttcaatgataagaaggtgttgattcggccggagcaagccgaatctactaaaggaaaaggagtaatcattggtgaagcaaggcctaaaatgatagtgccaaagaaaccggaggttggcgtttggaaggaaaataggagtggagcttcaacttctaaagcccctagaaagaccaaagtgacttttgatatgcttttggaaaagtatgagaagcaaggtggtgagagggttcgcaacaaaggaaaaagaccaagatcacttcctagggagcgatttggtcattcaccaagacagtcgcattcacctccatatcatcatccacaagatatgtcatggggttcttatccaatggccaccgccgggttatccttatccttattacatgccctccaatgcaattcaaccaagggtggggaggaccgaggaggccaattcatgagcgtttattttcaccgaacaacggccggttatatggtaagaatcgggctaatgaagaaaagagggaaagaaagcgcatcaaggtggaggtaaggacttcggaagtaattaccatcaaagtggggtctcatgatgtgtcaataccttctggagatgaagttggagagtcttcaaggaaaaaatccgaggccggtaccagctcatcgcagtcggatggtctgaccaggccttctggccggtctgaccgcagccatacagccggtctgatcgggccatcaggccggtctgaccgccgacccgacagcggtccgaccgacacctcaggctggtctgaccgtgcgccaaatgtcggtctgaccggcgcatctggccggtctgaccggtggtctacgtccggtctgacccggctccagcgccggtttgataggaggtttgcaaagggcgatgtgagggcttcatcgtcttcaaacaaggttaatagagggcattatttacctcctggaacagagccggatcctaggtggatgcctaaggatttgacggctactcaaaagagaaggttgcaacgtcttcgggctcaagagataagagagaaaaaagccgaagagcaaagagataaaaggttcaatgagttgcgaccaccaccggtatggaggcataagtccatagagaaggaaaaaccggttgttgtagaggagaaggaggaacaatcggttgataaaggtgaatcatctccaaaagaagacatgaatatgaacatggtatgtatgttgcctatgcagttttgtgctatggatgaagccgaggttgctcaattctcattaggtcctaaagacacggtttttgagaagcccgatgagtcaaaccgtcacatgaaccctctctatctcaaaggccatgttgatgggaagccgatctctaggatactagtggatggaggtgccgcggtgaacttgatgccgtactcattattcaagaagttggggcgtgaggatgatgagttgaagaagaccaacatgattctcaatggtttcaatggtgaaccaacggaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattattcaagcggatacatcggccgaggttgcaatggccgatgctacttttgagtggcgccatgggaatatccaatgcttatcggggagggatctttctagctacgattttattagtatctccgatggcaaatttgtatctatctctgtaaagccggctagtatagcacgactaagccatataaatttgtataatgagtaaggaggctaatttagaatggttacaaaagagggtgcaagaatatcagtctacaaagaacgatattggtgaaatcgttgaaggttttgatgaagtggagaagcttggacaagggtttacatcggccgatccattggaggaagtagacataggtgatggaaccaaaccaagactgacttttgtaaacaaaaatatgagagccgaatataaggttaagataatcgagctacttaaagaatatgttgattgctttgcatgggaatatcatgagatgctgggtcttagccgtgagcttgttaagcatcggctttcaattaaaccgggttttaggccttataagcaaccgccttgtcgttttaatcctttgctatatgaccgagtaaaagaggagattgatcggttgttgaaggcggggtttattaggccatgtcgttatgcggagtgggtttctagcataatcccggtggagaagaaggggagtcgtaagattagagtttgcatagattttagagatttaaataaagccactcccaaagatgagtatcctatgcctatagccgacatgatgattaatgatgcatcgggtcataaggtaattagctttctagatggtaatgctggctacaatcaaatctttatggcggaagaggatatgtataagacggcttttaggtgcccgggatttgttggtttgtttgagtgggttgtcatgacttttgggttgaagaatgccggtgcaacctatcaaagggcaatgaatttgatctttcatgattcgctaggtattatcttagagatctacatttatgatattgttgtcaaatcggatggtatggaaggacacatagcagatttgaggttagcttttgagaggatgcgccggtatggtttgaagatgaacccacttaagtatgcttttggtgtgtcggcggggaagttcttaggatacatggtgcatgagagaggggttgagattgattctaagaagatagaaaagattcgtgatttcaaagcaccgacatgtaagaaggaggtccaaaagttgctaggtaaggtgaattatttgagaagatttatttctagcctagcgggtaaaatcgatgcttttattcctatacttcgcttgaaaaaagaagccgattttacttgggggcaaaacaacaagaggcgtttgaagagttgaagagatatttgtctactccacccgttgtgcgagcgcctaaagccggaaaaccttttcggttatatattgtctccgaagacaaagtcattggtgccgttttgacgcaagaggaagatggcaaggatatatcattacatatttgagccgccgtcttttggatgccgaaacgaggtatgtctttatagaaagactttgtttatgcttatactatgcttgtaacaaattgaggcattatttgttatctagtacatgcatagttgcttgccaagccgatgttattaaacacatgttgcaaaggccaattctaagtaggagaattggcaagtgggcatatgctttgatagaatatgatttggcttatgaaccattgaaatctatgaaaggccagattgtatgtgattttatagtggaccatcatgtagatattgcttatgagaaagagatttgcctagttgaagttatgccttggaagatttattttgatggttcttcttgcaaagaaggtcaaggcataggggtaattttgttttcacctaatggcatgtgttatgaagcatcggttcgtttggaatattattgtacaaataatcaagccgaatacaatgctttgttattcggcttacaagtcatagagatggttggagctaagtatgtggaagcttttggtgatttggaattggtggtgcaacaagtcgccggagtctacaaatgcttggacggatcactaaataggtacctcgattcatatttggatattattgccaattttgataattttgctattaaacatattgctaggcgtgataattctagagcaaatgacttggcacaacaagcatctggctataatgtgaagaagggattatttctgatattagaggagccggtgcttgcttttaaatctttgtgcgaaattggcaaagctggggaccaggggcggtctgaccggcattgcgtggccggtctgaccggtgaccaggggcggtctgaccggctacatgccgccggtctgaccggcgaccccgagcggtctgaccggccctgtgtggtcggtctgaccggttctgggcagagcgctggggggcacgtttcaatcaatttagaggccgaattaattgtgaattcggacatttgtgcccaggaagcagaagaagattggagaattcctttgattcgatatttgaaagatcccacacttaaggttgatcggaaaattcggcggcaagcattcaaatacacattgcttgatgaagatttatatcgccgaaatatagatggtgtcttgttgaagtgcttagatgaagatcaatctaaagtggctatgggagaggtgcatgaaggaatttgtggaacttatcaatcggcccacaagatgaattggttgcttagaagagcgggattctattagccgaagatgattgatgattgcttcaaatattatagaggatgtgaagcttgtcaacggttcggcaatgttcaattggcgcccgtcgccatgttgaaccctataatcaaaccatggtcgttccgagaatgggctttggattttattggtcaaatttatccttcgtcattaaaggagaaaaggttcgtgctagttgctacggattacttcaccaagtgggccgaagccgtgcctttgaagaatatgactcatacggaggtagttgactttattttgaagcatattatccatagattcggtattccacaaacattaactacagatcaaggtgcttcttttatgtctaaggaagtgaagaatttttccgaatcttatgatattaaattgttgagctcttctccttacaacgctcaggctaatggacaagccgagtcgagtaataaaacattgttgaagttagtgaagaagaagattgaggaatacccaaagaggtggcatgaggtgctttctgaagcattgtgggtgcataggatatctaaacatggtgccactaaagtcactccttttgagttggtttatggtcaagaagccgttttaccggtggaggtaaatcttggttctcttatatcaagcaagatgatttgtcaagtgaagattacaagatgttgatgggagacaaccttgatgaagtcatcgacaagcgcttgaaggcattggaagagatagagaaagagaagaagagggtggccaaggcgtacaacaagagggtgaaagaaaagttgtttcaagttggagacttggtttggaagacaattttgcctttgggtactcgattcaaggagttcggtaagtggtctcctagttgggagggtccttatcgagtgtgcggcattgttcgagggaacgcgtactttttggagacacttcaaggggagcgttttcagcgagcgattaacgggaaatacttgaagaaatacttcccgagcgtttggcaagacgcttaggaggtactatggccggtaattgggttatcgtcctaagaccaaaaacgtgttctatgcttttagattcacgttgttcatcaaaaagataggggggcatgtgtttacacccaaatttggcacctaggattaaaataggaaagattgccaaaatttggaagtctaccggtttcttccgagtgggccggtctgaccgccgtgtgttgggcggtcagaccgccggttgagggccggtcagaccggcggtgtgtggccggtctgaacggcaggtccgagtccgactgtgtttcatcgggtttcgaggtttccttgctcgggaaagcatgtttcgggtttcctttagtttctaccccgagttggacgtggagaagggcctgtagagggcaataccaaccccctatataagggacatggctggttcattgtaaaaaaccaatctacaatcaatcaatcgaatcgtttttcatattgcttttagttttctcttagtttgtccatctttgtcggtttgcgccgtaaaccgtccgacgccgctgcgagagtgcgacatctctttgtaggtttgtcctgaaaaccttccgttttgcccacgagacgggtagttatctagaaatcggctccactagccggtttagttatcaaaacccatctaggtttagctctttgctaaatcgaggtggttggcgactctaggatcaccgcaaggcttaaggtactgcgatcgtgcttgttaacttgtcaaaaaagttgccaacagcaccagagcagaaaagcgaatacgtcggtacaacggcgccctattcttccacccatagccgggagccggcatgcagttcgtccactcgccggcggcgtgatatatccgatccatctactctgttcccaggtgacggtgcaaaactcttcgtccatgcgtgcatgggatattcccaggcggttttgcttcgttccggtaagtccattaagtttctttgatttttcttgctgatcgaaccttcccttttgttttctattagatcgatctatttctattctaatggaggatcatccaggcgatctcgcagtcatccgcagacggcgtcatcggcaacctcagttgttctcagccggcgtcattgtcaaacatacgttggtacttggtaggtcagagtgggccgggatggtgttatttcatcgttctgccgtcagctcgattccaggggtcggtgatgcccattcggatgatccctgggtgttgaatgctgcatgccatgccgttcctcattcttttctgctagatcgaattcccattactgctgctaaatggcagtatatatatggcacatgattattcatcttcgtgctgccaagccgatgataccttgatcgattactcagtatgattacatactgctcgttcttctacaatatgtactgctcttttttttttggttatatactgtcttttctacctatgatatgatatagtcagatgtatatactaagtaaaagatcatatatactgctttctttggagaaaaatatacgtactaaaagtacttgaaaaatagtatatactgctccatcgagaaatgtagtatatacaactaaaaatgactatgaacatggattaatttgtagtatgtactgacaaaaagaaaagtatgaacctagatttgtagtatgtaatggcaaaaggaaagttgtatcctttcattctaagtagaaatcagtatatctcaattcataaatcagtacatactgattacttgaagaaatcggtatagcccagctcttgaagaaatcagtgcatatccactcagacaaaaatcagtatatactcattccaagataagtcagtatatactcgttttaaaaaaaatcagtatatactcattccaatatatgtcagtatatactcattcggtcgttccaacagtatattgcagctaccaatataacacaaagtagattatactgaccaaacataaaaagtagtctacgtggtatatactgagcaaacaaaaaagcagtataaactcctttagccacgatgatgcagtatacactgaccaaatataaaaagtaatatgttcagtatatactgaccaaacaaaaagtagtatgcagtatcaaacaaaaacgtagaatgcctaatatactgagcatacgaaaaagtagtatatgtactgaccaaacagaaaagcagtatatactcattcagtccggatcgatgtagttggaaagaaaatttcaaagcaactgcgtgccaacgctctctccattaaaaaaggggagtacataacacctaggtgtacagaagagtcgtctctctctctctatctctctatatatatatctccgatgtcaattgttcgtcatagaataataataaaaaacacctttgattttacaatctcctccttgatgaacacattggcaaactcattaaaaatgttttggtgtttggaaaaataaaaacaaaagtggtaaaaagcacacttcgtacaaacgtacacatcgtgctcaaaaatccaaaagaaaacttatccccctttgtaaaagaaagaaattcccaattgaaccaacaaacgtgctcttctcaacaactctccaaaaattcaccttgcttcttctaaaaatccaaaaaattttacattacttctcccccttttggcaatgatttcatcaagcataggaattatgttcattaatgttcaaaagcttagcatacatatagcatatcaagtcatgtgttgcaataaaaagaagatgaacccatctataatataacaagcatgtattaaagtataaccatgaaccaaagattttacaattaagcttgaatcaacaatcaaaattcatgatttcaaacgatttataatgcaacatcttaacaaatacataggttgaagaataaacactaaacacatatacctattgcatttatcactctttctcaaataacctttagcacaaaataaccaagagaatttttaactttttcttttcttgagccttttttctcatatttttctcttttattccggatacgtccctgtcgtcaagacagtttccagagattcggcacctattattttgctcacatcgaatacgtccttgtcgtcaagactgtttccaaagattcggtattcattttttttcatatttttattctctttttcacaatgagcaattaaagctatttgaggaataacaattcaataaagcatatatatagagtatttacaaatcaaaccatatgctagcatcaacattgcattttttttaattcaagtatagaatttaagtgtcatgcatcatctcccttaagagcaaaatctaaatctcatgaaaaaactagaatacatacaagctatgctagagacaaataaaccttcaaagtattgctagcatgcacaagaaaataccatatgcataaacaaagctctcttttatcaatttttctcattgtcatattatagcttgataaaaccatgaggtactaattccccctcaaaacatgccaaaaggatgaattatgcccaattcaccatgaagaaaagcaaatcgattagaatccaaaggtttagtgaaaatatcagcaagttgcaactttgtgtccaaaaactgcaattcaacatctctcttctcaacatgatccctcaaaaagtgaaaacaaatatcaatgtgctttgtgcgtgagtgttgaacaggattcttagcaatattgatagcactagtattatcacaaaagagaggtactttctcaaaagtaagaccataatctttcaaagtagataaaagccaaagaatctgtgaacaacaattagcagcagccacatattcagattcagcagttgatgagcacactagattgtttcctaaaagaccatgccatcaatgatggaccaagaaaatgacatggtcccctaggacttttccgatccattttaccacccccca

SEQ ID NO: 75095 - DNA, 15800 bp, Oryza sativa
gggaagcggcggcgttcgggctcggcgcggccaactactacctcgtcctcgcctgggacgccgtgtcgtggcagctgctcaacctgggcatcatggggctcatcacctgcgcgtcgtcgctgctcgccggcatcatgatcgccgtgctcctgccgctctcgcaggtcctcgccgtcatcttcctccacgagaagttcgacgggacgaagggcatcgcgctcgtgctctcgctctggggattcgcctcctacctctacggcgagaaggcgcagaagaagaaggaggcgcagaagatgcgcgagcgcgagcaggaggtggcgctggcacagaagaccgcagacgtggagtcagcggcgccttagtttacaatgggattgtacgtgtctacttgggtgggtcgtatacatatttacgggtgtagtgaacatgtttctcagtgtagttttacagtacagtggcatgcataaattttgtacgagattgtttcaaattctgtatgacattgtttcattatatggtactagcacgcagaaaaagcaagtgctatagttgtatcaacaaagagaatactagcatatacattcacaagttcttcacttcatgacttcttcccagtgctggtaaaacctttatactactagctagtctacaagataacaagacagaagggaagattgtaagccgccatgaaggggttgcatattaaaatgccatttcacttcatatagagcacacagttgcttggcaacatgcatgcctgtgcagaaggagcatgtgctgatatgcacacctggagcagaaaagagggatgggactacggaagcacaagcatgcatgcaagaaacgacagggataaaatagtttcatagtataaaactagtaaaaaacaaaacaaactaatccctccaactccatgtctccatgcatgctgggcagtgcatcttggcatgtggcgacggtcgccggcgtcgtggtggccgacaggccgccatccggtccaacggcccagcaatgacttacaagaccaaagagggcatgggcccacaagaccgtcacgcacgcatgctacggcactggatgatggaccaacaaggtgatcgctgtcgtcgcctgcaccaacaccaagttgaatccgaatccactgcaatttttggaggctgtgcgctcatccagtcaccctgagcatagatgacaaaaacgaacacaccaaaagaaaaacaaatatgggcccaaacatcatggaatatattcacattgtcatggaatatggaattcttgtacaagatacaggggaatgacactttttttcaccaactatcaacttattctgccgtagtactgtaacatgaacctcaaaacacagtgtctgccaactgccattgacggaggtaccaactaacattttactcgatctctcccttttgtcaggtcttggtgcttcatcatctcctagagaacttggacacgaggtacactagaaagaagcagacgagagcgaagaggattacatgaaaaagatggttcgaaccattctgtatgattttcttgtttattctcctcatgttattcttgacgcctgcctgggcctttgtcagagtcatttgctgcaaacaagtgcaatatgcacattagagaccgagcacaaagcgtatttcaagttttcaacacaaactagtgtacatcttattgcagattctagtctacacatgttctcgacaaacagagaaaggaatatgccagacaagtaattttggatgatctagggcattttatagagtaaagcctcatttcgatggaccttaatctgggtccatcaaattcctggcctataggtgtgctaacatggaaacttctcatgtatatgtggcctagtccccttttctttttccaaaaactatcgaccaacaagatgacaatggagagaagatcagaatgtgattccatttaggcacgaacatcctgctaagcctgaatgatggttatagtgtacttttagagttctcgtacaaaggtttcagattttaaaacgagcagacatcaaattccaaataatcaattatgattaaatgtacgattctacaagcacttcacttccagaaactactattttatgaaattttaacatgatgccgctacagatagactagacaaagctcacaatgtaagtaatacccaggataccaacatacaaggccgaattcatggtaacttttagacatgcgttagtgcataatgaatcaactacagtgcatgggatgggatgactgaacatgactggttaagtgacaagagattgaggatcagcagattgtgtttgaagaaacattacactaggaaccttgcgatcagtgataatctatctgctaaaaaatgtccatgtgaggtacaataggcgtgccatatcaacattccgataactcaatctaaatgctattcaggatttggcccaaactgtctcgcagacaagttacttaccagctgagagatgaaatcattttggtacttggcctctgtttggatctcttgggcaacctgcagcaccaaattaatggcttgtttagaatcgattgaaagaatatgaaaaaagcttatgaacataagtagatcatggttcaattactcccacatagcatcacgcaatttcacaacaactctagctcgccacaccggtttcatttagacaccaaattttgactaccttccacaacagagtttgctcatacagattcataacaatacttacccctcttagcttacggacttgcccacgaagtccgacaatatggtcatccaaatcagcggtaattgggtcgatctggagcgaaatctcgctggagcttgatgatgcagccggcctggccgtcagcccttccctgcagaaccgaacattaggatcaggataaccgagacaaaattggaaagtccaagagggaaaacgataatttgcacacacgaatcgacggttaatcagaaattcagaatcaagccacgaaattagggacttgtcgatggctcaatcaacaacgaaatttcatagggtaccaacaggggaagcagcgcaagaacacaaatcgggggaaacgaccccaggtgttcgtcaaccacgagaaatcgaaatcaaaagaacgacgcgtcctggcgaatctaatcccgcaataaaaaaaatcgaaggaatcgacgattaggacggaaaactagggggggggggggggaagaagaggcgaaccttgaaccgtaggcgccgctcgccattgcgagatcagaagagggagaccacgaaagattgagcccgaggagatggagaccgatgctgctttcctcctccggatccgcgtcttcccgggcggagatcgaggctgcaaatttcccagcgacgcggcttggattggaacggagaggagaggacgaaggagagaggaagggaagcggagtagaggggggaaagtccgaggacgtggcagatcggacggcccacggttcacggatgacgcgttgtcgaagcagcggtgccagcgtgcagcgaacagcggttgcttctctgtcaggaaatcaggttaatcctgctttagtgactgttttgggagtttaaaattctgaaaaacagcgggtgagaagttagccgataagaattcgaagaaactatgtttttttagcttcagacttctaatttattttctagattcttaaaatctaggtgaaaatctaagtgttttgaaagtttctgacagctacagcttataggatgtcataagctccccaaacatgcccacatggttttacctgctgcttcgtgcatatgatgatgcttttttataaacttgtatagcacaaagaggataggttttccattccatcaggattttcctattaacgcttttttttataaattgttaaatagtgtgtttcgtataaaaacttttataagttactttaaaatattaaataaatttatttttaagtttataataattagaacttaattaattatgtgtcaatagctttctcactctacgtaccttatttaatcttaagagtatgttcaatggtagagacgattatagtctcttaaataataaaagattatttagagaccgcgtctttacaatagttgagacgacaaaggctctaatcattaactcaaaaaaatattcattttgttaacattcgttccatttttctaccctcatacaaccatatttccatattatagtgattaagagtcgttgttatccataacaaggatgttttgtctctcctctttctctttcttccatatcaacaaatattcctaattaacaacgctaagagaccactgtggataaatattcctaattaacaacgctaagggaccactgttgacaatcattgtacatgccctaatatttatctacctcaaactgacccttacttccttacttaattacttaatcttaatcttcatctattcaggtgccgctactggatggtcagacaatgcagcagtaaagggagaatataaatgagcaaaactcatggttcaaccaactcaatcatgtagaagaaagttatttcatcataggcgtcactttgtaaacacttcaaaattggtttttaatgcgaatttctttctatcagcctggcactattatcgaacgtcagaacagacactcgtttgatattgcaggaagccaaatgaaatccagtcggacaacaacagagagtaactatcgagagatcatgatgtcacatatcaaaaaccgtttcaagtcggtacacattgcaagaaatgccaacacctatccaacaaaatacagacgactgccaatttgatgaaacacagagtatatcacaaactgtaatatgttgggcttgctatccccaatctatggacatcactaagctcgtagattctgagcctcctgaagtgcttcctgcagattctttacggcgctgtcatagtacacgaagcccatgaaccagaactcatgattatcaacggaaaccacctggatgtatttctcagatgcatttgttctgctcgttgaaggattcactgatctcagttgggtgtggggaatgacaacctgttgtttcagacagaacaatgataagttatgcacttctataaaatgattcacgcaaatggagaaataacagcaggctaatggaagagaaagaaatctgcgactagtttcatgaagaaaagtaaaaggaaagcacataaaccaattcactactttgctttctacacagtacattatggtaagatatcttgcttcaggagaaatttgtcacactgattatcaccagcggttgtattgtgaagcagactcggtatgatctcaatatatgatgaaaaacacatacaggtaatcagaataccttatagtagctccactcatctttgtctccaaccttgtaagcaagtggattatcgctacagaatgccagctttttattggacaggtatagcacacccatgacaggaccagcagaggttgacagataacatgcatatggtttcttcagtttctcgtcagggaggacatcaaatgtttgatggaagattttatcatatccaccttctgctatgactttggtgatctgggaaaccctgcccattgctgcatctgtaatgcttggtccagttttcactgtttcaaggcaaattaagattcgtgttatgactatattatctcacgctgctcgaattcaatttaagaaacttataccatatcatttcaagggatcaacagtacaatgagcatgtgaacaaagaaggctcaatgcatgaatacaacaccaaatcagtgcaactagaaaataagggagaggtagcacaatgagacatctatctggaatgatcagcattataaaacactgcaagaatttaaaacatctttttactctctacattgttaagacatatggtttacctaacaaattaatatgcatgagctattcactgcaaataaattgtgttatgactgatagaatatacccagcatttctccgttgtcatcaacaacgccaactccacataaatccaattacatagcctaatagcaacagcaccacccataatccatatgcgctggaccaattcaaagtttcaaacagaccaaagaagccaatagatagtgaaccttcttcattcagcattactataacccacagatctcaccagacagcacaaatacccaatcaagcactactgtaattcacaattctcaccaggccgccttttttttttcgaactcatcaacacgaattatcgtcaaattccattagcgctaactaccgatataatacccagttcccccacttaatttaattacatgctactcataactccaaaacgaagataatatgcagaaaaaccaagcattggtaaactgatacagaacaaaaaccaataacttcagaattgaagcttacagtgttgccagaagttgccggtgagggtctccgtcttgcgagccgcctctccaaacctcttccccatcttgccgagaacatccttcaccgtatccattgtatctgcaaaaggggaaatccgaaacagttaaaaaaaaaaaaccccgcaagttatcctgccaacaacggagggcagattcggctgcaggaacgcactcttggaggcgggcgcgacgccgccggcgggtgaggagacgtaggggttgcccgagtagggcggcgcggaggaggcggcagcgtggtaggacggaggggggggcggggccacgtcctccggcgagagcctcgggtagtgcgcgtagtccgacgctgttgctgcggctgcgccggtcgcgggggccggcgccgccgtggcgtggtctcctccggcggcggccggcgggtgcatgtcgacggcggggaggtggggcctactggtcagacggtacagctgggcgccgcgtcgtgctcgacgtaattcctggacccaacggacgcttcaggtggttgccttttttttcttttctcccctttttttcttttcgaggatatcgtgactgcctgtctccgaagctgatgcggtatatatacataatcgaaatattgaattttccattgcttcaaaaaaaaatgccacacttaaataacacgatgaggtcatcgctaaggatttcgagtcttcggcgaacttgtaccaacaaatgcttagccacgaaggtgctttcatagcccgctctgatctgtcgtgtaacgcccgaggtctctcggtcagcgacgcgttaatatttagcggcccacatgtcagtcctgtataggtgagaatgagatcggatccaaccaagtgttgctcctcctccttccaacccgttaattccgctgcttcgcgtagtactacagcagcaacggttcatttctgcctttcggaccccaaactctcccaaggcccacctcacgtgagccctgtcgctccaccgcccaacgaacggcccagcctgcgtttcgactcgcgcgggtgcagcactgcagccgcgtctctccgctcggcgcgttgcactccgcagcgagcggcgagcgaaaaaaactgggcggattacggggagaatccggggaatcgcacgcgcgcacgaggagcgcaccgtgcgtgcgcccacggccacggggcccgggtggaaaaaacgcccccgtgtgctgggccgtccatccgaacgcgtacaccaccgcgcgcgcgcggcacgatgggccgccgatcctctcgcccgcctcgcgtagacgcgtacgtatacggcggcccaagcacttgggggggatcttggggaatactggaaattggaaaagaaatggagatacggggctacggatacctacctactactagtgcctagtggagtagtaccgttttttgcacctgaaagctgagagccccaggctgaactcgcaacctgccactagcgggaaagaccagcaggggggccacctttggagatgcacgaggggcattgcccaaaagttggccactaattgggttctttttttttcctctcataaacgactagcttagcactgctttattagactaaccgtggatctttttatgaccattactatatatctatttgcttcatggtctcttgttcggttttcaaaaggcaccgtgctttctctttgtgtgagaaatagagggaaaggaacctcctttctcttcattaatttttgctcatacgaattgaaatgatttcccttttgtccttaacaaatgggaattttccttatcattgattttcagctaatgttgttactcttgttagcttagacctgatcaatgatcccacgaatatagtatttactgtataagattgattctagctcaacacaaaactgggaaattcacttctgagtttggtctgaacaaaacaacaaccagtcatggaccaggatatggagttatctctttacaatcttaaaaagaagcggataccttaaagaagactattcttaggttttgtgcttggccccggatatcaaatcaaacgtcattgtagctcctctcctctgatcctctcccctgttgtgtcgaataataatagacagaggcctgaatgggaggaagctgaaccttatagataagactttaccttttttgcttctcccttatctccatctccttagtttttatatactacctccgtcctacaatataagagattttaagtttttgtttggaacgtttgaccactcgtcttattcaaattatttaaaaaaaagaaaaattgtacttaaaataatatagataataaattaagtcacaaataaaataaataataattttaaaaaaatttgaataatacgagtggtcaaacgttacaagcaaaaacttaaaattccttatattatgggacggagacggaggaagtacttattatggggatataatgactgtaaatatgtgggagaaatatagcttaaaacacacgtggctgacatgcatacaacggtaaatcacatgatgaagcatgtaaatttggggatcacaagagcacaggtaaagatggtatcattatgcctagttagttagcatgaaggatctctggacaaactggtagatggtttgattccagctcttgtaaacaaatgatagaaaagtacagtgtttggtcagcactacataaataacaattaacatgggacagatcaaaatgtattccaccatgaaataaaataatttatcataaggaagtactcagaaaataatatgccttgctgaacagaagttgatatggagtcacatggcacagtgcaagccagttctttttccctgaaaacaattatttgcagcaactatcacacgaagaagagaatttattggacaaaattaggaatggacaactgtattttttttcttttgtaaaagaagataaatcactggcaatatcgtgaggccagggtgcagtaagtgcttgagtggacaatctgagttgtctttatcatcatcatctctttctttctttctttcttttttttgaaacaaactttagtaccatctttcttgaaagaaattgactttcctgcttgtacagatggatcaatatcagaaacgaatattgcatcatgtacctgtcaaaagatcgagaggaagcagaatacttacgttttcattgcatgcatacagcccttgaaacaaggtaagaactagtgctcaagatttagcaagaagccactattagataaaaatacaatgaatgaggattgatgaacaatgtagttgtgtagatgcacagttgtatgtgaaggtccacaagtcctttcctctgagagtttttgagtcgtaaatgatcagttcaaccaaagaaaaaggagaatcgagatgtgcaggaagtccactgagaaagttggccacttttgcctctagtttttatttctccgtgcaggtaaatggattatgttattgcaggtcaaataatagtgcatggcttttggtgttaggagatgtacagctcatctgcaaatcaccaaaaaacaaaacgcagttactctgaagtcgtaacagcacaatcaacgacctggcctttttgaaatctcgtgctaattaattaagcaaggatgtgagagctagcagcacgtaaagtaaaactgcactaatcgttaaaaaaatgttattacaagtaaactaacccaacaccccaccggccaagcgtgatgtgacaaattaaaagcatgttgtgaaaaactgttatctgaataagtcgtagtaccacgtcacactaattggaaaaagggtcatcaaataccaatcagttttgttaacattgtaaaagattgtgttttgcatgcgtggctgttgcctgttctctgaaagaatgtccaattattatgtggtgttgtgaacagcttgtgcctgaatttgcatggcatctgaagtcctcaaagagtagcagcaaatcgctagactgacagaaaggaagaagaggccttgatgagagaatctgagatgactgcaagcaccgaatgctcattctgtacacttctcaagtttctggagcatcaaagtgtgttctctgcattccgttcaaaaaggaaaaaagaggagctcgatttggatcttagaaaggtattaactgatcagacacagtaacagaaccaaccagcttcaatcacactcacaatggtatcatgcatggttaatccatgtcatgtacttgggcttagggttctctcctcctccaaggtcttatcatataaaccaactggccaaattttgaatacaaggcgcctgcatagatcgatcaaattcggagaatataaaaattgggacagtatgagctgtgtttcttgttttctaaaactaaagaaataattctttcgaaaaaaaatacattggaattaaagaactgggaggggggtaaacaagggtgtgcgtaaactactgtctgcactaagaatcccaatgccttgactgacagcaatccctgcctgaaaggccgaccaagcacaataaaagatgtggaaggaaacaaaaacaaagaacctttccttggcctatctctcgcctctttactgttgcgtttctaaacaaagtcccttgtgcatgtggactggggcaagggtgaaggatttgttttttcggatcattttcaaatgcctttccggatgggcaagggggctcatcatctgtgagcatatgacaagttcaaaggttagtaatgaccaccatgctcctacaccacatcaccaactaaaagaacaaacacgatatttgtttaaattagattgattgaaattaaggacctttcaaggactttctcccattcagatgaacggttttggtcgctattctttgtatccaatatataaggaagtagtagttgagagttgagactagacagaagttattctgtagctagaaagtcttttgtttgtcatgtatgcgagtgtgaaaacactttcatatctggaataatttaaccaattcctcagaagctatttccaatcattattcagctccagaccatccttaggggggttttaacttgaaataccatcatcgcttcaatagagaagacaactagatatccgagttgttaatactataagagtaaaatcttgtgctaacaagaaactgaacaatttctttctttacataagttagatcacacattttgatcttatgaatcgctttaatgtctacacatatatatgtcctccacttttcgtcttttcatggctaatgtcacttccacactaccactcatctcatatccattctctctcgccatagtcgcaagccatactatcctgtttgcgtgcctcatcctatatctcaggtatagatctcaaaggctagtgtgatcgaacaattgtttcaccatcgcggttggtccattctttcaaaatgcataactccacgttcttccgtctctacgttgctacttgtatttacacgtatcttcctcctcagctagtagctatcagtgacactttttagtacatattactcaaatctatatagatgataggacatatgtgacaaccgaagacactaaaatttgattttgataataaactgtaattgaaataaccatcttcactaccagaacaaagcattcaaatagctttcaacgaatcaaaacatgcctagctggaagagagaaattcaggtgtccaaaactccccccgtgcatacaatctctttcacgctttcatcacaccatctgaaaaaagcacaaaggccgagtttagttccaaattttttcttcaaacttcaaacttttacatcacatcaaaactttcctacacacataaactttcaactttttcatcacatcgttccaattttattttgacatgaactaaccacacctaagcaaataatgagagatgtttacatctatcccagcttccctctctttgcctttgccagtcccacggggggggcgggcactgtggtggtgccgccgtggtgtgtgccgttctgtagagcactgcggctcccggcccaaccgcagcagcagcagcaaacatacaacacaacaacaagtacacgcctccctcccacacaccaccccggctccgcgctggatgtcgctcacgcacacccacctcccccctcccccccctcctccgccgcggcgcgtctccactccactccactcctcgccggccaccaaccaaccacgcgagtggtgggggggtgggtggggcccacatgtccgaggaggacgacgaccagccgccgccgctgccggcgcagaagcggccgcgcgcgtcgccgccgccggaccaggtgctcgacaacgtcctcgagacggtgctccagttcctcgactcggcgcgggaccggtgcgcggcgtcgctggtgtgccgctcgtggagccgggccgagtccgccacccgcgcctccgtcgccgtccgcaacctcctcgccgcgtccccggcgcgcgtcgcgcgacgcttcccggccgcgcggcgcgtcctcctcaagggccgcccgcgcttcgccgacttcaacctcctcccgccaggctgggccggcgccgacttccgcccctgggcagccgccgtcgccgccgccgcgttccccgcgctcgcctccctcttcctcaagcgcatcaccgtcaccgacgacgacctggacctcgtctcccgctccctccccgcctccttccgcgacctctcgctcctcctctgcgacggcttctcctccgctggcctcgcatccatcgcttcccattgcaggtaatgcatctctccatggaactttccaacttccaacttactagtagtagttgttgttcttgttgttgtctagtcgtccgtggtaatggcggattcgatgcggtttgctctcgctctgtttcttgcagggggctgcgagtgctcgatgtggttgactgcgagatgaacgacgacgacgacgaggtggtggactgggtggcggcgttcccgccggggacgaccgacctcgaatcgctctccttcgagtgctacgtccggccggtgtccttcgccgcgctcgaggcgctcgtggcgcgctcgccgcgcctcacccgcctgggcgtcaacgagcacgtgtcgctggggcagctgcgccggctcatggcgaacacgcctcgcctgacgcacctcggcaccggagcgttccggccgggggacggccccgaggatgtggggctcgacatcgagcagatggcgtccgcgttcgcgtccgctggccggacgaacacgctggtttcgctgtctggcttccgcgagttcgagccggagtacctgcccaccattgccgccgtgtccggcaacctaacgaacctcgacttcagctattgcccggtcactcccgatcaattcctgcccttcatcgggcaatgccacaaccttgagagactatatgtaatgcctggattgcttcatcagcttggtttcgactgaactgcgcgattctgcttttctgacgatgatttgtttgccaggtgcttgattcggtgcgtgacgaggggctccaggccacggcgaggacttgcaagaagctccaggttctccatgtgcttccattgaacgcacttgaggatgccgatgagctggtgtcggaggtcgggcttactgccattgctgagggctgccgagggctccgttcgacgctttacttctgccagagtatgaccaacgctgcggtgatcgccatttctcaaaattgcgtggaccttaaggtattccggttatgcataatgggacgtcaccagcctgaccatgtgactggggagcccatggatgaagggtttggtgccattgttaggaactgcagcaagcttactaggctctccacatctggacacctgactgatcgagctttcgagtacattggcaagtatgccaagtcgctccggacgctctctgttgcgttcgctggagacagcaatctggcgttgcaacacatcctccaggggtgctcgaagctggagaagctggagataagggattgcccatttggggatgctggcctcctctccggaatgcaccatttctataacatgcggttcctctggatgtcaggttgcaaccttacgctgcaaggttgcaaggaggtcgcacggaggctaccaagattggtggtggagctgataaatagccagcctgagaacgaaaggaccgacagcgtggacatcttatacatgtatcggtcgcttgaagggccaagagaggatgtaccaccattcgtgaagatcctataagctgcttctgcagagtggcacttgatacgctgaatgcggcctaagcaacaagggaaggtaagatagctggagtcaggcgtatgatcattttttgtatgcttgaagttggaaggagttctaaagccatctatcagagctgcaaatggttaaattgttgtactactagtagggggggcatcggtatatgcaaaattttctaccgcaagatcataagtgcatcagagcaggcttcttcgagggggcttcatcccctcagttttgtttgctgctctgatggccttctgtttgaggggggcaatctatctatgccggcacaaccaccatggttcctctaatttttttcccaactgaagcttgtcatcagattaaattcattaacacatttcctgtttcttgcctttataattccttctgttttcgcattcgtatgttggaactcagaaaaacagaaaccctgctgaattgagcttatgtttaaattcctactactatgtgctcaaattttgggtgatctctggttcaggcttgaaaaaaaagtctttgaacttgtcttttcgttatctcctctgaatcctgcactttgtctgttgatatcattacctggaggtcctactcctcacaacctgaaagctctatccatgggttccttattgggaggtcagcaaaagttaggccctagtccatcaagtgattattgcttgacagcccccagtttccggcctacgtgttctccttccacgccagtgaaaacgacggccggcagctgcctccgtctccggtgatccaccaccattttttttgcccatcagaaacatatctcatgctgatactgttggagaaaatagtcgccacagcctttttcttttcttttttctttttttcctttgttctcttgtggctgcatctgcttctgctgctgcagctggtcactcacagcttcttctgagaaagaaagaaaagctttgtaggatggtgaccaatcctacaaggaagcctgggtgcatccaagcctgagctcaaaaagattgatagtgaaggggtggcaaatgatgagggagtgatgaccggtcgatccatccctgatggggattgatcgatcgttttgactgatccccacgagtccctgactgtcctcacccccccccc

SEQ ID NO: 75096 - DNA, 10416 bp, Oryza sativa
aggtgtgagcagagataaatgatttatatatttatttttctattaatttgataccaagttgtttcttaattagtattcttttatctcttgtttacaagagaataaaatgatgtagtagttcttgaaatctgtagtctgtagatagccatggtcaatacatgcggaacgctgcgtccacggctatgcaggcgtgtgacctaaacaaaaccgccagtaggtcaaacaaacaggcaatacaataataccatatcgtacgttttggagagcgaaacgcaacccgtcgtggaaggctctaactagagagattagagaaggaaggaacagatcaaagaaaacaatcgttgaccgaaccagatatcaaaaccccccaagtacgatcgggtctgataagtggaatatccttatcgtccagctcgatcgaagtagcactatacatggtggtgatttgtggtaggcatgggctaccgttggatgcttagtgaacaagttatccacgggcggaggcgaggcgtggcgtggccggtgggacgcggtggatgcttacctggtagcgacccggcgcggcgattcctttcgttgacgtggaggtgggggagaggagagagcccagcagcgcacgggcgcccatcccctcgaaagcgcacggctttttgggcgcatgtgcgcaaccgtgcaagtgcggcaccgcacgtacaggtgtaccgcacgggagcgcggtcgttttttccccggtgctaccatgcgactgcgaatctgcctccgcgcacagcgaaaagttggggttcagtcgtgcggagcggttgtgcctgtatcgatgggagccgggccaagctggtgggattccaattgggccgtactggacgaatcagcgtgcttccgttggggaaataagtccattctacacccccctctctctctctcttcccaccttatctctctcggtctctccccttccccttcacggtggcggtggcaacgggaggatgagaggagcagcggcggctggtgacgagctcccactgggacgcagcggagccatgggctgggatcgtagagccaaggaggacggcgacagctcgattttatggaggcttgtgacagtgagaggatgagggtagtgacagcggcagctgatggcgagctcccaccggggtgcatcggaatcgggggcggcagctcaaccttgtgaaggatcgcgacagtgggccccagctagagtgatggcctcatcggctatggtcaccggtgtggtctccgatggctctgaccaccgctacaaggccaacgaggcgcattcaacgtcccccgcgctattgctcttgtaggatatgtcgacttgtccttgtccatatttggggaaccccactgcctcgcatgcacccaagtggaattagtggcctcctcaaccatcgctgttgctcggtgcccagcttctagaccttcaaagccgttgaccgccctcccctgctcaagctcattggcgtaggtgttatcactgccatcctctcctgcctccttgcctggttgattttcagccgcgtgtggtcactgcctctaccaccgtgacaaggtagctgccgcatccggctcttctttcgtcgggcgcccataggtcttaccggttctcatcgtcgtcccggctacaaactgagagcggagaggtggagagagagagagagagggagagagagtaaagagaaaactgtcactgacccatgggtccctcgccttatttttatttttttttcttgtaatgccacgttagatcacgaatactaagtcaatgcgacatgtagacatcatttagtgaaaatcaccctcaatattaccgctagagttattttgcaccggttttaatagttggagaggtccagacaccctattttgcaatcaagggatataaagtagattcgacctataattaagggagtcaaagtgtacttttaccttccgttgagcagttggggattgctgggcggaagatggcgaaagtggcgacgtgggaagatgggccgaccataagaaggcctttttagggcgagcaaaattttacagccttttgagcctagcggcgtgcatcggcccaaggtttcggtcgcgttagaactgaatttcctacgcgcacagaacaagcgctagcagttcgagtatgaaatgatgtactcgtatacactttaccagctcatgatctgatgatatgatcaggcgaaaggaaggtaaacccagtagtagtacacagaaagcaccgatcaatcaaaactgacacgcccaaacaggtagtgagaagagaagacaggccccgaatctcggcagtagcagctactacttgatactgaagctcttaaaccggaacaagctgccaaccttgcgcatcatcacccgccgccgtgcgggcaacgacctcggcattgtcgagaacgcgcttagctcgctcttctgatcttccatcgacccgaatatgtcgtacaccgatccttcgaagttatccgacctccgccgcggtagggtgagccccgccggcggcttcaccctcgcctccgagtggcacttgatcagcccgtgcagttctctcgacccgtgcgacgacgaggaatcctccatgtccagctttatcccggaagctgtggggctcggcgacgcggatagcttcatgccggcggccgtggggctcgacgacgtggcgacgagcaggctctgcagctccttgacgctgtcgcgcgccgccgcctccgtcacccggaggcactcgagctcctgcttggtgcacttgatggcggtgtccttgtcgccgagcatctccttgagcgcggcgttctcgcccctcgcctcctccagcgcctccttcacgaccttggtgtccttgacggcctgcctcaggatgtcgcgcagcttggcgatctcgtcccgcccggaccgctgcgactccaggaggcgcgcgttctcgcgccgcgtctcggcgagctcggactcggtggacttcatgcacgacgtgaacccgggctccttgccccgccacgccgcgaacgactcctcggcgtcggcgcgcagcctggccacctcctccgacagcgcgcggagcttgtcgtccttgcgcttgagcgagacgtgcagccggtccgactccagccgcgccgtctcggcctcgtgctgcgaccgcgccagcagctgccgcgtcgtgtgcagctccccgttcacctccttgagtgccagcaccagctcctccatcgccttcttgttcttgtcctccgccaccagcgccatccgcagctcgccgtgaaccctctggtagtcgcgatcgtaccttcctctcggcgtcgtcgcgacgggcaccgctatggcctcgagcctctggatggtctcacgcagcgacgcgttctccagcctggcctcctcgagctcgatcttggtcatctcgagctgcttcgtctgcatcgccagggactcgagcatccgcttctcggactccctggacgcgtcgagctccgcctcgagcgtctctatggtggtgcggtcgttggccgacgccagcgccttccactcgctcacctccaggacgcggtacgcgcggtctcgctcctcgcgcgccttgcgcagctcgccgcggagctcggcgacatgctcgtccacgtcctgccggctctgctgcatcttgttcgtccggattgaacacctcttcagacgttgcacggcgatatgagcaagaattcttggaccatgatggtgcggcgatcggggatgggctaaacttcgaggcatgtggaggaagaagaggataaaaatggatgatccaggcgtgcatcctcatgttttgctaaatatgtggtggcagatgagaacctaaaattgtgggtaatgacaagtttaaggccagggttcatctgaaattctgaattagattgttacctatatttggagtgttgagtgttactatatgtaacttgtgatcttgccctgttcttttaaacgtgacatttccctgaattattgcataatcatgatatgtatcagaattctggttgctaaagaaagcaatcatttattcacctggagatccattttttgagaaagctgttacaggcagaattcagatgactgagaatacacagatgaatttcagagagtgattttgtatatcaataaagtctgaacgcacatgatttgacacacgatgttaaaattcactagtcattatacacacaaatcttcttggggcagcagtcaaaccagttatttgtataattgtattgtaacctactgaagtgggcagcaaacttaagtagacaactggtttgctcaattgcaatttcacttagccacatcacttgtccatccaaatggtgcatctgagactcttcccctgcaacagaaggtcaaatgccgtgttgatgtccttcaggggaacctcgtgagttatgaacttgtccaactccagctcctgcattgcgttcgtatcaacaatcttgatgttaaaatattgtgacactatgaacagttaatcagttttgagggtgtctgtaagtgaaaggtttaccttgttcagatacttgtcggccaggatgggaatgtcctgcttgggtttcacccctccgaagagtgatcccattacgcatttgccgttgaggatctccaacgaaggaatggacaaaggggcaccgtgcatttcgacgccaagaatgatcgtcttgccccatccctgcagcagtaaacagttagtatcttcagacacaggtggatcagctcatccaacgtacactaggatgttcgagtacaactgtaatgtgcatacctctcgggagctccgaaatgcatcgctcatcaccgacgccagcccgatgcactcgaagcagtagtccgcgccaccgtcagtcatctcgatgatcgcttggctgacaggtttgtccccaagttcttgtggattgatgaagtgcgtcacaccgaacttctttcctgaaaatcaacaaaaggtgttactaactactagtataaactaggacatcgaccaaaggtctgaattgtaatcaacattcagaacagtttcatgagcagaagggcttgccaagttcatgtttctcagggttcaaatccacgccgatgatcgttgacgcaccgcaaatcctggccccttcagctacctgacaacaaaaatacttcactataacatacgtacacttcaatattgtacaccagataatcgaaaattaattaccgctaatcctacggcgccgaggccaaagatagcaaccgaagaccccggctcgactttagccagcttccacgctgctccgacccctgcaacgcatgcacgcgagcgatcgtgagagaacggcaggtatgcctgcatctctgccagtgtacgtgccagcagtagactagtaggacgaaccggtggtggcgccgcagctgaggagggaggccgtggcgggcggcacggcggggtcgacgcggacgacctggttggcgtccacgacggtgtactcgctgaagctggagacgccgaggaagtggtggatcggggcgccgtggcggtcgcggaagcgggcggtgccgtcgcgcggcatcccggggcgcaccgcgaaccggtacgtggagcacacgttgctccgctccgaggcgcagtccacgcactcggtgcactggcccaggaacgtgggcaccaccgggtcgccggcggcgaacccttccacatgctcccctacgctctccaccaccctgcagtttgtcactccgagatcgatcaccttgcaattttcatacatcttcgtatattttggcaaaacgaaataaggggaaaaaataaaaatataccattttttcaccgattttacataaatatacacgtgtataaaggaatagcagaaatataacattatcgtagaatggaagtgcgaggtcacacggtctcgggcggcatcattaaccgttaattaattattaattatttaactagcatcattagtaattaattaatcactcaataagactattaattgtgccattagtgtcattctggccggtgtcgctcaaggaacaagcgaaaccgaggccttcttgcaacggctaccagcgaagaccgagcggtctcgtattctcacttgcgagagcgcttgcgtcatcatgccatcatcgctatcgcactttggggttttacaatttcgctgcgatttcgcactattgaaccgtaacgacggtctattcatgcaaatccgtaatctcgtatatttctaagaaatacgatctattcgtacaaatccgtaatcttgtatatttcttaaaaaaaaaccttcaacattataatttcaaaaaaatattcaacgaaataatatggttgaaatgttaaccaattggttttgaaattttagatggttacataatatgtaaaatcgaggatttacgtagacaagtgtcatactcgtgctttgtaaggggatctaaaagaatatgaaaaaatggttttatgttgatatggatgattatgaggttcagtttttgaaggaatataatttacaactttagttttttctaccttttttttctaatgaaattatgaaaactggtggtttttgaaagcgggtggctggtggctggacttacgtgtgcctaccttctcaagcacctgatgccatcgatcttgtatgttggttgttggattcttggatgcacgcgcagggcttgacaagcttggcaagaaggcgtttgatgcggctttttccctgttatgctggattatctggaaggagctcaatgcgcgagttttcgaggtcactagtaagacaaacaacgaggtagccgacaccattatgtaggaatggtggattgttgggcttggcgcaccgatcatatagacatctgtgttcgtttctccaacaagagttggaagaaatttaggatgctcgtgatgcgctttttaaactgctaaacgtacgcttcctttgattttctaagaaaaaaacaaaacatatatcctttgattttcacttaaattggtgggtccaatattatacaccgttagatgaaactgatcttaaaacaaactaaaaaccatgggtcccacctattctctcctcccgtgccaaatacgtacgcttcctccccctttttccttttttcttcttttttccatatatatatataatggatatattttttaaataatcataattttacaaacaaagaatctaccatcatataacttaagccggtgtactctttactttgtactattattttcaaataatacactattttaaaataaattttacacaattatatcgtgtacctatcaaataaacaatatttatatattaactaatttatatgtgcacttaaatttatgggtccattatataaattatcggatctacattttattacactggtctattattctcaagtaatgcactattctaaaataaggtatacaccattatattatgtacccattaaattaacaatttaaaatctatattaactaatttacacttacactagaactggtggacctattattataatcatcaaatctattgtttgctaataaataaagcgtccaaaattctctttttgcccgctgcacattgcacgtctgcacctttgcctttcgcacgtattacaaagcataatgtctgagacatctaaggtgaacacaaccgttatagcgctaccgctttgccacgtatcaaatcatatatggagatgattaattttgtaaatgacataaaaagaaaattaaaggtgtgatgcgacaagagaataattaagcaccatgggttgtgtttttctctacactaattagctttgtttaagttgaaaccgagagttgattacataacaactataacgtatttgtgttatgtcgtatttggattttgtactatttgttcgtacaggtgaaaggaatcattatgttataaatgtgagcacaatattgacgaatatcaatacaaatcttactacgacaagggtgataaagggagtttaaggccctctcttttttaccgattccatattttggattttagtttgcatgctttacaagtttctaagtgtcatctttaaacaacattctaactttttagaagtcaatccattcgtttataccctcgaatagctatcacataaattatataattcatcaatttcagctatcctaaaccttaagtactactccctctgtttcacaatgtaagtcattctagcattttccacattaacatcaatatgaatgtgggaaatgctagaatgacttacattgtgaaacggaggaagtacatatttttttcatgcgagccatggtgatcaacggatcatcaaagtcgtaagatgaatatataagagttgctcttaacaattgtaaataggtgtcaaaattaattgctattaattagacatctaatggcttgctagccacaaaattaatttttctctacatgtatataaacatgaatgaagctggaacaaatattaccatatgtcgcatacatatatattgcgcagttaatattctagttagtcatttcaaattccttaaaatgctcacaagctgccacgtggtgctataataaattagggcaaatattagaaattctaagaaaaaaacaaagtatatattatttgattttcactcaaattggtaggtccaatattataaaccgttatatattaaattgatcttaaaacaaactaaatactacgaggtcccacctcgacataggtacgcacctacgtgcacgggtacatacgcctcccctcccttttttcatttttctctttcttattttttcccatgcatatgcttcccttcctttattactatatcatgcgtcttcatgagacgatttaatcaaaagaatttttagtatcttacactcgcattcttaatttgcggccatactacacggtatgtatatacatggactgtatgataattaactagcaatagtttcttatttactcgagaaaaaaaatgattcaaaagtcgtaagtacttaatccatctcttactcaaaagtttgtgaatggttttctaagataccttaagaaatatacaacccttaaattattataaaataacattatccaaactttaatttgccctgaatctatgagataaaatttctgaacaaacaataatcttacttttcaataatatataagtgcccgcgcatacgcgcgggccaccttcctagttattatatactaaaagtccatgaaacttcctacaaacactcctaagtcaccatgtggaagtcctacaaacactcctaaaccgatacgtggcactgtaataaacagctagacccactatttttaattattattagaattattttttttgacctgcctctcctatcccccattagcccacatccacgcatcccccactggcccatatccatgcacgttcatatgtacttaaggagaaatacctaatcactatttgccaaataaagcaaaaataacataatacgtatagactattcatcggggaaaaaaagaacatatatgtatgcacgtttgcacctactggaaaagaagctatcaatccttacccctttattttcttcaattgttcactttttaaaactttataaaacataggatatttctccttccctcccctcacctcctctattttttttaagtaacaacatcatataaaaaatcaatagttagatagcttgatgatcataattggtagtctattaaacttcctattaacgcttctaaaccatcatgtggtaccctatgaatactgtcgagtaatcacatagcactctaataaaacggagaaattcgaccgcattgaaatcggtgaacctattatttaatcgctatatctatcttgaaaaaatcaccctccgttcatgactccgtgtggcttctcacatatgtacctaacctaccctccctccgttcttttctccttttcttttatttccatgataattaaaattattttttccttattggcctaaaaaatccataggtagacatcaaccttctaaatctagcaagctcttcctctaacttctctttatatagtatgctaaacatcacacaaacgtttctaaataactacttggcactcttaaattagatacaatataaattagagaaaatagaaaaaaacattcgaccatcgatttctacttaaatcaattttaggtcgttagatctacatttctttttttttaaaaaaaatcatccagacctcactccgcgcccctatgtgacgccatgacagactgatcagatgtatgaagatcacaccaatgtctgataaattattttgttaattgcagaaaaaaaattaattgtgctaactttatatctactgtgcaaatgtgttctacaaacacatatgtacattgttcattattattgtaaatttaatagggggtaatatacttgcacaaa

SEQ ID NO: 75097 - DNA, 8163 bp, Oryza sativa
taaaaagcaaaaacatatcatccttgatttttacttaaattgatgaaactggatttatattatcgaaagagaacaaccagggcatccaccgttagattagaatgatctaactaatcagagcctcaagcggtcaagcccacgtcacctacccagtgcatgcgatgcatggtgtaaaaaaattctacgacatctccaatgattgcaggagatcgctgtcacggtgtcaagtttgtttgatgagctacactttatattgtatacaacacaactccaactttatgaagatggatatgtcccgattcatactgtattgtgctaaattgttcgttggctagaacaaactaacgtcgattgatatatatacttaagcatactcataaacacaggccatagatatatataataccatacataagcaacaaacaacttggagtgaatttgttttctggagagttcaagcaaacaattttacatgtgcaccaccgggaccgagggtggcacgatgcatataaacggaggtttaattataaggaaaaatatggagtataaaccacgtatattgcaaacctaaaaactatcatcacgagtaaaacttttacttccagtgtacctatgccatcttatagctatggacataataaactaccatgattgtttaaatgcctaattgtttcaaagaatgaagataaaatagggtaggtattgcaggcttcgcattgaagattatgcacaagctgcgtgaacacacggtgcaaaccaactaacacacacatacacacacatatctcactaaaaattgtagaaaaattattgtttgtacttttagactctcaaaatttatacatttatactccttagactgtcaaaatttttatcctttttattatacggctataaatttaaagtaatactttacacgtatgtgtgtaatactaaatgcctaatgcatgttagctaaaagaaagttacaaagagtgattgtttcgagtatataaattccttgaattataaattttagagtaaaaatttttaaatcatgacggcaatcatgaaaagtccacactacaataataattatgcttgcagatttatttttatctataaaattatattcgtagtctatttgaagtcccacgcactctacatgaaacaatgaactgtttcccacaatccaaaatcaatttgactcgactagacttttttcatttggaatacttattgtgtcacatgcaccaaggcatgcattaataaacaatgagaaaatgcagcatatagagaaatattagcagatacatctcagctacgcgatacaataataagttctaaaatatctagccaattagactacataacaaaaagaactatcaacttaatcttgataatcttccttttcacatgcctgataaggtttctgatctttgggatgagaataagaattgggatgctcagaaaataactcaaatttttgatagtgcagctcaacattcaattatgcaggttcagattatgcagggagaggaggaagataggctttgctggaagtacacaccctcaggagtctgttcagccaagagtgcttacaagacaatttacaatgaaatgtaccccaatcaaaatcaggtcagtaatttaacaaaaaatcttttgaaattaatctggaaacacaggtacatgcctcccagagtcaaaacttttggatggaggctgctgagtaatgctctcccaactgctcaaagaatgcaccacaggatcaaaaccgttagtcccaattgtcagacctgtggtcaaagggaggatgacttgcatctcttctttctctgtaatttcagtcgtttatgttggttcgtctctgactttaatctcaaagctgataatctttcttctctaggctctgttcaagatattattgcctatctttcagctaatggcatcaatatatacaatcttttaattatgctttggcaggtttggaaagcaaggaatgatatcaacttcaaaacaaagatttgggagccacaacaagtgtgcaatgctgcgcaggcaatggcaaagacatatgaaagtgttcatcaaatggaagaagacagttgccaagacttcaatcgggctgaggagaataatataagaaattctgttgttaaaattcctgcaggaacaagagtttatgtggatgcctcttggaaggaagagaaaacaggagtagggatcttcatccacaaccctagcaatcacaatgctattgtcatcaaagctcaaagtctcaatgcaggaactcctttgctagcagaagctgaaggattatttttagctatgcaaattgctcgtcatcttcagctgcaagaccctatttttctctcagataacagtgagatagtgaatgctgtgcagaacgaggactacatacaaaaccccggacattggtctctgagaccaattatttcaagaattaaaaattttctgcaggatcaacaagttcgaatcatttggatctctagagagctcaacaaagttgcagatggccttgcaaagtcagcaagacaagctcagactaacagctgcttagcttttgattgctctaatatttctcacatttgttccagagatgtttgtcctactaaaagagctctttccttcactcctaatggagcagttaatgtaactcatgctttgtgtttctaaaacgctttcttttaataaagtgcatgagttctcaaaaaaaaaaaactatcaacttctatcggttgttggcaaacaataatataggcacaagtaccattattttcacatagggatttccaaccttttaattgtataaataattattttcatcacactactacacaaatggttcttgcgagcattcttttcacatgtgactcaaatgtgcagcctcctatatgccaagcatcttgcctcaaactcaaggttcatctttgaaaataacttttgcaatccttttacacataactattttatggggtgcttaaccagcaattagcattgaagcttttacacataaaactattttaatggagcacttaacccataagatagtattgaatcaatatactcctttcgttatagtaaaacatagctcattttacaacataatgatattttattctttcaatttttttatatttgtcttcatacaagtcatattaagcaatccaagagacaaaggtcaataataaatcaacaaaattcagtaaattcctatccttcaaagtagctccatgggtttctccacaaccttcatgtataagcctctaatgcggtttcaaaatcagtagtttttcttataataatatgattaaaatctatactttttcctaataaattattattttaagattcatattgactaggtcttttctttaaaataccatagagtctcacatattacagagaagccttaaataagatatgcatatttgatcaattaaaaagagggctaagcacgttggtaaaaaaaaattactagcaataaaagtttcttgagactttttgtggaaaaaataaacaatgagaattgaattaaaaaggaaaaattccttactttaatttcaacttattttgttaaaactatttccgaaacaaaataatatgcaagcctacgtgactgcgcgggttatgttcctagttattctagaaatattcaaacatttgggcaactcgtattctatcttggtgcaatgtactggcagtaggtcataggtcttgatcagtggtctaatctcatctcaataagtacattggtggcctaatcacaagaatgttattgtactcagacgggaaatcggcggcgcgaagaatagttataagtaacttacttgaatgtcagactctttaagttttaagttagcagtaggtgctaattagtactaactgctaaataatcgatgcttgtgccatagaacatcaaacctatttaattattaactgaaaggacaggtttgaactgattatatcgataggttggagtattaaactagtcgtaactcgtaatatagtccattgggagcattgacgttgaatttatttagccaacgtgttaaggcaggttagtagatggtatgtggtccgcacattttgttcagtttgattcgacgaatacaaaatgttgaatgaacatctcaacaaaatcatcagttcctatatataattgattttcttaagatggtgaatctttatttcgagatttaatactgttctgatgtagagctagccatttctattatttccaataaaatatcacggatcaatagccggtaacgttgaagaatatttgtggtgccttttctactcttctatctccattcattcccttttcacaatatattttttattgaacgcgtaaaaggattgcacgtcaatatattagaagaatagagtttttgttacacgacgcaatcggttagaccgacttatgccaagaaagggagaaaacaaaaagaccaaataaaaaggagaagagaagactactgcgacggctaaacacaactttaaatagcgggaaggggttagagccactaccctcccaagagaaccccaaaattagcaatgtcagctaaagatcatagatgacccttagagaggatggactcaaggacctctgagaccgaggacaacgcagagtcaaaaactttggagttccgctccttccacggttgccaagagaccaggaggaccataaaatcaaaaccggcacgaatatacctttttaaagagaaatttactattttaccacgtgcatatacattatcatacacatacgtacacatccatgaccatgagtaggtcatttttaacacacgctcaagagacatcagacacaggccggataagtcatattgctgaaaggttgcgacccgtttatatcaacaattttctacaccaacacgatccgaatgtcattttccgatttcttagtttattatggcctttttgacattcaggaaagcatcgtccctttcctactcctagctcattcgtagaagcatagaacccatccagaaaatgcagctatcttacgtcgttcttatcagaacacgggaacaagccaaacatactgcatccatatacgctcatgacattcaacatcatacatatgtttccatctttagtgtattgtttgactcgttaaaaatcgacggcctatagggacagcagagcagctttctagccgtgtaattccaattatttccacgccactcgcttgggccgatttttcaatgtgggccatctaaaaaaacataaaaacagtaaacaggagttgaaatgaactgacccgaaggcttcgtgcccaaaaatcctcgggaaaacgccggggaaatcctgcaatgtggcagcaaaggttctcgtgtcacaagttttcagagcaaaaggctcacacgttttcagagcaaaaggctgtggcctgctttagttccctaaatttattttacaaaaacatcacatcgaatctttaacacatgcatagagaattaaatataaattaaaaaaataatttcacaattatggaggaaatcgtgagacgaatcttttaagcataattagtccatgattgaacataagtgctacagtaactcgcatgtgctaatgatggattaattaggcttaaaagattcgtctcgcggtttctaggcgagttatgaaattagtttttatattcgtgtccgtaaacgtctttcaatatccggacaaacatctgatccgatgtgacgcccaaaaaaattattttcgcgaactaagatagtcctgtataacggttataaatctccacaaaaataccgtactacacatggggtccacacacgggacgttctgggccgtccgatcggtcgtcgacagatcagcggcaggggatcggactgacctgcatacgccagaacgtgacgtcgctgtggcagagcgaggtgcagacgatcttgatccggacctcgtgcgccttgggcgggtccacgacgatctcctcgacggccagcggctcgccagcggccctgcacacggccgctgctcgtcatcgcggcggcggcggcggcggcggcaacgaagcacggtcagggcatccatggtggtggaatcaaaccggaagcaaagagacgaggaaaaacgggctttggttttcgaggagaagatgaagaattttagccggattcttcttacctttgcaacggatgggttgggggatctgacccgccatggacgcgagagagaggagatagtaaagaggtttctgttggcgcggcgctctacttggaagggacgatgtagctcggtagtgaatgtctgaaatatataaagggagggagtgaggttgaaggcatttgtgtgcaggccgagagcttctaatcaaatggtacttgtattttgttttatgagagctttcagtttcttctaccgttgacgtgggctgatggatggtgtagctgtctagtctattatttttaaaataaacaaaactagtaggagtaggagatgtagcacatattactatatataaaccaggggacatgtcacatgctactaatacaaatctgggatataacttatgttcagattcatatctcatcttatactaaatttatttattttaagatggatgaagtaggcatgtatatctcatcttatactaagtttagtcaatttgccttgctactctcttttatgtttgttgacgtaaagacaaacaaattcatatgcatatttgttgcagaaattatggaagcggatgcgaggctgtatgcctgtatttggttcgtatttcaatggcaaaatctaattcgcgcgtgctctctgttttgtcttatcgcacgacacgctcatcggtcgtctgatcccaagcgctggtgcgtatgtacatggcctcgtgattcacggacatggcattatctagaggagccatgtgatgctctacgctacaccggcttcaaaaatgattttctcttaaattaatcatccgatttacgatccgattacactggtgtgttcgtaagaattgaatctttataataagatctcacatgattatattttgatgaaaaattagaaattacttttataatatatctaaattacttttagatttcactaaattacttcttagacccataaaagtaaattcaataaagcctaaaaataatatacatatattatagaagtaacttagaaaaaaaaagtaactttatcacgacattaaaagtaaatatgttatggaggtaaaaacatgagtctatatagaaattaaatttaatcagcataaattacatcattgactaaaaatgattataaaataaacaactcacaacatgaatgtatagatttcttttaatgccgtaacaagttacttcacttttgttttaagtaacttctatagtataggtaaattactttcaagttttattaaattacttttatgactaagaagtaatttaataaaatctaaaagtaatttagatatattataaaagtaatttctatttttttcataaaaatatagtcatgtgagatcttgttataaatatttaattgttatgaacacaatggtgtaatcggatcgtaaatcggatagataatctaagagaaaatttcataagaagaaaaaaatacatgcacttttgagtatactagtagcaactagatatgagattgaggtagctggttatgaccatatagagaacgatctcgttgtagacacgtcttatttcaatctattacgacatctcttgcactcttttttgatcgcccggttactcgtgtaaccgccagccgccgcgccaaaactggctcataaagaaacaaggaaaatagcatttgatgttaagattgtgtctgcacacaaaattagaaacaaattcatccgacctgagataatctctaaagaaacaaggaaaatagcatttgatgttaagggtgtgtttagttcacgctaaaattagaagcttggttaaaattggaacgatgtgacggaaaagttggaagtttacgtgtgtaggaaagttttatgtgatggaaaagttgaaagtttgaagaaaaagtttgcaactaaactcgcctaagatggtgtctgcgcacaaaattagaaacaaattcatccgacctgagataatctcatagaagtggtttgtgggcaggatttgatatgcgaaagacaggtagggc

SEQ ID NO: 75098 - DNA, 34212 bp, Oryza sativa
tatatatatatatatatatatatatatatatatatatatatatatatatatatatatatatatgtaaattaactggtgctacatggagtatgggctccaagattcaaattgcgtatatacccaatttgaatgtttaaatgttttttttaaatgtttagatatgaatattaacttctttactaacaagttcaaacaagtttgaactgagtttgaacttttttttttagattttggttctagatatataacatctaaacatataattcgttatgtatgtaataatgaattgtgaaatgaagttgagtttgagttgttttgttgttaggtatttgtatgaattaaattcatatacctagatatctacttacaatttgtaaatttttaaaaatttgagagaatttgtgttttttataccttagagcccggacaccataaagtcccctatggatatcatatatatatatatatatatatatatatatatatatatatatatatataacacgatcatgctacgtagcgcgacacacagacgtagcacgctaggaaactacgtagcgcctctcacaggagcgatctcctcctgtttttccgtttctccttcctccctttctgtttctgggtttttcgtatttttcctcccaccaagagtgttttccgtttttttcctgcacaactgccacccggtctccacgtgccctcctcaagccccttttctcactccatcagttcacacggtgagtaaaaatattcttgagagaaatcaggttcccataatcagtaaaaaaattccttaacaaaatcaaaccctctttctatgggcaataaaatttttactcctagagtctccataatcagtaaaaaaattccttagcgaaatcaaacactctttagaccgacagtaaaattttaactccccaaatcccaataatcagtaaaaccctctttggacgggcagtaaaatttttactccccacaagttcagatactcatcaagatcacactctttcgaccgatattaaaatttttactcccaaatccccataataactagtaaaagaagcgaaatcaaaccctctttagactggcagtaaaatttttactcccacaagttcggggctggataatactcatcaagaccaaggttagtgaaatttttactccagcatatttcttacatcattggcgttcatagtaatatttttatcacatatattttggtaattcttttactcaatctgttcgtatggagaagagaaagagaatttttttcaggcattaacatatgagaaccattatcatttttacgggacatattaacacatacaatcaaaattagggagtattacattcaatcatgcatatgaaattatcaatcacacaaaatcttctgtgcgtaaaaaactacagaaacaacaggaggaaaaaataacatctccatccaagggaggagaggagacacagcagagatgttgatggcatgaggtgctgacgtgctgcagcagttggcggcgactactcgagacagatagactagcagctccaatcccatcccagccaccagcagctgttggcatcgaagcaggagcaaggcgacagggctccagtttagccccgcacaaagcatggtcggggttggactcgggttcatctgccagccagactacgccgctgtggcctagagcaccgccgcgcgacgtccaccatctccccgtcacctactccttcgccgttcctgtcgggataggacaaggcgctggatcccacaccggggaggagtttggcctgcaaatccggcgcagccaaagctcaccagcaccttcatcggcctcctcaccatcctcatcgacagcggcctagtccgcctgtaagctggtcaccggggctgacgtccattggcgcaacattttcctcctcttctggcttgaacgcagcctacgcacggtgagcaagaagaaggcgacctaacaccaaggtcctccctgacgattgatccagtgccctgcttcaggaccaccaccacagatcaaggagcgcgtcctcctgatccgccctcctccacgctgcagacggctgctcatcgtttgaagagctgttggagtagttcgtcgtctcctcacccgccgcccgtcgaccggtggcctaagccacacagagggcgagcaccgcccgtcaccctctagcacggacagaaccactgggcaacctcgtcggtgcgcgtgctggtcaccgaccgccgtcaccgaattgctgccatggccagccacgcgctcagatccgaaatacccggagagagtaagaaaaaataggatcggatatgtgattggttacaaggtgagaaaacaacatacatatatatgctgaaaattgggtaacattaagttaaaagtttactcggattataagcgtgggggaggaggcgcaggggtaagttaaattttaactacatactgtggactgggaggagggaggttgcaccagggtggtggcgctgtgtcgctccacctagttaggcagcgcccatagcgctataatatatatatatatatatatatatatatatatatatatatatatatacacatatatatatatatatatatatatgtatgtatgttaatgaatctaaacatatatgtgcgcctagatttatgaacatctatatgaatatggacaatgctagaaagtcttataacctgaaacgaaggtagtagtaagtaagaaagaaaatcttacaacttgtgtatactattttatcacacaattttctcgcggcaacacgcgggatatccatcttgatcctttagtttactagtggtcaaagattttttagccacataaattatgtcatgtcatatgtttgttataaaagtttaatacactctctgtcatggtcatggatatcacatacctaatagtagttgactaaacttggcagggcccaccacatacgatatcttatacgaaaacaaatcccgtatatataaggagttccggataagaaaggataaatagagttctatatagaaacgataaggactactcggattgtatccatatttatctccctagttttacttggacaaggaggcatctatgggtataaatacaagccctctaaggaggagaggagatacatcataaagccacaagacacacccaccataggcgcacaatacacaagccaatatacgccaagacaagtcgtcgcatatcaacatcagagataagcctagacatatcccatccggtgcctacggaagccgacaagagggatcaagtgccatctctgatctcgacgtgttcgtacttcaggaggaagactaccctgtcgtcgactacgagatggttatctagccgccaaatcgacgacaactagataggttatcccaaatactgtatttgtgtgatccagatgaataaagagcaacaccggcttcggctaacaggatgtagggctattacttgtcagataaggggcccgaacatgtataaaaatccttgtctctatctcttttacctcaatctcgcacataccctagtaccaacgatctccataccatcaaataacgtagtcgcggtaccaaccgttgacagcggtgcgccaggtaggggaatttttggtgcttcaaggtttcaacgacatgggttcaagagatggattctccaatgacaaattactcgacgacttcggctgtagggaaatctaacccgaccggagtatgtcccccgacgagatcgggaccatcgccaaatattcgatccgtcgagatcgaccaatatttaagatttcgtcacagcggaaaaccaacagtatcgacgacatgagagattgatccaatatgtgtcggtcttattcctaacagggtgtcctcggacacgttggcccgattcgtaccgagatcaaacgtcgcgctgctagctggtgcaaggcattggcccgctgagtccaagctggacatgacatccactatcatcgaccgagtacgccgacggacatgaggatacaaaccaagagcatgcatgcatgcgtggaccagccaacatgcatccacacagtgcatgtgaaaattgcttcgttaagacatgtctatactactcggacacgtgcacacaaggtaattagtgagattgattttttttaaaaattaatctactaaattcgtagatatatccagcatatatctacaaagatacgcaatattttatatacaatttaccgtacctatttttcagatatatatacaatattatcagatcaataatttattatgtttacctagaccgtgttttttatacaatatttattgtgcgagtgtttccaatattaagccaaccacggtttaatactggggctcgccctacttttttcaagtataaatcatgcttgtttacggtttacataatgcccgatatttaatttgcttgttatatcctgataatactataactctagaagattcatgcagttttttgagtaaatactcgatattgtctactatattgtcttctagaaaatatttttcaggaacaattgagcactcgagtacgatgtggtcgagtacaccgcattatcgagaacgttctcgaaaaatgctgagttgtcgcacccaacctaccaacaaagaccgacgacttatctcatatatagcgttggctacggctagactatttgagaaaatattgttaacagataattcccccgcgaacgttgtcggcttgatcatccgacatgattgcgaacagacatccggatatgctataagttgggtatgtgagtcatgctggccacatgagatgcacatgtaataaccaactctagcgcccctataggtgattaagagatgcctaatcctagttatcgaccagacagttgtagcgacatctcatcgcctatcaatttaaattcacttgtggaccgttgaactccatctatcgttgtccaagactccatgcctctacggtcttacaccaggatcgaccaagtgagtacggcaaatattgataaaggggggtcgtggataacaagagaagtttcatcttcaggtgatcgagatacgcctacacctggtcctcgaccagtacatcgtagtgatctctcaccacctaaaaattcatcttcaggtgatcgagatacgcctacacctggtcctcgaccagtagatcttagcgatcttcaggtgaccagtagattgttgaccagttggttacaacaatctctcgacatctaacgcgacaatcaacattgccgtgatagcgacaaccaagaccgactagatcgccgttgtcaccaggacgacaacgtccaggactaatgacatcggaacgacaacggacaaggttaacgacatcacgacatcacacgacgacgacaaaacttgagatccccatacttctagagggctcgaggatgaggtagtaggtccaggaacggaacctccgactacggtaattcctcattgccttcgtcgtcatcaggaggcagttctcgcaggtcacgagaatgtcatccatctattactctggattcccttcaagtggtcgaggtactactacaactggttctctactagcaacgtagcgatcctcgtaccatgacttctaatggtcgaggtgcgactatgactggtcttccaccagtagcgtagtggtcctcgtaccatgtcttccaaaggtcgagttacgattacaactggtcctcaattagcagtgtagcggtcctcgcacctcaatttcaaacggttgagagactcctactcctggttctcgaaccagtaggtcatagcgatctctcatacctccacttcaagtggtcgagttatgactacaactggtcttcgaccaacggtgtagcgattctcccactacttttgtgatttgttgagtacaactatacacctggcctttgcccagtgtggtggtcgtctcatcatctacatcaacttctgtaagtgtttatatgtgcaatatttgtccgatgatcctcttttcttatatctcctcgtcttcgaagtcggtcctatcgtccctttacactattctgacaagcctccgagaaacctaagggaattttggctagggacgcccagagtagataaggtcttgttggattatgagagccgaacgaccatgtcaaacctggtcatgtaagagtgctcaatggacgcgtattaacaaggccgtgtaatcggaaattgatttttccaacttcacagctgggggctaggatttgtcagcttcagcatggtttgttataagatttaagttgtctctgtggaaaatggctttttcataaaaacaactaggggctaggaatggtaccaaactccgattgctaagggtgactctagcgagagtactcttttatcgtcacatgcagattcaatttattttcgatttttctatacatattatatcatgttacccttgagtgttcgctcgagggctatttctatttaatattctattttgagtattgattttaggaaagttctattcaatattgtcgaagactccgtgtctctacggttctacaccgggattgactaagcgagtatggcaaatgttctgagtattgatttcaggaaaattagacatcaaaataatcaagtcagatttcaaggctctatcgtagattctatgcctactcgattactcgagaacggttgattgggctcgacaaggaatatggaatgaagcgatggtctacccaccgagatggaatttcttgacttcaatccaaattctcgattacagcaagacaagaaacttagtcgcatgctctgtatcttctcggtcgacatcggagattaacctagacaaacctaatatagtgcctacaaaggccgataagaggaatctagctagccttatttctgatcacaccgagaacggtcaagcgatcacgacaatagttgttccaaagtcttcgattgagaaccttaactcgttcatttgcaatgaagtcgggggttactgtcatggttatggataccacatacctaataatagttgactaaactcggcagggtccaccacataccatgtcttatacggaaacaaacctcgtatatagaaggagttccggataaggaagtataaatagagttctatatggaaacgacaaggactactcggattgtatccatatttatctccctagttttacttggataatggggcatctatgggtataaatacaagacccctaggaggagaggggatacaccacaaagccacaagacacacctaccatagacgcacaatacataagccaatatacgccaagacaagtcgccggatattaacatcagagataagcctagacataccacatcccgtgcctacggaagccggcaagagggatcaagtgccatctctgagctcgatgagttcgtatttcagaaggaagactaccctgtcgtcgactacgagatggttatctagctgccaaatcgacgacaattagataggttatcccaaatattgtatttgtgtgatccagatgaataaagagcaacaccgacttcggccaacaggatgtagggctattacctgtcagataaggagctcgaacctgtataaaaatccttgtctccatctcttttacctcaatcttgcacataccctggtaccaacgatccccaaaccatcaaatactgtagtcgcggtatcaactgtcgatactctccataaaaatatatagtagcaatatagtatcagataaaatatgtcatagtactactaatttatatggacctcatctaaattgatagtgttaagatgtgccttattcaggacgaaggaagtcaagtaaaacaacgatcaaacaaacccttaaaaacgcacgcaacagactaacagggaagaagcaccttgactcgataaaataatataaataaattaaatagttattttgtttagagatgactggattcgaggcatacgtgatcaacaacacaacaccgtctttgaaagcagaaaagaagctggtacttgtttcttcccccaaggtcgcttgagcttatcgggatgcccgaatcggacactcctactggaactccttttcttttttctttttaataacgctcgaagatgagttggattattctcctctccgttcaaaaggccgtagtttcgttcgaattagctgtttggctcagcttattagcgccatgcgaatcagcagagtactaataaattattacgtactattataagtctgaaaacatttattttttcaagggaaaagcctgaattaccctgaattattaggtgactaagaattaccctaaacttgaaaactaaatatctttcactctcaactagtaatatcagataaaaacccctctgagcactgttttggatagttttaacttgaaattgcacacgtaacgccaacgtggcaatccagttagtaaaaaaaatataagagaaatccatggacacacttgtcatctctccctcaagccatcctctcatgtgctctctctctctctgcaatagctgcaatggaggtggcattgtccacggccttggttcgtcgtcgcctcgacggcaccaggggcgcagcggaggtcgagctagctctgggatggcctcaggtgcggttggtctcggcgacggcaaccagctcacaaagcggcggatctattgttcctagccccgggacgaatctgccgttcccagcctcaggtgcggcaggtctcggcggtggtagatctggtgccctcggccctaggaggggtggatccgctgccccaactttgggtgcgacagttctcaatagcggcgacgacgacgttgagtggcatggaaccggcaaggtggcgaagtcggatgcctactcctagctttccgcctctatcgccatcgtcaccaccttgtcaagttgctttctccctccgactcttggtttgcaagtggccgacgatgaccgagatgcgacggaaagtatggagacgacgacctccgccggagtgcgcatgtgatggctaagagagctactgcccgcaacatcctcttcacgcgtcacaactgtcgtcggagtgtgcctccgtctcccaccatgtgccggagtgcgccggcggaggccgaggagaagttatgcggtcgtagaggaggcgcatgccggcggaggctgaggaggacccgcctcccccgctagtcgcccccagctgccttcgccgctctagctcatccgccctgctgttgtgtagtgtcgtcccctgccgatggacagactaggagggaagggtgaagagagagggggtgagagggagagaatatgacatgagggtcccaccatttttataaaaaaaaagtgctgactagattaccacatatagagctaaaaccaactaccacatatagagctaaaaccactccgtattgagttaaaagggttctgcatctagtattaatacttgacggtgaaaattgtctagttttcgtgtttagaaggtaattcgtacttacccaatagttcaggggtaattcagacttttccttttttaaaaaatgaacttctatatacatatatttttaaaaatacatttaaaaatacattgtttagcagtatgagaaatatgcttatgataaacgagaaaataggtgagaaaataatctgtttagaattcagcctcagagaaaaaaaatcatttggtcaggagatcttatttcatgattgataaatgtttttaatgaaataaacacctgtatatatgaatattcgtggatataaagttgatgctttagatttgtcctaccttatgttcttatgttttcttgttgctatgtcatgtgtatcttttaaacgaagttttcaactttcttgtgttcttaatttctatagaaatttaatgagtatgacactttattcttgtgttttttgtttttacaatcttgtgcttcaaaggagctgtatacgagattaggtgtagaaaaaaaatgatgcaacactataaattgtactacgtagcaactactaatatggcatttctacacaaacatgccagcaaactcacgataaaagcatgtgcctactcttcaccagattccgccattaaatttagcgtaaatattatacgaacccacttacatgacgcgcgagtgtgcaagcaatagttcaaaaggaaaaagaaaacttcaaaagttttaaaacatactgtaggagtattaatcattctaaaagcatttcaaatcaaacaacaaacaaaatatttttcatccttatcaagagaacgcaaggacaaataaattagattcctctcatattgccaaattgtccaaaatctggaccatgcatgatgcgaccaccaccccatcagcccatctgatagcgagcgacaagcaggacagatccgcgcggaaaatcccaaactcgcccgcccgcatgggatccaacccccaacctgtgatctcctctactctcttctactccgttctataaaaaattcaatctacataaaaacttattaggatttattattgtacgaagtattccatcatgttattaaccttttatgggtctaatagaaaccaatctagataaagactcatttaaacaattacatttattgtgttagaaagtattttatcatattattgattttctatagatggaggaagtactcccatccagggtttcccaaaccgtcgaggccagggttaccgtgtaaaatttatcaaaaattcaaattattttttaaatttatttaaatttcaggaggttattatggtatttatattaccgtactctatgataaacccgataactatggtaaccgcgcggcagtaaaggaaacctgctcccatctactccacggcctcactcactgctctgctctctctccccgcggttaaacttaaagctactatcgctagcgctttgccttggctaccgtgcctcttgacaaaaaccaaagcccaactactccccagtccccactgctgcaatgtctgctcgtgttctgcggctgttacggtagtttaagagcaagtttaatattatagcctattactggcttcaatttatctatagctaatctaatagctaattgatataatagttgtttactatactattaatatatggtcccacctattatacacactgtgttttgaaatccgtgctgcagctggctacagatctctagcccatttctcttctctctcatcttttatctaattaaaatatatttatagctgactaatagtctgctattatacctgctctaataactttgttttactgctaattataatcaccagtagagagaggggggaggaaactgtgatctctggtctccatcttttagcaatagtacgcataatttataagtaaatattttatatgtatgttatgatttaaatatcaatattgaaaattaaatttatataaattcctttttaaaattcaaaatttgacagcagctgattctaaacgaagcaaatcattggggcctctgaacagagtgacaatagtgtgcaactgttgacgtactagtagaaggagagtagtaccactaccgtggtagcagctgcttaactttgcccaccggccaccgttcaggggccattaatggcgtgcagggccgctgctgctgctgcttgctcttgctcttgctgctgggtggagtgagcgagagatcccatgtggcattggagcgctgtctcctgctgctgcacagtctactctcacctgctccgcctctcccctcgttaattcttggcggctgtgtggcgaggaagaagaagcggtgatggcatgctgatgggctgcgggttcttggatgcatttgggtggatatgcggacatggtggtgagttcgctgcctctcgcgcttctctgagcctgtattgattttagaaatttcttgtatttcgttctaactctagatggcattgatgctctgcttgcttggttcttgttatcttcttgtactctgtgtatgtgtgtgtgtgagagagatatttgaactgaagattctgcagtttcagattttctttggcctgtttctctctctcccccgagcggtagccattctctctttcttgttcttctgccaatttccagctgtttccagtagctggaaacttcgaattgcttaaagttcagttgtttgcttgctatgacttcgtttccccttcaagtttcactgcatttcctttccagtttttccttcaaagctcggatttgtttcttgcctcttcagcattcttttttccggcctcgattttgtataaagccgtttgtttgtgtcaaaatgttcaccaatatgcctttctcatgagcctcatctgttcggtttactgtacatatgctcttaatggtctgtcaatagtctgtccagaatgtcattttctatgtcgggaccgtacagatttttaaggctgcagcttccatattttttaatttgaacaaatgacaactactgccttgttttttctgttcaatctggagtaaaacttgttcgcgatgttcttgcatccggtctccaaattgtttttttttttttggtttttggaaataagtatgattcagtcccgtggcattcacatcttgcttctccttagtttcttcattgatttgggctgtaaatttaatctttttcctttgcaggaagctgtaatttgagagcgatgggagcatcttcttagggatcctcttccactggctagcctacagctgtttttctccttcattggtactccaatcttggctggaattttgaatcttttgtccgggaagtgataaaatttagaaagacaacacaaccattggcacttcttacagttgtgagcgctaagctgagcctccaatggcgtggcattttactgcggctttcatgatcgcaacctgtttgatgttattcccaagaagcgagcagtcctcgcagggtgaggtgctgcagcagctaaggaagcagctggagtacccaaggcagctggatgtatggaataacccaaacagtgacccctgctacacccagcctacttcggtggtcaccgtggcatgcgaggggaacgccattacagagcttaagattatcggtgacaggatcaccaagccaccaaagttcagtggctatcctgtctccaatatcaccctctctgaagcctttgttctcgattcgtttgttactacattggcaaggttacctgccttgcacgttgttatcctagtatccttggggctatggggtcctcttcctgacaagattcaccggctgtcatctcttcaagtgcttgatttgagctccaatttcctttatggatcgattcctccgaagctgtcagccatgccaaagttgcacaccttgacattggatgggaacttcttcaatggtaccatgccggactggttcaacttgtactcgaacctcacggttcttcgcttgcagcgtaaccggttgaaggggcccataccagcatcaattggtaaagctaccatgcttagtgagcttgctcttgctggcaacagcatcgctggcgaggttccacaattaggcagcttgaataagcttgagatgctggacttgagggacaatgagttggatggggagctcccagagctgcctacagcattggtaacaatcctactcagcaaaaactcactcaagggcgaaatccctgagcagtttggtcagttgaaccgacttcagcacctcgatctctcattcaactttctcgtggggaagcctcctgaaaagctcttcgctcttccaagcatcagctatctcaacctagctgcgaatatgctcagtggatcattttctactagtttaacatgcagcagtacccttggctttgtggatttgtctacaaaccaactcacaggtgacctgcctgtctgtcttaatgttaatgtcaataacagggtagttaagtttgatggtaattgcttcagtgacgaccctgaacaccagcatgaaactaagtattgtcaacaacctcacaaggggagaggatcaaacaaggatgttggacttgtggtcactgttgttggggtggtgtttattgtgcttgtgctttctcttatattaatggcttcaaacagaagaagctgtcagagagttttagcagaacaacagttacttcaaaagcaaatgcaagataattcgacatcaggaatgtcaactgaactgctagtaaatgcaagtaagtcttcttctgaagaaattttgctagtaaatgcctagtttcttatgatatatggaatgatgtgctagatgtggatcatgtgtgcatcactgcatcccatgttttgagatccatccagccgattgtttgtcatagtcacagatagatacatcatacatgtagactatcctaatggtagatgatggtattggaatgaactccaaaatttatttccctgaataataaacaagagataattgtatttcctcctattgaaattctcctctccctcacttcattgcagggtacatatctcaagctgtaaaattagggacacaaataatgcccatgtatcgagcattttctttggaagagctcaaggaagcaacaaaaagctttgagaggtcggcatttttaggcgaggggtcaattggaaaggtctgttgccatcttcaacatctgtctgatactccgatttagttaggaatttaccgtatacatgagataataattgtactgcttttaacctgttaacagtattataattactccattttattagctctgcaagctagatagtttctgacaatttttcctcatactattttaatgtggcattttccttactcctttcctttgttttcagctgtacaagggaaaactagagaatggaaccctgattgccataagatgtttggcattgcaccaacgatactcaataaggaatctaaaacttcgattagatctactggcgaagcttcgtcacccaaatttggtttgcctcttggggcactgtattgatggcgaagttgatgaatcaagtgtgaaaagggttttccttgtctatgaatatgtacctagtggaacgtttccttcatatctttctggtaaggaactaaaaataaaatgaggaattaaagtcgtacgaagtgatagcaatcgaatttgtaacttgtggttcgtgaatgcctttgctgtggtaggctctagtccagagaagactctgaactggtgtgagaggctccaagtgctgatgaacattgctaaggctgtgcatttcttacatactggaataattcctggttccttatataaccggttaaagccttctagtattttacttgatgaacaccttgtggcaaaactgagtgactatgggctatccataattacggaggagatatacaaacatgaggttggtttgccatatcatagaatgatcctactcctcttcccctgtatttaaaggagtctcaattatagaccattctttattttaatgcccttattcctattggtttacactttacaggcagcaggagaagggcagagatgtgtagaagacaatggtggagaattgtaagtacctgcagaacttgtagcaaagtatttcttacacaaagttgcatacaactaataaatgatcagacatgctgaaagtctaatataatttatgtttttagggaaaatttggaggatgatgtgctttcttttggaggtattttacttgaagtacttatggggccaaaacgtcataggaaagatctctctgtgctaagtgagctggtatgttccattttgtcttttgcgtaaagataattaatcaaatatccagatgatagttataataatgatacttcgatcaatatcacggtgatacatagctcgagcgctgtctggactgggctaatttcatgttgtattaagctatctatcaactcaatacagatattttgttggttgggtatgaccgtataactttcgtcctcattgtgctctgcaatccatgatatcataagctgaattatgacaccacacactaataagttctgagtatgaaatgtatgtttcaagcacttctgcttccctgcattagcccaacaaagagcattacatgcacaaatattaggagcaatgttgcttgcagagtaagaactacaaattttaatatccggattaatttggcatgataaaacttcaactgataggatccttagctctctaaaaccctacatgactcatatgctctgatcataccagaacaatcaaaattttacctgtatctgcaggttctgtcaatatcaaaacaggaagagcgcgagcaagttcttgatccggttgtgctgagcacctcttcgcaagattctttgtcgatggtgatttccattactgtcaaatgtttatcagttgaatcttcagccaggccttcgatcgaagaggttctctggaatctgcagtacgctgcacaagtccaggcaatatctgatggggaccagagatcagaagtttcctcgcagacctgttaggctaactgaacataaaacaccttggaggttattgtccatatctgggaaaagacggcgccgcacgtgcaagctaatttgatcttggtgtgcagaagagaatgaccaaactgactgatctcttcctgggagtaatcctgcatttgctgctacttcaacagcatttctgacacatcaacaagttaattaacatgtcaaatgctgtatgctaaacacagatatggtcacgttacgtcctgtaaagagttttttttttctcgattctagcttcccattgctgtgaaagcatccctatgagcagttcttgatttccaaacttccaatcgttgtattagggcattctcatataattaagtagtaggacgagtgatgtgatagcaaaattgatgagttgatagagaagggtatcccatgttagtgtagtaatgagaagatgtaattcatttgccacatgactcgtgctagtgcagaccaaagtgaatatgctccaaaactaaatttgggtaataaaatatggcctaaattctaatttactttaggattcaatgatgcaataatattaattccatttgttataaaactggtccgaaatcactatcgaaaaccaaacacgaaagaaacgtcataggtaattcaaacacgatgatcgcattgaagtacgatatttgttaacgagatttaaccgaagcctacatccctggagtgcttcttcccatccagcatttacagcgtattagagttataacaactatcgatcgaacgccgttggcagccgctccctctcactatgcgaactctaacaaactcctccttagcgaatatgccacgccaacatgaatttgttatttgctcgaacctccgtgtgccagaacttgagttggttcttccaccgctcatgctgagttggcccgacaagccttcaccaggatcaccacaacaagagactcccgctatccctgtaacttcttcctcttgattgcacctgcaacagtgttccaccctctcttatatcaccacaatcgtcttgctaagtgaaattgaatttctttctacctgttacatcatagactcctcaaaaatcatgttcaactacatctactgttttaaatttgacttgttctaatccatggccagataacacgcattgttaccaaatagaaaaatcaaactcactagacatgaagagaaccttttcttctttgatgtcttacgaaccgagctaattaacaaatccaatatccacgcttctacatagaaagtctcatgtaatatgttgccagaagttgtttctattgaaatctggagtcactgactccaaatcaacagaacatcttatgttgaatcccatatgagtactaagatcctttcgtgtgagatagtattccgtcccgaagaatcggaacgtaataccttcccacacgtatcgcaacatacagagaaatcgtacggtaagaaaacgtgaaccagagtcatctactagcgcgaaatcatcccaacatattgctttccacacagtagcagaatcaacattcatacctattttagcaagcagctccgggtcgtatgctcgcgtatgagcgaacacttgatccctgagaaggttgtaggcctgcatcaactgatctttttacaagtacagctcggagtcgggacaaaacgtcaagccttgatcctcatgcattgacacttggccataagattctgcatgtccttcactcggcacatcctctttggacgagcacgcactcgagctgtaggaatggtggtgtgagctcgatactgataggaactataaaatggaaggtggactgctgaagtataaaggaaggatatatgcaggtaaaacatcttaaaccaactactaagggcataccactcctcctttggggccattatggaatgagggccacttgccatagaatcaaaatgtttttttactagcctggtctcaagagggatgctgacaaaatggttagggaatatcgtatgccaagcgactaaagaagaacacaagttcatattccaggactcctcaatccttttgatatagttgacatggcttggtcacacattaccatgaatttcattataggctaccaaaatccagaggaaaggatgtgatatcggtggtggttaacagattgactaagtatgctcactttttggccttgtttcatcattattcagtggagcaggtggtggatatctttatatggatatataacatccacaaactacatgggatgccaatgggtatcataattgatggtgacaagatattcactagctgtatatttcaggaagtatttcaaatcaatgaatatgcagctgagattcaacgaaaaaaatttggaaaaatattcttctttttaaaaatttgtgtttatatacctgtatgggagggtttagcacaaatatacctaatttgcagattggaaacgcgggaccacaaagcaagcgcgacatggacatgcgggaacggcggatgcttcggtgccgcggagtgaaaacgcggaatagcctcggtcccgtggagcagaagagcggaaccacattgctccggcggccctgtcctgcggcagcgtggtagagagcggcgtcgtgcgggatagcctcgctcccgcggaaccgtggtgcgccaccgacgcggttcagtgtcccgaatgcgcgccatctttccggtcccgctgctccgcacctcggaagagcagcgccgctttggccggcatcgttaattagctcacaaattttttttcattgcttgttggagataaatccggaaacaaaatattaaactaagcttaggctctgtttgtttcaacttaagattattgtaatccagattattaaatcagattactctaagctggattataataagctgatatagaataagttgcgagttgtttgtttctctagattactggagacatctaagggtagtgggtctttagccactcaataatctagaaaaagctcctccataggagattattagattatactaatctggcttatagattataataatctactggtttgtttcggcttactcataataatccagattataataattttaagctgaatcaaacagggttaatcacatcaacaaattaagttaccaacggaggttcattagccagtataatattttcttattagttgttggagattaatccggaagcagaagagtaaaaaaaaaagcctaatcacatcaacaaagtaagttgcttttttttacggttgtgacctctaatccagaacgcaatgccgctcgtgctggtgcgttcccgcactactatgccgcgggaccgacgacctgccggccaattgcgtagagattgattcacggtcccgcatgatggttatgcgggaaagggagcggtgcctcacgacgggaccagatcggtgccgcatatccgggatgcagaaccgcgtcggtagcgcaccacggttccgtgggagcaaatcggtcccactctccgccacgttgccacaggatagggccgcgggaacgatacggtcccgctcttctgctctgcaggatcgggcctattccgcgtttccgctgcgcggcaccgaagcagccgccgttcctgcatgtccacgccgcacttgctttgcggtcccgtgtttccgaaccgcggattagatatatttctgctaaactctccaatgtagatatataaacacaaattattaaaaaaagagtgtatttccaaaatttttttcgagattcaatacaggtcacctccatgaaacaaattgttagacagaaagagtgaatcaatgtctttgagtcctatatgagaaatatgaccttccaagagccccaacattggtatttatggtcggcgttggctgagtggtaatataccacatatcatacaactatcgagatgaccctattcaaagcattatataggtacacccattcaattgggtgggtttaatatattttaatgagtctagtgtcttgcatcaaattacgatatttttagagtgtcctcaagaaaatttctttgtggtgtcccacagctaattacgcatttgagtgtcttggagcaaatttggtgtaatatataatatccacccaactgatgagagataaatcacataaaatggcagttttgcccttatcttcttctcccttctcatagtcttcttccgacgctcactcgcagtgagctccattggcttgtccattgtgaacaaccgctcggtgcagtcgatggcgcggttgcacatcatgccacaggcgccagtgagattgggcatcgccaagccggcgtgcatggtgaggtggtgcgctatggtgctgccgtccgagtcaccggtgacgaacacgcggccgaagtcagcagcctcggtgagccagccatcagcattgtccaaggtgtgttccctaatccagtggaggaaacccgtcgcatcgtcaactgcggtgggaggcggtgcttgagggcgaggcggtacctgatggagaacacgacggcactggcatccctcacgtggtcgtctggccggggcacggccaccacggtggtgcgagtgcaagtggctccggcagctgcgccgcctccgcggtcgcctatggtgttcggcgtccggtagcggtggcctcgacatgttgcatgaccatgctgagcaactatctaccatgggcaagccggtggagctcactgcgagtgagagtcagaagaagaccgagagaagggagaagataaagggaaatttgtcattttatatggtttctctctcatcaaattggtggatactatattttaatgcgtccactatactacagaaaattaccacacttttagagtgtccttggcaaattgatgtctttgtgatgtcccatagctaattgcaatttttttaaatgttttataccaaattttgcctacctaaaattgcagccctacaggcgtacatcatttggtatcaggggctctcttaagctgagattaaaattttatggccctttcacaattactaggaagattggacaggctgcttagagactccaacttcaaagggctccaatatacatcctatttttcatgtcagccaactgaaaaaacacttgggagctcatgcagttccaatggccaatctgctatctgttagaccagacggctggatcaaaactgaaccagttgttgtattgcaaaggaggatggtgctagaaggggagaagctgtgactcaatggttgaatctttggtaaatttatcaccggctgaaccaccctgggaagataccactgtgatccgaagtatgtttctacctttcaatccttgaggacaaggattgtctcgaggggaaggtaatgtcggaatctggagatgagaaatggactgaatatgttctgaatttatgaatctctgaggatgcttaagccaattgaagagaagaggataaggaaacaattcaggagcggattatgaagatcggacgactggtaatagacgaggcatattagttttgcatctgggagcttgctcgttgtcaggaaccactgtttacatttcattttgtcgcttctctgttttcctctgcttttaagctagctctcgtgtggaaccaagggtagatactgaatgtactataaattgagatgccttatggccaaggaatggatatgaacaaacttatgattatcttttatttcaaagtaacttagcttttgagccttttgtgtcttgcgtcatacactaaatttcatgcagtgggggatggcaagcagcagcggacggacgtgggtgacaacgagccatggtggacaattggagctggatctgaactgagggttgctagacgttgagccggcggcggctagctaggatttttaggattttactcccttgctcttgctccggtacaatatcaatatacagggaggagaaattgggaatttaacttttcctggagtttaatcctaaatggcatatcaattatatacactagtgatagaaagttactttaatacttttcatacaaactatctcatatatacccttaacatacacaatgctagacaactgcagtcttgtttctacgtgtggattgaatagaagccgtgatgcccaaaatatatgaaaccctaaaccatttgcaattttgatcatcatatacatctttgcaacattttctgcaaaacgtttatataaataaataaataaataaataaatgcaatagaacaaatcaattcctgatgttcccattcaacaagaaaatataaagccgtgatggtcagaacatgtgcaaaatcttacaaagagggaaagttaaacttgatacaaaactgagagcacacatgcatgcccagaaaggtgagtcgaccatgagtgtgtatataatcccttttgttcgcatcaatggcgcgataggtgaaagcgaggacggttcgtgaacttccgtccgttagctttgacataacgcgtgatgccaaagcaaaaaccagaccatagtagtgacagcaccaaatggaaaacatcattacgtgctgcaaggaaatgaatcaagttagtatgacaaagcatgaagaaggatcaaattaaacttgttggagtgaatttggcctagtgacttggttatgtatttgtttccacatagtaatatgttggctgcaaacaactcgtcaagtttacaacagttgagtgcctctaatctgcataaattaacttaaatcattgccatttcggtaggatgaaatagtacctcttctcagtgacattatcaagaatatcacggcagccaaaagcagagcaaaagcaaggcggaaggactgcaaatgaaaactcaagtaagttctccactaaaatatcctaatttaaatatggaaaaatattgtaggatcgtaaagggcctttcccaccccaaaagctagccattgaggtgaggggctcccccacttatatcttaagtccctcagcctttcaccgtgtatagaccccacagaacaggcccacggtccattaggtatacgggccccgcaggcacccacggtccatcaaaccttcacatactgtgtccatcgggccagagatgttaacctagccaggctctgataccaattgtaagaccgtaaagggcctttcccaccccaaaagctagccattgaggtgaggggctcccccacttatatcttaggtccttccacaaccaatgtgggactattcaacaaatatctccactaagatatgcataacgacattcaaatgcccatgtaactctatcaacacgaaagaactaaattgagggaatacatcaggggtggaaatcttcgcaggtaattacactgctggttaccggccaggagctccaaaccagttactggtatttccggtcagaacattatgagctgtatattttttgcagcattaagtgtgataaatactaagtcattaaaaaaaagcacgcattatccatgccataagttttaatacaaaattttccatcaaaaactggttcatggtcggttacggctggtaaatggtttgtgaattaaaaaaaatggatatagtggttttccagaaagactggtattcaaaaccttggtatggatcatagcatcaccgctgtcaacttatcctagtaagtagatggaaacatcaaaattatgcatagaaattcattgtaaattgcaatccttttaagcatgagaattcagaaccaagagtaagaacaataaatgcaattcacggtatgcaacttaaggattattcatctgtaaaaaaaaatctcaagtaatagaaagaaaataaccaaccgcgtgattctctataagtcctttggttggagttggcatatcccgactaactgaggatatgtgatgtccttgaagaagatccatggcatcctatacaagacaataaacaaataatgagttatcactatgccttgatccatcattaccaacgtaagggatcttttcttcactcgtccatgatgtcttggataaaatagcaaacctaaaatagcaaaatccaactcactccagcccatcaatggtgagaccaagtaagcaacatacctgtttagtaccatctgcaaagttgttcaggtaatatctagccattgcattccacagatcatttaaaattccctgtgtagttcgctttccgtacctaataaataaataagatatagttaggttaagaacaacaaataactaattaatcattatttgtttctaaagatccaacaaccaaaagaagaaatagatcatagacagcggattaatagaggaaaaagtgaaaacatgtggcaatgccattggcagaacgatagtattattttgcaccttatgtgatcatgtagtttgtcagtaatttaattataatactgcactctcatgcattagaactgtgtcaacatcttaggtgtcagctcagtcctgatactgggaagtaagcaactaaacataatccaacaagtaatttttctgatggtgacgagaagataacttttcacagcgagcaagaaataaatcagtttaaaagttgccattataaaggtttaactattgaggagattcacaacatgaaactagagaaaatgtttagcaggctaggtgttaaaggatcttacaagttacaaaacctttgcttcataaggaaacattagcaactcagcttaaacgtgcttatggttgcaatcaaatcattacttctttttctgaaattagtaggtccaaattgtgcaaaggaaaaggggctaaataagagaattcacaaaaacttgaaaacacaaattaccgcacaaagtctcccttcaaggcaggagttccagagtactgagtgcttattgcatcgccatggttggcccacactgaaaaagaagtcagcaattgtttaggaccagcaacattgtgagacaaatgtgggggacatactaacaaacatgtttagtgaatatcatatgcaacacttacaaactttgtaatctgcatcaaatgccggataatcgctgattgtattgttgtcaccaagaacactgattttttgcagttggctttccaatatttttctcccgatcatgctctgttttgtgtattaaggagactattgtagttacatacacattaaaaaaatggagaaggccaaagaaacaaagtaattgctcgagaaagacataaggatccccacacaactacaaatactttgaatgtaatattctagcccagtagttgctacttgctagtgatgtaacccatggtgtggtttggtgagattagttccacatggagcattgttgacgcccgtaaaatgctaaaagtgatattttgtactccttaaatacttatgaataaatgaggtattgataaatgctgtatttattttggcactaaccttaatgtatccacgagttttggtgtgtcaacaagtttttggcggtaagccggtaataagtgcatcaacatattcaagcaaaatcaggaagttcaaaaaaaatgcaagaacaatgccaggcaacgtatgcaacggcccaaccagcctagccaaccaagggatgcagtccggccggtcccaaaccaagcatgcagcctggccagcccaagcttacagcccagccggtccactccgtagcccagtcgatcccacaccgacataagttggctagccccacaagatgccttagctgctactccacctccttgtatgctccatgcagtgtgggagaaatgcctcatgccacttcattcctccatgcctggtggagatgaaacccatatgcccaaggcacttctaatataaatagggggctccactctcacttcactcgcccctcttctcgagagggtggaaacagctaggaaaagatagttgacaaggaaagaaatctcagagaccagaaaaatactataggccggaatgctaacactccaaatttgtaccacttcgatgattttttctccccgatggaataaaactcctatcccttcaatccggtaaaattctgatgtgatcttattatttctttctagtttactatttgttatctgttggtacctcgtctattcacactttatgtttatattatgcatgtctagttactctatgtttagacttcaatgtggactatttaacctattgtctggacatggtgcatggctatacatttacaaggaatgtgggtgacctagtactgccaacaacccttctctcaaatggatccaaactgaagttatccaatgacaaggatgaaacaacatatcatttattttttgaatgtccaatgacaagatcaatctagaatgtggtgatctgctcgcacattcttgtgtaacgaaggtttatgctctactaccaaccaaagtccatatcgactaaactcctcacgttgtgtagaagtgttaaacgaagatactatggtcagaaatccctcagtttgtacctacctaaactctatatgtgggactaatcgcaccaaaaccacagtccgggctacaagagccactattattgggcctagtattaaattcaccccgtgaaggtttgacaccatggcagtgcataactaatgtctagaaccacccctaggtacataaccaagttttatgacctccatgagccaatgcatataaccccatcaatcccattgtttgattgaagaaattaaattggaacaggattggttaagaaaaccttctctttaggaggtgagaattatgttctattttcaactttccattctccccgcatttttcctctacttctctacatggcaaacacatcaatctcattcaaggcagccacatcgaaaaatctcatccatggcagagtgcttcttctaggatcgcctcctctctattttctgtgttggttggatgaatgatgccttgcgcccttcccccacgcggtcagaagtctatcatatcacctttaaggcagttggatgatttcgcctccccagactgctccattgttctagctgcctccacctctggcacacgcaatgacgtcggcctccttgtccaactctaggacagggcactacggcctctccccatctggcgcagcgtgcggcatcctcttcactagcttcaacgtctcctcatagaccagagtcatgcatgcaccatcgcttttctctcaccggctgatatccacgcagcgaccagacatagcaaaagctatcacgtgcgaggtgggaagagctcatctagcaaaatttctggtacaacaccgttttgcatcttggtcgaatattctatcatgttggatgaactcgtcccggctcattccacttcgtcctaccaaccaaattcagggtgagggcctcgtccaaactaaacactatctagaagaacctaggagcgattatgtgatgttctgtatcttttgaaaactgcacttagattacaatactgtactaaagtacatcccattctttcaaaaaaaaattaaagcgatagttaccacatcagcaattattttgttagtatctagaattacatttcaaaatatcatgaaaaagctgtccttggaagtatgtacctgagttacattagtacgatccagacaatcgacacaatttgttctaacggttccggtctgctcttccattttctcacctttactatttaaaaggaagtacctatgccatacaattaaaaagactatgagaacaaagaaataatatgagtttggatgaaagggattcttttgggacattccttgggttttaatccaaattcctcaccaaatttcagctaggaggttttatataacatatgtgaccaaaagtgtcagatgcagctaccattttgccatttgttttcttgttgtgtgggaaaggtagatgtgaaatgttttttttttctcgccatgtagagatggcaacataagaacatagaaaaagaagcaaaatagtttgactaatgtacgataaatttgctttccctttgacaggaacagggccaaaactaggaagcatatagcaaaatatgtgtacgcttttcaatgcatgtatgctagtccctactaccaataattataagttataatgaaagaaatattaaacgaaacaagggttattaaacgaaagcacattactgcatatatgctatagtagtttggcaaaagaaggaactgaatagtaaatcagctacattattctctacatgaaatgcactgatttttcaaatagaaaatgcagatactcacacttgcagaaatgttaaacagagaaaaattctgtagaagaaaactcatgctaacatatactctaccaaatcaaatggcattttttgaatgtgtaaaatcacccccacaatcttataataaatgcaaagatattaagattgaaaaggtaaaaggtaataaaaaaattccatttccagccaataaaattttaaataatttgaataaaaaaataattgaagaggcgaagatccaacaaggggtttaaaagccggccaaggaccaatgttaaggtaaaagggtttaatccaaaattattaattattaaaccaggaggactttgattttttagccacaaacctaaggtttctaaaaatatcctcaatttgatcatacagttgagaaaggcgttcaaagtgaatatgaccacagatttgatggaagtcaaaatgcacaaatctgcaataattaggtttaatgcaattataaacagtaaaccacaatagaataactctagagtggagcaaaacttaccttatatcttcactcaagataggctcaattgattttgcatatctttcatacaggcgaccttcgccaccatgctgaatatattaacaaggtatatgataggtgaaaaatatcacacaggagtagaacaaactagtaccaccaccgcatattactagcatgttaaaaataagaagaggcaaaactcctaaacatttaactaattctagagcaaacaattatcgttatgtaatataagctgaaatgaactagttaattctatttcaaggaacagaatatacaaaatcggagataaaaatgcaatttatggaatgaacatgggacactattcgtcaaagtgaagaactcttttttctttttcttttttttatcttggttatggacatactgaactcagttgtggcagtctgcggatcatggatatctcctggagcctcttgctgtcacgcaaacaacacaccgggtttctctgtatgcggctgatgtggtcatgttcttgtgtcctacaagtggggacctatctcttatcaagcagattttggagtttttggtcagatttctggactaagaaccaatatgatgaagagctcttgcattcctattcactgcttggaagatgatctggaagtgatttctaatgagttgtcttgtaaagtgatgagcttcccttgctcttatctcggacttcctcttagaatatgtaaaccaaccaagacagaattgttgccccttgtggacaaagtggcagataatttaccatgttggaaagcctctttaatgaatagggcgtgctggcttataacagtaatggtggtcctctcggcttttatgcaatgatggcgttggatctctaagtgggtggtcaaggctatagataaaaggcatcgcggcttcttatggaagggaagagaaaacactaatggagaaaatttgtttgatctctttggatcgtgtgtgtcggcctttgtgcctatggaggccttggtatccttaacctagaaaagatgggatgagcattatgcatgaggtggttatggcttcaaaaactgattttgatagaccttgggctagtttatgcttttaagggccttcagacggccaattttttttccaagtgggtggtcaaactattatggaatgaagaaaataccaaattttggagcgataggtagctgcaagggaaaacaatagcaaaactggcccctaatctctttgccttgatctctaagaggcaaggaagcaacgtactgcggcgcaggctttggagaacaacagatcggtggctgacatacatggggagctatctattcaggttctttacgagtacatgaccatttgggttttggtataagaggtggttctgctacaaggtgtacaagatcaacatgtttggaagctaacggctgatgggatgtattcttgcaaatctacctatgaagcttatttcctgggatcgatcaagtttgctccttggaatcacatttggaagagttgggctcctcttcgctgtaagttcttcatctggttggccgtcaataatagatgttagacagccaaccaacttgctaagcgcggattgcagtaccccgcggcatgtcccctttgtgattaaagtgaagaatccgtcaaacacattttgatttcttgtgtcttttcttgccaagtgtggacggcactattcttgaagcaagggatatctgatgcagtgcctcaaccttcaactatttgttttttgaggtagtggagccaagctacaaatgactgtgttttcaatggcgccaatcctagaattgcggcggtcttgcaggtggtagagaatgagggtaacctttggtgtttagcaggggcatttgccctccaaaagtttcttaatggagcagcaaacctaggcagctagcgcttgccagtattggctggggtgtgtgggtgtgttttttcggtgagagtactctggttctcctactttgtatttttgttctttatttttcttccccttaatgaaatgaaacacatttctcttgctttttcgaggaaaaaaatgaagaactctcattctggtcctgcaatcaagacaaccatatgacacagcctagatgatttgtaggggggtgggtttgatgttgcaactgtgtgaagtatcaagatgaggccctggaccctgtggaatggctaaggatctatgatgtggttccagatggcaagggataggtgaaactggtatttctttcttcaatcatgcggcaggactttcatagatgaagttatctaaaaccactaacatctaatgaaacaacaaaatgacttatccagagatatgcataattaagaccagttttatctaaatatgccaacaattagacttctgaagactgtgtaaagtctgacaagctgccttgaggccagtcaacttgcacaccaatggtagggaatcccaacatgactgttatacatgacaaacagaatgaagagactggtttgggtccaagaattcaatacttactgtattgacaagatcaacagccacgacagctccatatttcttttgtaaatcatgaaaatgccgttcaagtacacgaggctgcagaaatcaaatccaagaaaatttatgacaagaaaagtataagcaatggctacattgcaaatacttaagttagatcttcataatatgtacatgaactgaaggggtagaaattagtggagcaacaacgagaaattagtagagcaacaacgataaaaaggaaaaaaaatcgtatgatgagagcactcaccgcctcctctactctgacaacatcaaaactaggtttatatgtcaaatcaacaatttgttcccacaaaaaaggcatagaacctcgaacctgcaatacacatcaatgtaacaaagttatcacagaatataaaaataaactgtaagccaaaataaatatgaaaggtgctagaaaaaagttgggaaaacctgcaaacttttagtgtcatattcaccgctagtatcaagatacaaataggaagacaagaaatcttttagcgtacatgagctgtgcatgattgactcttttttccttttcgattgttgattccaaagataaattggaaacaaaatatgaaggttaacataactttatgtgtatgcaaatcattattttttcaaaaaaagaaatgggacattgcatcatgtcaattcctcaaacggggacactagctcccctatgtgtcattcaattgagtgaagaaacttacttgcacatatgatgctgtaaattctttcgattgcattatctgctctgattcaacaaaatttgcagcataaccctctggatcagctcctcgcctccacatccgggtaccttcaacaaagaacagctcgtaaattcctaaacgatcattgacattcagtttccaaaaatagtaaaatagcaaatgaatacaaatttaccttaggttctaactacggtaacatttaatgaaaagaaaatggcgaataagcttttgatggttcgtaactcttacctatcctacgtgtacaccgacgtgcaatcagggtcacatttaccttctctgacccaacttctgcatggatactctgaaaacctgatatttagttaagttgcagaagttcaaattgacatatgaccttaacagaaaggtaacctaaatataaactatcataagtcatctaacatctcaggtaataagttgagatgttacgatgaggtgaaggatacttccttgaatgactggtagtaagtattggtgcagctgttgagggacaaaagggaaatcaaaattaattgtaaatattggtcacacgatccacagttaataacaacactaatcttactttgttctcaattagaggctccaacaagtaaccgttccaaagaaatcttggttctgcctgcaaaaggtataattaattaatctggtgcaaaagtaaccagtaaagcatcaaaagacttattaacatgtccaaagtgtactcatgtagtttattaaaccatttcattttctgcagaaaattcctcctatgccactgagcgttccttcaattccttattatgctcctgcttttgcactcacttaactggttatgtatgaaaatggcacaagagaaataaaatttgcactcaaatgacgttcaagaaatgggaagtatatagtggcaaataaggtgttgaggggtttatgggattttctcgcactacatgcatagggtggaggaggcaactgtgtcttcaaagtagtagaaaaaaaatcatgctcctatcacttttaccactaccatcaaactctattagttgattaaagttgttttggattactaccctacactgttttggtagtgctgaaacctaggcaagtttcagtactaccaattatttggtagggtccataggattgtattgatttggtttggtttgatgccaattatgagccaattctttgtaggttaagacagctttcgactgctgccaatttggacatgggcattgccaaaaatatggctccaacccaaatgcatcacaactactattcaagtggccaaaatattggaaggggtcttggtatcaaaccaaaacagtccttagtattactaaaagtgtggtcaatgacttaattgtaaaaaggtaataaaaataagcggtggattgaaaaattatttgcatatgttgttacaactcaatttttcattttgtttacggaacagttttttcagtgaataccatcaaacaaagttttaaaagatattcactgtgattgctaaccatgctatgacatgtttgtctttcatttgtatgtcgtagctagcgttcatttctatttccgattgtctttatgaaaaacaagatgtcttaatcatgacatgggctccatctgtgtgttctttcctttttttgcaccacctttctcactgtccctcacagagttataacatttaataagaaagcgtaaaataagtcaatgaacatttcactgtccaggtcattatagaatacttgcaagtttggtactgagtggccaatgcggtcttgctggatggtaacgttggaagttcacaatagtcggaatcgtacacgtgcaaacca

SEQ ID NO: 75099 - DNA, 6816 bp, Oryza sativa
atattttaataaaaaattaaaaaaaatctcgctagggacagagtcattgctatttatttttttatattttttagaacagggtcattgctagttgccacactgccagaatctgattggggcatatcatatcaccacgccacatgcgttacacgcctacacgagagtgggaccaaatcacgcatgacatttcccctcttttaagggtgtgtttaattcgcgaaaaggaaatcgttaggtatcacatcaaacgtttaatcggatatcgaaaggaatttttagacacgaatgaaaaaactaatttcataactcgcttggaaacaacgagacgaatttattaagcctaatgaatccgtcattagcatatgtggattattgtagcactttatggcaaatcatggactaattagattcaaaagatccgtctcgcaatttccatacaaactgtgtaattggttttttatctatatatttaatgctctatgcatatgttcaaagattcgatgtgacgtttttggacaatttttttaaactaaacaaggcctaatttatataagaaaacatacatacatacatacatacatacatacatacatacatacatacatacatacatacatacatacatacatacatatatatatatatatatatatatatatatatatatatatatatatatatatatatatatatatatatcatacatattctcagtcatatgaatgattacatgctcttatctttacgagtatttctgaaaagttagaccaacatattttgtaattaatgtagccatcacgaatacctcattatcgacggatatacctcgcttattcatacgtacaaacagactccatctttatcgctgcagatgtgaccatgaatgcactgcagatatgacaaataatgcagatgttgatatgatactagcagacacaaatgctagtagtacgtagtagtagataagttaaatataataaagatctgaaaactgaaaactgatcaataaaccttctgcccggtcggccggccggcccacattttataaaatcaaacaatatgtcttaattctctgatgtaagtatgtaacagaggcaattatatcccactaatttgacaaatacaattatatccctataatttgacaaatataattcactcctggtataagaaaaactacttcagcccgaggggctatatcggccagtgaggttgttttcttttctcactctccaaatgagatagtagcgtgaatgcatgatatacctaacgtcggtccaaaagagagaaattgctcatttgaccatatttatagacctaactactaattttatctcatattttctagtttgtttatttgacccaacttattcaaatcgacaccatctaatgcctgctgcgcctggaggatgtagtgattatggtggcggctgctgctgttggtgtgattgatgttggatgtgaatgttaattggatttggagaatgcctggagaatgtgcttttgcttcatttaatgtaatttgagatgaacaagacatagaaaatgatgttaaaattttgtatgtctgccataattatgccattttttagaaatagaagtaagaattgtcaaatttaagccaaatttatcaaattttaagcccaaattgttgaaattgtctaaaatatatcaagctatgccatattcgttacaaatatgtttaaaatgtccaaacaaaaataaaatttgatacaaccgggtgaaatgagtaagggtaaaaaagataattagtcccttagttaacaccgttatcttatctttgcgagtaaggtcagcctccattttcgattttgaaaaacatgatcaaatgagaaaacctaaaaaaataggatctaatttatagttacgctttaaaatagaatcaaataagcaattttctgaaaaaaaaaagatatcatctgctcggggtcggttgaagctgcttcactcttgctctgcttaggtatagtcgtgtttcagagttgcaggttcatgaagtggatcaaataattgacttactcttattttacactactttgttagggaaaatgagttgttttattcatcagggtgacaacaattttgtctaaacttccattggagctttattcggtggtagcaatccgttgcttacataatacgagtaactagcatttaggatcagatcacattacccgatgtcaaaattaagggggtacctgggcatttaccttactaccatgatttactagggtatgccaaaaccaaatccgccagggtaaggacaggttagaaacataggttgagatcagcatcaacatgtgcatgtagtcgtatattgccaatggcattataggggtggggcaaggatagagatggaggttgaaaatatccacatgtgtatatacctgtagtttggcggtattatatgaacaggatagatggaggttgaatgcatctatacgtgcatgtactaccaaattctagaaaactggaacacacaaggcgatcatcactttggccgtacatataagaaaagaatagagagacatggaggttgaatgcatctatatgtgtatgtactaccaaattttagaaaagtggaacaagaaaatgcgatcatccatatgtcagatatagcatttgaacacgggtgtggacaacttccaccgcaaagatcctggctagctgacctacactatatctcccaaaaataaggcctgagtttagttacaaattttttcttcaaactttcaacttttccatcacatcaaaacttttctacacacataaacttctaactttttcatcacattgttttaatttcaaccaaacttttaattttaacgtgaactaaatacaacctaaaaagaagaaaggttagcataaaagtccgagaaaacgacgtgagtgaacaggttgctaaacagtagtggtttgtatggagtgttttgatttctacttttatttggaagatgcatgagttctactactacctccattttttactatatgacatcattaactttttaatcaatatttaaacatttatcttatttaaaattattgtggaaatataaaataaattaagtcatacttgaaaaacatttgataataaatcaagttacaataaaataaataatatttatgtatttttaataaaacaaataattaaacgtataaaaaaattaacagcgttatatattagaaaacggagggagtactgtttcattaagcggaatagagagttttttttttgaaaacaacaaggtcctaatcaggaccagttcaccatgtggaggccaggcaaagcaaaagctagcggactccactacagagttttattcatgttttgttttctatcgcatgtattgactaaggataggaaatcaaacctaccacatatgggtgaaatcgattattcgttccatcatgattggggtaggttagttagggatctatttatagccacagaacattgccctggagaatacactgctgcagtgctgcttaagctcgccatccagccgcaatggaagatcagagcctgaagcccatccgttgcaaaggtacacaattcacttacagagatcagatctgcatagctccttggtactactactactactactcaattcctcacgcatgatatatgattgatacatatcgacgacgacgatgcagcggcggtctgtagagcggccagtgagccactgatcgtcgaggagatcgtcgtcgatcctccgaaagcctacgagatccgcatcaagatcatctgcacctccctgtgccacaccgatgtcaccctctggcacaaggtatacgtacgttcccccatctgatcaaaccatgtgaaagaatcacgtataatttgcttttataatttcataataggtagaccctgcctttccaagaatcttgggccacgaggcctacgggtatgttcgttcttccctgatgctttaattttcctcttcgccaatccgaaaattcgaattcgagaatctctaactatatctgtttgttttttttaagggtggtggagagcgtgggggagaacgtggaggggctcgcggcgggggacacggtggtgccgacgttcatggggcagtgcgactcgtgcgccagctgcgcggcggagtggacgaaccagtgcaccgccgtgccgttcaccatgggccccgggatgcggcgcgacggcacaaccaggttctgggacggcgaagggaagccgctcagcgacacggtggccgtcaccagcttcagccagtacaccgtcgtcgacgtcaaccaggtcgtcaaggtcgaccccgccgtgccgcccaaaatcgcctgcctcctcggctgctgcggcggcaccggtgagcctgagattcgcagatatattgaacctgcttggtagagccaaatcaatcaaaacagtttcaacttcacctaaaatgggtacggagttggatggaacgtctttcacaaaatgaactagatatacgaagcttggtttaaactatgagatttgctccggtcagtaaaaagtatctcgaggtactagtatctcacggtactaaatcgtttccgatcatttgatctagttggacatgatggccattgctagatccaacgattgaaaacgatttgataccgtgaggtaccagtacttcgagatattttttttttggactgaagcaaatctcttaaactattctacaactccacttcatagttcagactcaactcctgaagctaaatttaggatttgagttttaccaaacagttccatattttagcacgctacaaacgaattgggggagcctgagcctgaaatgccatttgcctgattgccttacctctgaactgtgcactgacattcattgcatcattgaatgtcgatcaggggtaggagcagcatggaggttggccaaagtgcaacccggttcgtcggtggttgtcttcgggctgggatccgtcggattggcggtaagctagaggtgaagcagtgtaatttcttactcggatacatgatgagttgacgaccgctgcaaatattttgacttttttttccaggtagtgcaaggggcaaaaatgtgtggagcaacgaagattatcggtgttgatttgaatcctaacaaagaggaagttggcaagtccaaattatttttcctgtgtataacacgcagtgaagaagaatctttgcattttctcacaactgaagaaacctctactttttgcaggaaaagagttcggtgtgactgatttcgtcaatccatcccaactcggcgacaaatccgtcagtgaggtgaggaaacacgccatttggcaccaccctacagaaatcatctgctaatggatccaaactcgtcagtgcacgttgttaattctgttctatcctaggtgatcaatgcgatgacagacggtggcgctgactacagcttcgagtgcatcggtatctcgtcggtgatgactgaggcagtcagaagcaccaaatcagttctgatctcaccacactgattcagacattcagtgatctaataatcgcgtgttaataattcagaggagaatatttgcagcgggaattaataatcgtgtgttaatgcagggacggggcaagacgatcattctgggggtcgagaaggacagccagccgttgtgcctgccgtccttcgagtttctgttcggcaagtgcgtcatgggatcgctcttcggtggggccaaacccaaaactgacatcccaatcctcgccgagaaatgcatgaacaaggttgcgtttttataaattcagttcgcggtttcagtttcagacgaaactagactcttcctaattgtaatgcatgtgctttgtgtgtgttgtgcaaatgcaaatgcaggagctggaactggagaagctggtcactcatgaggtaggcctgacggagataaacacagccttcgatttgcttctgcagggaaagagcctgagatgcatcatatggatggacaagtgatggccacaacttggggtggggatgcttttcctgttcaggttctgaatttggttgattgatgtgttcaataagtatgctgtttatttcgctggtgttgctgaaacaaggagtaatacactaatacgtccatcagccatcacgaataactgatgtacacttaatttcatgggcggttagcagcatcctcctttctgaatcaatgcagaatattttcattccaaaagaaaaggattatctttcttatggagtatgttcagatttgcgtgtaaagaactggattagtccaatcttgtttcttcttttttttttgatctcagtccaatcttgtttctgaaactgaacggtgaggtcgcactctccgggtctcctgtttcttaagcgggtaattttaccatttttaaggaagtgaggtactatatttttctagtgtaaaatttgatacctccagatactaactactaattatcttaaggtactaaaaattttagtgtaaaatttaggtaccttaaggtacttttttaaggaccttcaaactcctcttcttcagctgtctttagtcctggagcaattctacagtcttaaggaggtaccataaggtattaaaaatttagtgtaaaatttagtacctcatgttacatcatagtatctaaatatcaatatgtaccaaatttataatagaaaaaatggtatctcatggtaacttctcaataactgtaaaattactcttagtcctgtgcctttcggcgtgaaagcgtgtggaccattgataagatcgagttgatctccagggccataggccgaaaagttgaagcctaagccctaccgggctgcaggaatt

SEQ ID NO: 75100 - DNA, 63755 bp, Oryza sativa
tttgatatctggttcggtcaacgattgttttctttgatctgttccttccttctctaatctctctagttagagccttccacgacgggttgcgtttcgctctccaaaacgtacgatatggtattattgtattgcctgtttgtttgacctactggcggttttgtttaggtcacacgcctgcatagccgtggacgcagcgttccgcatgtattgaccatggctatctacagactacagatttcaagaactactacatcattttattctcttgtaaacaagagataaaagaatactaattaagaaacaacttggtatcaaattaatagaaaaataaatatataaatcatttatctctgctcacacctcccagcaggtcagctagactcaattcctatcatttacttgacatccactacactttaatcacaataaagctatgatgcatgttttattaaaatcagggtatagctgggcaggcatctgttcttgttcatccgtgaatgcgcattatcgatcgtgatagaggctactacctcctctaaataaatatacttctagcttttaattttcttccaaaatgaatgtacttctttatcactatttcttcctccaattacctcttattcaaatttcttcatattgttcactcaatctcgaactacacctcatttaatcagggacatctaaatcattttattcaaaagggttatataatggagtcagatcccgatcagagcatctcatttccatagtactgttattatgagcttaattaggaacattttgcatagtaattgtgtccatcaagtgtaagtgcacttatttgggaacggatgcagtactatctttcatgcttgcaaccttcctttgttattggcatattgcacagcgcacctaaacaacaaatcaagagtttggtaggtctgatcactgaattaaccttgtctctgttggacggaacagagaactgttgttgatcagtggggcgcaccagtaggacagtaggtgatatcaaatcagatggagctattttgttgaactgccctgcccaaccaagtaggataggcggatggagttggcgaaaatggcagaaatatctgaatccagacaacaaacttcatgccaaaacgagaggacaggagcaaagataaaaataattgtagataaccagtgggagaattcactggttcagcctaaaattaataggcgtaacaatcgatcaaaaaacatgaaaacttgaatagctagaatcactgaacatttaagaaattgatactgttattatgagcttaattagcattttgcatataaaaactcttttttttcatttggttttcctatttccggtgttgtcttcacgttgccatgtacgtagtattgtactgctatgtgcattattccataaagtacaatttgtcccctttgagagaagcacttcagaatttgcccaaatagatttacaaatccaaaatcaaaagtgtaagtatttgtagtggcaattaactggtaacttaaattaacgagcagtacaactggaaaattgtgatttctacatacaaataagcaaattaaatagtcaaaactataagatcatgcatgaattcgagaaatgaaacttataattgaaactatacaagatactgtacagatgcctaattttacacccgtatacactgtctccttatatttttctagctttacagagtaacgatttgcaatcccccgttgtggtcaagtacaaatcattgacaggttaataattataaacttctgctcgtatacatacaggatcccaaaattcttcttgtttttttttaaaaaaaaagtcaaaatcaaacacaaaaatacttgagaatagtttagagtgaaagccccctaaaaattttaaaaaaaaaggtaggcaagaataacaaccaagcatggaatttacgatccatagtttgcatgcggtggcggcaacgtttgatcagaaaaatacccacttgtgcgccgtcttctccttcatggtcttggaatggaagagatcgccgccatcggcgtcccctgattgccgccgcttctccgctccgacgagcctcgacaggaacctcccaatcttcttcttcttcccgctcttcttcctcttcacctcctgctgcttccccttaccagatgcctcccttcccggctcttcttgcccccctccggctggtttccgactaaccgagctcggcatcagcggctgcgagaaggcggcgacgttggcgaaggacgagccggcggcgccgaccacgtgtacggagctgacgtcggccgagagggccccgtagcagggaggcgagccggaggagtagccgctggattcggcggaggaggaggcgcgcgtcgtggtggtggccgaggaggaggcggagaggtgggcgaggcggtcgcggaggcagtaggggcacacgcccttggacagccggtgctccgggtgccgcttgcaccaccggtcctcccactccgatcgccgcatggtggcgaggcgaagctttctccgctgctcgatcgatcgctcttcctccgtgttggcttgctagggtttatgcgtctgtgtttggagacagcgcgcgcgtggcggtggtggtgaactggtgatcgcgttgttggtggcagcacgggagcagggcgggtaggaggagatgataagaggagcgaggagagcaaaggaaaggaaaaggaagaggaaagtttggcttgtaacttgctgcagaaggagtccggggcccgtgttctattgcgccagtataatttaatttagtaccatctgttttgttgtaatgtttgataagcatagatttggcttttttcttctttattaaaacctttgatctgttcaaccttttttaaaaaatagcaatatctatgtttcatattataagccgtttaactttttttcctagctaaatattgttaaatttaattaaacttatagaaaaaatttagcaacatttaaaatatcaaattagtttcattaaatctaatattgaatatatttttaataatatacctgttttatgttaaatttgcttaaacttaaataagtttgcctaggaaaaaatcaaactaatcgtttttgttattattttgatggaacaatgatgagtgcaatatcaatatgtgctgccgaaaaaaacaacttacttcgacgcttggaaagtagatacgttaaaaaagcctaacaactagtattacgtacgtaggacttgtttagattcaaaaaattttcgtcaaacttttgacttttctatcacatcaaatatttggacacatgcatatagcattaaatgtgaacaaaaaataaaacagttgcacagtttgcatgtaaattataagacgaatcttttgagcctaattacgctatgatttaacaatgtgatgctacagtaaacatttgctaattatggattaattagaattaatagattcgtctcgcagtttacaggcgaaatctgtaatttgtcatgatattagtctatgttaaatacttcaaatgtgtgtccgtatacataaaaaaaattagtacacaaactaaacacagtataaaagcatttcatgcgaaaatgatgaaagtaaacaccaacagtgaactctgttacagggtcatactgtcatggatcaggatcaggtactctgtctctgagtctctcggcctgggcgctactgtttcgtatcagactagtttcaaggtgcccattatttatttcttttcaccaccacaccagcctctgaaacacagattctaataattccaacctacaacaatggcgacagaaacaaaaaaaaaagaatgtttcgatacaacgaaagattagattagagctgccaacgcattcactgatccaaggtggtcaaaagaagcctgatttctttaactccacatctgctagagtgggatttggtcgtgactgccttcagactttgtgcaccccaagtgtaattatattatttcccccacatcgaaaagaagtaaaaaaaaaaagtcagtagaaagaaaaggtgaaaaggattagtgccacgccgcgtcggcctcttgtgggaggcactagtggcgatggcccgcgacagcgatgacgggcgggcccacgcgcagtggacaggagatgctggtagacgattgacgacgacgacgacgacggcgagagtgaacgggtggtgcgcgtcgcgggtgggaggagcagtcaacgatgtgctacgtactcctacgtgtgcctccattacgccggggcgtggggcgtccacgtccgcgcgcacgcgtgtcgcaccgcgtgtggctctcgcacgcgggcgttcgttttcgcgcgtgcttcgtacgttttcaggacgtgagctgagcccggtcgatcgtcctcgtgccacgcatgggttcagactttcagactccggccgcgacgtcgggatgggggcgtcgctgtggccgtgtgggacgcgctcgttagctctcgccgttttcttgcatgtgcagctgatgatgatcttctcccgtcgcgtcggccgtcggtgacggtgagctgtgagctctgctgatccgcgttgcctcgcagagcaaacctgcttgccgatgatgcagtgcagaagtggaggctgtcctccatccgctgatccgcctcctactcctagcttctcaaacgtaggcaggcatcgatacgtcagacaaaacattcaccatctagaggattggatcggtccagattctgagctgagaaatacatgggccgagatttgaaagccctgtcaagagattaggttaggaataagtatacccttactccctcaaatatagctccaagctaattcatatctctcaaccacaatatcaaatattttggtcgtctaactattgaaactagtgtaatttaacttccacagcggttttcgttgatatggctcgttgacctggttcaaccaattgagtcagcatgcgggtcccatatatcagtgttacctcctctttcttctcatcttcttttctattcctttgtcccctctcttttcccacacggcacacaacgatgacactgtcgagctagagcgggaggagggtggagcagcagctagtgtggaggagaaggtatggtagaaagaagggaagcggccccttgcatggctggctacgccgagccaccgccgccgccatcgtcctagtactagtactgccctttctcggcctttcgccgtcctaccggtaggtgagtggatctagtccacacttggtggggctttgatgagttcctctaccactccgcctcgagaccacgccattctacctcgaggttgcgacctctcttcaccttgaggacgatgagccatatatccgcctcaaggacgcttcatcgccacttcgtctcgaggctcgccatcgcagcacatcaaggccgccgcttttcctcgctcacaaagcacaccaagggatgggcctgctgcgtgagctcacgaagctcgctgggtggagtcccatcacggaggtcactaaaagatccacgctgtagtcatctaggcagtgccaaaccaagcactgccggctgccgccaccactacatccccctcctctcttatgccaccatgatcatgggagagctcagacttggcgtagcggtatccatccatgccgaggtggatcctgggcatcgttgagccaaagctgaaggagatgaggcgatccctaacactagcaaaccactctcgaaaccatttagggagatcacaccggtttcaatagttggagagtcaatatatctgatattgcggttgaggaatacgaattagattgcacttatgtttttaagggacctaaaatgtacctatttcggttaggttaagcagtaaaggctgaaaaagaattttcactgacgggccgacagcccaacacaaccgaaatgtcgaagcatatgtcatttgacggtccgccgttaagtgttgtaattaatgggcttctcgtcgtcgtcgaccagcggtaacaaagggcccgatccagcggccgacacggtcgcggtcgccggagacgtcagccgaggccggacgaacgtgtccgctggagtacgtttggagcttagcggccggagataggacataggtaccccgggggacaagaagatgtcacgcgtccgcatcttcagtgcggtcaacacgacacatccattcaatcgagacgtacgtactcctcagcgatagctacacgtacaattttgtcgtggttgcgcatgcatggcaagatcctgtgcaccatactgcgcgttgcacaggattttcatggcaaaatcgatcttctactccaaatttcagcgaactttcagcctttgcaaggttcttgcgatgtccaggcctgtggtttgagagcactgccaagaccaaagatgctcttcctcttctttttttttctttccgatcatactgcaccaggttttattattaagacaaagaaagattactccgtataaaattagccacatggctcggggtgtattatatctgtctctttcttctttatttcatgacgtctcaccttgtgtgacatatcaccactggtacttaatatgattctttacttacttgcgatgcctgtgccctacaagcgaaaaggacgcttaccaaacattggaataaaattgatggccatcttggagacgtgttgacacgattgaaaaccactataccactttgtgttaattgggactgcagcgtttttctttcttgcggacggaacctgtctgtagataagaggattttcttctcatgttttcccaaaatggtaaaagcatgcatcctttgcaggctcagctttgcaatctactactagcacaatactgtcagttatttttggaagagcactgaacactttccaagctccctcttgatgccaaacaattcttgatggtatctgatcacatctgcaatctcgactgcggctgtcactctgtaccttggcttacacacaagagtttagacgatgacccaacatggttgcatgatacaggggtacttccgtggacttgattacgtacctacttgacccaacatggtttaaactctgtgtgatttagagtaatttttttagaaaaacttaatatatagtttaaaacgagttatttgaacagtaaaaaaatctaggaaaatatatttttccaaagcgtgaagtaaaacgatctgtttcatgaatcaataagctaaaaagaatatgggcttaacccttgtgtgtaagccaattaacatggctttataaaatgtccttgaaggagagtcatctacttatctttgatggctacttttttacatcactttggaggacctgcttttatacacccataacatctttccttttctctatctttttttaagacgatgtgcttcatgtcttcatcccttcatttgtttggtggcaggggaacaagccatcatgctggccagtcagtagtgtttggtgctttagctggcttgcgttatctttcaaaatttatcagctgccaaaacatgcgatggatcctccgtagctttctgtaaaaacgctacagatagtattttgggggaaatgtttgatttagcctgtaaaatgtcctatccgatttaccctcaacttatgtaccagacaaaccggagtgcacaaaagatgtttagaggaggctgagacttataggttcggccaaatttctaaatttaattcgataaattttggatgaaaggtataagcaaaattgatcgataatcttacccactatagattgccacatcgccaaaatgctgccacgtatgtgccaaacatgatcgaaagcatactagttgtgttcagaggtaaaaaaaacgctaaggtattttcgtaaggtgaaacacaatatttggttagtagtttattttttatcctgtagtcacatattctcaaaatttagataaaaatctgaatactttgaggagtaggagattttacaattagtcgtagctgtgagaagctcccgaattgtactatgttctttagagtatgtctaacggtctaccaaatcaaactctccaaacatctatacagccaacactgagacccatatgtcagcctctactaccatttcttctttctcttttttcctctcttcctcttctcccgttggggccatcctcaagctcctccatagcactctccctctctacggtgataatgtctgtgcgacagcgacagttggatccgtgagcgcatgaggcgtggtggccgacgccagctaaagaaaggccgtcgatgggcgcggtgggcaggtgcgatgcctatgctgtggtggtgcctgtttggcaagtgagggaatgagtttgaccaaccagacggagagactgttgggtgtgatttttgttcacaattattaaattttaacttgaaaaatgggatggagagacttttgaagatgatattggaccttgccagtgtgcgattgcatgtagcagcttggagggtcagtagggagttgagaccttgactcagacatgttgtattgctgtgagtgctgttgctgcttactgcttggggctcctgtgcacctctgttttcactaattctgctatgaagatttggttactgaactaaatgatttagttattttgactcgctatttacttttgggctatcatcattcgaggtacggagcaacaaatctcgatacttaggctgcgttcagggatgccacatgatactttggttacgttcgcatagacatcatgtggcattatgtctttttttttctattatgtaatgctttataatatactagtatgatatatataccacaggtagtaaaacgcagacagctatgctttgctgtcctgtgctatccttcttcgaccccttggcggcttaaaatttacatccttgatccttcgttaattaccctatatcaatttcgtcctctaggctcgttccacttcttgctactttgctacagtactagcagtaagcacgccaggtagccaaaggcggtagtaaatgagtacagtaaaaaaactaaaagtacgtgctccatccaagcatgcaatgcgccaatgcggttatgcacagtgctactaaccctgccattttttacactaaccgtggagatcaaaatctcattcccaaccctcgttaccactcgcgcaccaaccgaagttgaggttggaggcgtgctcgtcggagaagaagccggcggcgtcgttgccggccatctcgccggagcaggcagcgagccattcctccgtgaagccatagacgccgcctttgcacgagtcgtcggagtacggaccgtgccatttggactcgagcgcggggagcgacgacgagcagcccacggttgccgccgacgcgtcgtcgaccaagaacgacgggccgaatccaatgaaggccgcgccggagtacggcgacgcctcgtcgttgaacaccacgctggagtcgctgtcgtccgacgagccgtccttgcacaccgtggcggccgcggcgccggccgccgcgtcattgccggcttctaccttcaccgatgccgccgtgtccgccggcttggtgggcagcttctccctcagctcccgaatctgatcgatcgagcacgaattgaaggtgagtgacaagctctcgcgcgcgtcgggcaaaacacagcggtgggcgcgtacctcggcggcgagggcgtccttgtcgcggcgcagggcgtcgcagtcggcgcggagggcgtcgtggcgggcgcggagggcggcgaagtcgcgctcgagctgcttcgtcttccaccgggcgcggcggttctggaaccagacggcgacctggcgcggctgcaggccgaggtcgcgcgcgatgcgggccttgcggtccgggtccagcttgttgtccgtgtcgaagctccgctccagagcgcgcacctgctccagcgccagccgccgcttcttctcgcccagcccgcacgacggcgacggcgactgcgccgcgtgcccgccggccatgtcttcgtcgacctcctcctcctcctcctcgtccacctcctccatctcggcttcatctttctgctccatggtcaccgcgggcaagctgccctcctcagagaacgccaggtcctctcctgcaaaaaaatatgcgtacacttttaactttgtgtttgtattattcttgcttcaattacactggatcgaaacatattactaccgcaaatgcagatggattgtacagtttgcacttgtatttaagcttcaaacagatttgcagccatgacgcactccacaagtagtctacacaaacgaaaaagatctcgcagcaaacacaccttgttttttggattttcggctgctgctggtgggcctcttcattatttacaaaactgaaggaggattggaaatggagatgatcctacgagtggagggttgcaaggagtgttgaaacttgaaagaagcggcagctagcaaccagaggacagaaattgcatgcagatgtgtgtaccccttcaacttttgttggtcggtggcaatggcctcccctgcttcgagaatcgagcagtgatcgtggagatgaactgggcagagtgccgattcgtcctttggaggacggaggtgagaggcggagagcagagagagaggtcagtggacggggcaaacagctgatgcaagaagccatggatcgcgtattaataaaaggacgcaggaggaggagctgaggtgggccgggaactctggttttggacggtttccaagatgtcctgtggcagaaatctttgtatgattcatgtgtcttcaaggcatgtttgatttgttgaagatgaacatatcaattttttgtaatgcaaaaaaaatgatattaacaaaattttataagttaaacacatgagaaatctcatgcatttggttgtgtacatcctttgaatatatagatgttgagttttaattcattattaaaacaaacactggactaataaaatgaccgctaatatctccaatcaagttcgactgcataaatctttttttaagggacaccggggcagagtctcctcacctgaattaattgaaatttaaaataactgcacaaaagtttaaaactagatcagccgaaccaggaagaagaggaagaaaacatcgaggagaaatacatgaagattagaacaaatgtagagggaaggcgaatagcgcctttcaggtggaggcaacgtgccagtagatctgtttgaagcgatgtgactataatctagccatttccaggcagagtcttctcacctgaattaattaaaatttaaaagaactccacaaaagtttaaaactaaatcagccgaaccataaataagaggaagaaaacatcgaggagaaacacatgaagattagaaaaaatgtataggggaggcgaatagcgcctttcaagtggaggcaacgtgccagtgggtctgtttgaagcgatgtgaccataatccagccgtttccgagcagctgcgcagtaagcgggaaactgagggtggcaggtttagaagatgacttcgtttcatccttcaggtttacttgagtgtgtaaacggagcttgaaatttgtgagccaaaggttcatccatcagccatttgccatgctagaaggaggtgcgagatccatccccgatctttttgacaattgcctggttatgacttgaatttcatcagaatctatcaacgttcatcgaataaagttctacggattcagaccatatcaattgaaataatgataattgtcgggtagttatagtcgaatttacaaaccccgaatagattttgatggacctttaagagtagaaacttccaaagttgccaaatcaaggtatggttgtgattgcttcatatattttattttgctgtctagccaaaatttagtaagtttattttagtaacaaaccaaacatacccttaattagttatatttgcatgcatggtgttgtttaactttttcttaaggttcttgaatgttagtgcatggtgcatatcttcaagtgctactcagattgctaccgaattattttccattgttattagtctacgacgctctttcactttagcatctcaaaacaatatgggtaaccttgttcgaacatttttctcctatgttcaaggcacccagtgattataagtttaatccatccaattttttgggcaatgtagtcatttgacaatgtataatcttcgaaactaaacatcaacaactatttaacaaacaatatatttttagcatgatataatatcataatctgaatattaatcgtaatcaaacttacgtatacactccttaattttgctatcagccaactgagatgcattataaatagatgtgttccattaaatgagaaaagacgaacggtttaaatcgactctacaactacaatcaatagaaaacaccataaaaactatcaatggaatatgtaaatttcgattgccttcctctagaaattatgacgtgtttgtgtgccaacgaaatatttcatttcgtaagtcttaagtttaagcacacagctgcatgcactgcaatcaaccacaaagtatcagggatgcatggtaaatcaatccagcttagtgcttctttagttccaactttttctttaaatttctaactttttcatcgcattaaaatttttctacacacataaacttataacttttttcttcaaactttcaattttagtcaaacttctaattttaacatagaactaaacacagaatcggatggcggtgacggcctagttttaaaccaagtaaataccagaagaaaaaaacaaacaataatgggagaactgcacatacgccactacgatttgctataattgtaaatctgccaccaccttttcaattatcaatttctaaaatgctagtggtttcatccgaaagttgcgaatataccaccctgccgttaaatttgactaacgctaccaagtcaacatgtttggactgtacattagatttcttttaaagaaaaacttaaataaaatgttgtgctcatcgtcaaattcatctgctggtagcatttgagccattttcttgcaaagtattttctcatcttccattttcttaagaaataaaaactactacggagttaaaaaaacctaacgatagtggcaaaatttttacaaggtaatctcccttttgatggcattctagcaattttcagaattttcgatggcatagacaattggagcatatagtaatgacaaatgtgcaattgttttagtattctgtgattctgtcgttgccgctaacaatttaaattcgagatcgatcgaactcagagttgtgaaaagaagaccttgctgtcttgtacgtacacaatagtaatattcgtatcgtttaatagcgtttgtggcgttaccatttcaagcaagcagtgtgggctgtgtggcacaaatgcatgtcaatcatatcaacagggacataatgtaagaaatatgtagagttagatatctaaaaaagataaaaaaaaatgtaaactcaagatataatagattaccattcacaataatgagagtgtgaattctaactcccatagtccacatgaattctatgttactcgatatagttaaaaattgattataagtcattttgattttatagttatacttctctgatatcatttatagaaaaaatttagtaacatctacgatacgaattagtttcactaaaactaatactcctatttgatatagtttaataatgtgtttgttttgtgttaaaaatattgttatatatttctataaactcaaccttaaaaagaatttgactaagaaaaatgttaaaacgatttataatattaaacaaatgtattcaagtttttgaacaagcattatagtggaacacccaaacctctctgaaattgttgtaatcgtacggtgttatgttaggaatacttgtggggtgttgagtagtaggagtacgtacttataattttatatggttcatgatgcggtactgttagggcaatcacagtgcatgcactataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgtagtgcacagtgttttttttttaaaaaaaagcaaaggaaatgtataaggaaaaaaaaaattaaaaatggaaataaaatgtttaaaaaaaagtaatgatttactaatgttaaaaaatgaaaaaatggtatttaaaaaatggaaataaaagtttttttaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctctttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcagccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcatcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccatcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgcctcgggccgcccgtttggcccggcccatttggccacctctagcatgcaccggtagaggggtgttacttgttagcctaaaaagttggcacaaacactcaatcccacagtgcaaggaacctaatttgggtgatctaaatagataaatggatggagatactgttgaaggcccacaacgcacgggggagcggaggaaaatcaattcctcacctacccttcgatttttctcctcccacccactccgccgcacctcgccacaagcgaacgggtgaaaaaccgaggaggtcgtcgtcgtccttattgtctactcccttgctcctccatcccgccgccatcccgctccaccaccgcagcccacccctatccttgtcgtctccacgggagcacgcgcacacaccgagcagcgccgccgccttcgccgagaagatcgccgccttgaccttctccgacctccctcctccccaatcggagcagaagcaggcgcaagcgctgctcggccatagccgcctctccgacctccctcctttttccctgaatctcgccgagaagattgctgctcggccacagctgtggcatcccggcccagggcttaatagaattaatagaatactcatatcaacaagttgcaacttcttttccggaagccagtctcgaaagaactctgaggttaagcgtccttggtgaatttcccgggtgcgcacgagtgaggacaaagtgtgcagaaaagacatgtgttggtctgtgagggcagtctatgacctatgaaagctatcagatgtaagcgggcccggcctaggagaggcgggacgttacaaagtggtatcagagctgactctcgcggtttcacgggcacgtgtgtcgcagttgcgcaggcatggtgcgcatggctggtgtggacctggagtggtcacacagcatggcacatgcgctggcactagacacacggacgtggccaagaggggacgttcctggcctgaggttgatcgacgaggacgttgatctttcttaagggggtgaggatgtggcatcccggcccagggcttaataggattaatagaatactcatatcaacaagttggaacttttttctggaagccgatctcgaaagaactctgaggttaagcgtgcttggcctggagcaatttcgagatgggtgaccgatcgggaaattctttccgggtgcgtacgagtgaggacaaagtgtgcagaaaagacatgtgttggtttgcggcggtgttggcggcggagctcgacgtcgaccctgccaaggtggtggtcgggagggcgcgaacgacggagccgcaggagggcaattttggatgacgaatccggaattcctcgtcccgttcgccggcgagggcacgacgcgtctaggtcacgcgctccacggcgcacagaaccttgccgcgcgtggactcactgcgagtaagaatcgcgcggctctgctaaggggcgaggagctcaattggagcgcgcgaccttgctccatgcaagcgcaaagccgagccggcgatgcgaagtaacgctccacgtcaccggactgtgagaggccttattcacctctctgtaagtacatctacgcaacctctttaattagcactaaactatagaacgtgaggttttgctgcatttgtttaccatttccttgggtggccaaacgtggcagcaaatgtgttgaggaaacagcagcgaagctgatacagtatctaaacacatgacaaaaagtcaggaaaaaaaaaaccatacgcgaggtcgcaaagtgtggctagcggacgccgtagctcgccaaatggctagcagcacccagtttgaaaggccagattcgtgcaacagcagcatgtgtcacccggtccaaaaacgatatattatcccctttctctcgacgtgctgtgatgtttgctggaacagagccatgccaaagatatatcatgaaagaggtgaacggtgacaggtcatcttttgatctgattccatttcgcctaaaatcttctctggtcatggccattatttgcttgtgcatgcagcacagaactacaaaaacgatctctgttccaccaccagtgagatcaacatcacgacgcatgtgcggcgtgctgaaactactagcagcagctattatagataaatcagcttcatacgcaacgccgctggcgttgacgcgttgatgtacgtaggctgtttttagttccacgttaaaattaaaagtttaaagcaattagaacgatgtaaggaaaagtaaaaaatttacgtgtgtaggaaaattcgatgggatagaaaagttaaaagtttaaaaaaaaaagttaaaatctaaacaggacgtatgtgacttctatatgaacttgcgaaggatcgaccatgtcatcttacggatttagggatatgtccattgtccgtgtaaattaaatcgggctcgggcgagacgaccgtgtctgcacgcgtgaatcacgacaaggaccctgctttacgggcaccaacggagctctgctttgcatcttttgtagccttcgtcctcacgcgcaaatggtattacctccatcccaaaataagtatagccgtggatatccgtgtctaacgtttgaccgtccgtcttatttaaaaaatttgtaaaaaatttaaaaatatttagtcacacataaaatactatttatgttttatcatctaatagcaataaaaatactaatcataaaaaatttcaaataaaatgaatggtcaaacgttgaacgtgaatagcgcaaaactgcacttattttatggaggagggagtatatgccaagctattatataatgccgacgtgtcgtgttaagggtctaggatattgttcacttggacaatcacaaacgtgccgtatgctgctattagcctataccacgtaggcaatgtatcctatataaaaaaaagagtactattagaagataacgacaatgcagaattgcagagccccatcgcttgatgagagtgttaatacgttctagattaatgagggtcgataatgggtgtcgtacatctgctagtttccttttttttttttcaacacttgtgctagtttgctcaagttccgcagaacctatcgatttaccgaaatatccaatcatgctatcagctatggatgtataaacgccaaaacacggcgagcactagggggtgaaaacggtacggaaactttctgaattccggacctatttttgaaaacggaatatgtcggtcggaatttttcggaaacggaatcaaattcgaaaatattttctcggaaacggaatcataaatgataaggacagtttccgtcggagctcgaaatcggtcggaaactttccgaaaattttctcggaattaccagaaattttgtgacggaaataccctgcattctctttttaagcactgaatagtaaataccatggtgtttgtctgttattttaaaaaaataatatttgttatgtaaatctaaaattacataagaatattttttttgtcatgcattgggatttatcaacaacataaatcttttaaatatagataatttattcaattggatttatcagtttgagggattttttattccgataaattttcgttaccgtattcgcgccggttcgttttcgctccattttcggtttcgataatattcgattccgttttcgtatctgaggtttccaattccgaacccgaaaagaatatgaaaacaaaaacgataaagatagtttccgcctgtttccgtaccgttttcacccctagcgagcacaggtcgtgcgcccaagcactatactaatagtactggtactatgcagccatggtaggatgtagtactgtatagtataaattgagccaaaccttacgggaaactgttttaaatactcaagtggacgtccacctgtttcttgtatgtcatctaaatggttataaaaaaattgacatgatagattaatatataatatatcacttcaaaaacatgcaagttcaaattcgatttctacaagttgtaacaaaaataacaaatttaactgtgaatattagagtttaatttgttatttttgttataatttatagaagctgaatttgaacttgcatatttgtgaggtggtatattacacattaatctatcttcttgttttttttttgaaaattttttataattatttacttgacatgcaagaaaacgattagacgtccatccaaaatattaaaattcatcttccaaaccttacacgtatacaagaccacaagtcgcgcaagcaaaaaaagtcaggcgcgacctaaccacatttttttttccagccgggaatctgttctccggtggcctgaaaagcagcccccggataagcaaccttcctttgcccagaaagtcgcgggccgcatagcccgattgattgattgatggccgcatcaacaatccaacccaaccaataaagcggtagcctgccacacgcacgcactagcgcatggaccatactactgtagtacgggtcgccggaagacgacgccgacgtccggtccggctcggcctcgcgtttcttccacgtcttacgagttagtactccctccgtcatttttacttgcaatgtttgaccactcttcttatttaaaaatttttaaaattattatttattttatttatgacttactttattatctacataattttaagcacaacttttcgttttttatatttacaaaaaaaaattaaataagacaagtggtcaaacgttgcaagcaaaaactcaaaatcccttatattgtgagacggagggagtacttcattggtcccatacaaaattaaccgataatcagatatgatatattctaatattatatatctaaacatataggagcacacatttaaattatagtgttatgatatgttctaatatttgaagtcatctacctataaatataagatatgtaatatacttatattttgatatgtgaagtcatctacctttttcgttttaaaatattgctatctaggataggagagtaacattttgggacggagaaagtagctaacaggatctgtttccatccggacccatcagtccatcacaccattgatcatccgattccgtccacccaggacgggagtaggagaaatagcggaaagcgaggcagcgcgccaggaaaaatacggccaaattgatcccagcttctgttcccacagagaaaacaggcagggggtgacgggtgaccagtgacttaacgaacagttttgttctttgttgtatcaacatgagtatagtagtactccttatcaacagtctgctgggctaaaaactcgcaagaattgtcctctacaacgtgttttgtttttgtcgagtgtattggaagtgcagtgaaatcaaggcggtctgaagtgcaggagtggtactctgtggtactgacaggagcctactaggacatggtccgtcctatattaaattaatctaatacgagataaaacaaactccatataatagtgttataaatctaaacaaacatctattcatatttatagtactaacatatacattatgttccacattaagttaatctactaagtgatgtaacgtattgtattactataaatctaaaagacatatgtgtactagtaaggtatattatatcctacaatagattaatttaactcgcaacgaagaaagtacttccttcgtgaaaaaaaaaactaagattagatgtagacatattctagtagactagtacaataaatctagacaaaatctcaacgaattcggataaaatcctagtacaatgaatatgaataaaatgggagctaggatatttcacatctaattctagatttgttttagtatatcacatttagtcttaagtttgttttatgagtaaatttcataaaactacatatactttgcacaatctatcgcaaaactatagattttagaactagtttcacaaaactacagatttaatgtctttgtttatcacaaaactacatgtactttaaacaatatatcacaaaactacatatttaataacttatttcacaaaactacatgtttaatatcttcatttatcacaaaactacagatttagtgtctccattctcacaaaactacacattttaacaatgctaaaacatgtagttttgtgagaatggagaaactaaatctgtacttttgtgataaatgaaaatactaaatgtgtagcactgtgataaacgaatacactaaatctatatttttgtgaaacaagttcttaaatctgtagttttgtgatagattgtacaaagtacatgtagttttgtgataaacgaagatactaaatctgtagttttgtaaaacagaatattaaatctatagttttatgataaattgtacaaaatacatgtagtttatgaaatttactcttgttttattaatggagggagtaggagcgaactcaagtcttctcacatctattgtatccggtcgacgattataaatgttggagtctagcggtaggtgcactatgcactgtgcactgtgctgcgatggttgggccgcggtgcactgttctgcacaatgttaagcgtcaaatctggtcccggctccacctttatcgagcaaacagagcaaggacagctcaagtcacaacaactcaacaaagcgtcgactgtgcgagtccaccagcgatactcctagtcgatagatacagcggtacaacctcagctttgtttggccgagctctagtgccacagtagtactggcggtgtgctggctcgtcagtgtgaccaaacatcgatatgctcttcaaaccgctacttcttccgttctaaaatattataatttttagataaatagaacatatcataatactataaatttaaatagaagatctcatgttctattcagattctaatactataaatttaaatagaagatctcccattctattcagattcgaatttagatagaagatctctcgtttcgttctattcagattcgtagtgctatgatattttatatttaactaaaagttattatattttgagatggtgtattcaccagcgtcgtcgtaccatcagcccacgtgacgctattctttgatagtgtgacgcattcagagatgcgagatgggcagtgcagcagcatggcatacacatgaaaatccacactggtcaggacgagccgacgaccagatgcactggcatgcaacgcatgcactcgtgcgatcgtgccagtgtgtagtaagatgaatctaaggcgtaatttttcacgtgccgaaaacggctgaacagctcgtgctgccggcattggcgaaccatagagttactatacttgtagtagtacagctcacactttccgatcgatcgaccagagcgaatgaacctcgtcgatcacgggctcacggcacccacggccacgtcttttccttgctgataagcgaggtctcgttgcaatgtctcgtgatctcgtcgctatcgccgcaaccccaacgtcggattgggtttcggttgcaccgctgaacaactgctactcccatgtttttttcttctcttctctgcttttaattgagggtacgacgagttcaaaatccctgtagctggcaataacgtcgtaggctaacaaccctattagacgagtttaaagaagggttcagacttttcaaatcgatggaaactttggaggctagtgtaggccgtaggtgctacgggtgtgtcatgttcgtcaagtgtggtcctcatgatacagtaccccgatagtgcaatcaaaatgtttctttttttaagatgacaatcaatgagttcctttatctacagattgcagatgccctttagggtctgtttatttggtgaaataaaaatttttgagtattacattggacgtttgactggatattgcaaggggttttcggacacgaatgaaaaaactaatttcataactcgtctggaaaccgcgagacgaatattcttagtctaattaagccatcattagcacatgttagttactgtaacacttatagttaatcatggactaattaggctcaaaagatccatctcgtgatttatatgtaatctgggcaattgattttttttatttatatttaatattacatacgtgtgttgaaagatttgatgtaatgtttttgtgaaaagttgttaggaactaaacaggtacagggctacttgagttcagaaaacaaactgttttattgtaggagtacagggtgatgaactagatcaatgccgacttcggtgtagccgtagattttctgcgcttggccaggagtattcacttttttctggcattgtgaactcgcaacagtagttttggttgcctcttgccgatctcagatgacctcatggtaaaattcggtgctatttaggcacgcacacacagaaaggaaaaaaaaaagaggccatcgccacagtgggcctatattatgagatggactgaaaaggagtctgtaattgggccttatttaccacattggctcggcctcagtagcgagtttaccaatgggccttttgtcatgagtaggccttaacatggactcactggaccttaatagtgagtttcctgtgctcgatttcggaatttgcgctgggctgtgcgccgaatagtagagagcttaccgttttcagcttttggcacctgcttagcttgtgcgtttgcatctgcctgtacttcgttgatctatctgttcatttcatttgtattgtcgtgccgtgccagccagctagtttttgcatttccgggaagctgataatggcatccatcgacgcgcatactcctcctgggcatccagacggattagagtaaacaaacagacgcgcaaaatagcgcgttaccaggagacagctgctttcttttctctttaattgagatgcgcgccagtccgttcttctttgtgtactgtcaaccagccggatccaagtgtccacactccatcctcgcgcaggcacagctcatgccaacctcacagcgtcacatgtcctgctttccaggcaagctggtagccaaccaagccagaccgttttccccggttcattttttaataataagttcatctattaaatgtgatttaggctctgtttagttgctctaaaatagcgaaagttttgttgttgtttagcactttttgtcaaaatggaactaaacactagtagcaaaaattggtaatttgacatttgtcattttgaagtctagagtagcaaattttgcaaaaaatatattgggagccatgctctctctataggcctgtttactttgatgaaaaaaaacctcaccaaattttggctttttggcaacttgccaaaattttggtaggatttcttatatagttaccaaaatttagcagcaaactaaatgtagccacttttttagcaactttaccaaaatttattaagattgaaaatgacatcaaagtgaacaggccctatctttactagtaaaacgcaaaactttaatatacatctaaataccaactagaaaaactttaatgccaaatcttttgccaccaaattttttgcaaaaaaaattgccacggtaaattgatctaaacataaccatattttaaagataaggaagtagaaaaatctccgaccacaccgaccatactttttcttcgccatccgtaattccggtttcttctgcgcaacaccaatgcgagaagagtacggcgatagaagcaaaatggcactgttccaatacctgcaccgagtaattcttccaacaaaacgcatttatgtttctccattgaaagagagcctgcagatttttctactcgtacgcgggtttgaaggatcgatcacatggcggatggcgggagtacggcacaacacttgttcgccggcccggccgtcacggctcgcaacgcgggccatctgtcagcacagcacgggactgttcaatttgatgaaaaaaaaattattaatttttggcattgacaaaattttggtaacttcctaaaatttttggtaggatttttttatagttagtaaaatttgacagtaaactaaatgtagctttttttttataactttactattttggtaagattaaaaatagcatattagcaccacgtctcgcccgttgtaaacaactccaaaaccgacctccgcaacggctagtagccggacggcccagcacgtcgcccgagggccgcattttatcgtgatccatcacacacgtccatggacaatccgacggcgaggcactcgtccacctgtccatcttggaactagtcgttggatgattacctggtaaaacaaccgcttctccctcccggcgacgcggtgccgctgcacgaagggtcaacatagccggcgccgctctcgcgacgaaggtggtcggtgccagccggacccaacccactgacgtgttggtcccactcgacgtggcccccacgtgtcggcgaccgttgccgttgcgacttcgtcacgacttcaataggctacagctgttgcttaaccgacatggtggtatactagcctttcggctataaaaacctggaccctcccattgttttcgccacacagttcatcggcatcttctcacactctagctcacagcttcgcggtttccacgcacttgaaaactcacgtttccaagccggaaaaccatggctcgcttcgccgtagtcgccgccatcgtcgccctcctcgcggtcacggccgccgcgcaggccccgggagcggcccccgtcccggcgcccaagatggccccgctgcccgctcccccggcgaggtccccggccaccgcccccgcgccggtcgccaccccgcccaccgccgcgtcgccgtcccccatggcgtctccaccggccccgcccactgacgcccccgccgccaatgccccctccgccgtcaccccgtccgcggtcaccccctcctccgtctccgccccgaccggcgcccccgctgcctcctccacgtacaccgccaccgccagcttcgttgccgtcgccggcgcggtcgccgccgccatcgtgttctagatggatggatggatgatttgatcgacgcgttgtttatacggcgagattcttttttgtgattctgttctatttacagacagcgagacactgatattcagatgtttacacttgtcatgtttgatgagatgattatcgatggaatatattctttcatttattattaccatacatggagtattgtgcaatttttttccattttcttatattatctgtatcgctcacgcgtaaactattactgccgatctgatcgggccaacctacaagagtggctgtcacatgcatgatagtctagatagctttttttccctttgctttaccgatgtccgatgccgtgacatgtgagtgagacaacagctttcgcttgttcagaatgcacgtgaagcggctttgttgcatatgcctagtaagggtgtgtttacttcacgctaaaattataagtttagttgaaattaaaatgatatgcgtagtaagggtgtgtttacttcacgctaaaattgtaagtttaatgtgatgaaaatgttggaagtttaaagaaaaattttggaactaaactcagtctaaatcttgaacgcgctttttctttcatgtaaagttggataaaatccgtaggcaccgttagaaaataggcaaaatttgctacagaacatcgaaagattgcggtttttgctgtgagacactcgaaaatcgtgtatttgtttatgaacacttaaaagggtgttaattagctgctggacactactcctattaaactttgtttaaagacaaatttgcccgtgggcccacttgtcaatctctctttctctgttgttcttcttcgtctctttctctctgttcatctcttcctcagttcctctctttctctgtcgcggcacaccgggcagagctccacggcgaaggtgtgccagcgaggacgacgaggcggcgacgacgcgggcgggccacggcgaggtgacgaggtcgacgaggcgagcggcgtgggagcgcgatgcgaagaagtcaagcccgccgccgccgccgcccagccgtcctagcgatgcgccgccaccaccgccccgccgtggcccagccgtcccggtgatgcgccgccgccgcccccggcgatgcaccgccgccgccgcccggccgtggcccagccgtcccggctcaggccagccgtcgtcgccccaaagaagaagaagaagaagggaaaagaaaagaagtgagaggaagtgtaagtgggtattttggtacttacacaactctctctcttcattttaaccggaaataataaaataatgtgaggagtgttcagcagctaattatcacttttttacagtgtccacgagcaaatacatgatcttcgggtgtctcacagtaaaaaccgcaatctttcagtgtccaatagcaaattttgcctagaaaatacggtacactaattaccttaaccaaatttggatggctcgctatacggaaacgctgcaagttgaacaccagacgagatggtgccgtgtgagacactgagagagtctgagaacgtcactgcgtcaagaagagagagttgggggaaacgggtggttgagtgtggacagtctaaagttcgtttgagtttaaagaggcccaactaagtagtactgggccgggaaaagatgagggtagaacacgaggagtttgtatgggccaggacggaagatccaattcaagttcaatccaggcctagaagtaaaccgcttgtttcactttttatttatttttttcttttggtttggtttgaggtttgacatacgagtaacttgcaacatgtcaatatcagcaaattagcgctgatgcatggaatattacctgaacaatacacccttcgttctcaaatatggtaactatcatcgtagaataaatgtagtcaaaacgtaaacttccaactcttagtatacgcaaaagatttgctccccttaacaagcgaaatcattcattcttttttttttcttttttaagaacactgacgcacacaatcaatcaatcaacttgtctactccagatggttcacatgccgtcattatagcacagtgtaaaatttggaattttgccagccacttcttccactccatcccagcaatttgcttgacggggggagcacatataatgttcgcaaggaacctcctccccttcagactgatcgatagaaacaaagcagggttagctttcaaggcatcgatgcatcagctcagcacgaaagttctcacaagttgtgggtgccaattaagctagccggtacactgtattactgtgatgtgaaaatagctggaaagtttaatttccaggtgaatcaaattgtttcctggcctcgcttctccgcggtgaaagtgagctgcttactaatctgatgtggaaacaaccacaacttggccgtgtgatgcagtgcacctgtgcttgaacagcttgatgccgttttgctgctacttggctagatcaagacatagttgtacaggtgcgcaagagctgatctacacaaactacaaagccaatcatcggtaagctgccgggccacttgtctgagtactcccatcagctgttaggccccaggttccggcaacgacctgctggctaaaacggggcatcgcacggcttaatcctcatctttctcaacagcttacacacgacactgacgtggccacgtacagctagcacctcgcagtcaagtttgtatacgactacttaatcctcatccttctcgagtgccttattgaagctactctgaatatactgcatccgagttttccaacgtacttgagcagaaccagtcattgcattgttaatagacagtatatttcggtagatctatatcgtcaatagaaggttgatatgaattaccagtcgaagaattttgctcagaattttgtccgattggtgtaccggagaaataagatgtactccctctatctaaaaacaaatttggatagatatttatccaggttcatagtattagttaattagtattaggatgtgtcttatttcattttacatttacattacgtgggacggagagagtacgtagcagtacttatattgtgaggagaaacgtggggtgcataataggaggctcactgacagtctgaaacttactcaagtattacgagaggaagaaaaaatggttcattctttttctgaaatccacgtacatgggaacagccagttagtaacaagtccgatcaaacgcccattggacatcaagaattcatggagtcctagattatacggtagtaacagaacttatgtccttcgggtcaatggaatctctagtctctgccgcagatcactcatgttgtctctgtaggctagtgcaccctgagagcaagattgtctgaagagcattatgtactcctgcgaccaaaccgcagaaccaaacacacatgaggattatttactgtttatcacgagaaaagaagcagctcatcacatcatcgggcaatcattcggcctctgcactgcatggatgccacgctgttcgaccagtcatatatagctcctgacagatgcactctaaagcagagaaagcagagttcatgtgaaccgaaacagagatggatgcatgcaaatgggccacaggtctttttaggacacaaagccgtatacctcaaatgctaatcaaatgagtgattgcacggttctttttttatcaagagttatcacaattttcgatgttattttatagtacctctacgctagaaaatatagtatctcttggtacatcataaaggacagttcaagatttgtaaccaattagtttcaagaaacttagaaaaaaatgtacgtgatatatctcaaagaaattaaatccaaaatcaatctatacgttgaataaagcaatcggctattggtagcgtatgtgattttttccccttttgtgaatgagtagattcagatttacacttgaaaattcatgactttaggtattgcactaatgctgtcaattttgccttctggatttctcataactattttcatgatattttcgtttctaattaagatctagattctaccttagtttttgttagcatgattttcaaaaccgttaaacgagacgttttgtgttaaaactttctatataatagttactttaaaatatcaaataaacctatttttttatttataataattaaaactcaattaattatgtgttaatggttttaccctcatcagttaagaacaccatcgcccaagggctccttcagaacacaaaaatttcgatatatcattagtgtatagcctatgaaaaacccttgaagtccctccatttcaaagaaggcgtaaggttttagagtcaccctccttttatgcaaatggcaagtagtactcccttttttaatatataacgtcattgattttttaaaatacgtttaaccattcgtcttatttaaaaatatatatataattatcatttattttattgtgacttgatttataatcatcaaatattctttaaccataacttagattttttatatttgtaaaaaaagacaagtaatcaaatatttgttaaaaaatcaatgacgtaatatattttaaaaaagaaggtagcagttaagcaagaggtactagtgcacaacacctccatcaagacaaaagtggtcatcgtacgtacgtttacaagagctcaaaatgttggtatagatttctcattaaggtcgccggagatactgcatgcatgcagcactctgttggctagggtacaatcacattcacacattacaagctaacaagctatcgatcgaggcgccatggttccatttccaggacggacgaggcagaggcttcacatggcggccgtctcggttgtcgtctccatcgatcgcggcgtcagctgatggagaggacggcctcctgctgctgaatgctgcccaggatctgatgcacagcggtggcaatgtcttccacagagcccagcttggaatcatcctccacctaacatccaaacgaaagcgatgacattatcatcggcgttgtagaaaaatgggagcgaatcttcgctcacccgcgacgttccaatcgcttaatttgtctgtgctgctagcctaaactaactaagcatgcagtcgtggtagtaaaataggtgcaaattgtcgattggtttttaccttgaggctgaaggagtagaggaccatggcgtcgacggtggtcacgttgagatgcagcggcgggatgcgcagctgctgcagcccgacgaccagcttcagcagctgcttcggtcgccgccgcgcgagcaccttgaggctcgcgtgcccttccaccatggtcacctcgatgtcggcgatggccgccgactgccggccgctctccgcggagcccgccgtgtcgtccatgacgacgctgctcgcactgccggagctcccggcgctggcggcggcgctgcagccagtgcgaggcgacgtggagtactgtgggaagctgaagaagccggcgaaaggggaatcgccggcggcgtccatggcgccgctgcggttcttgaggctcttttggacttccagcgactgcagtagctgctccagctccttcacgtagttgattgctcctccgacgatcgatgcttgatcaccctgagcagaaaatggattcgatttaatgatgattaacgaatcataacagtatgcgtaaaagcgattaattgaagcatgcgtagttagtgttgtaccctctgcgagtaggacgccggcatgagggagcggagcacggcgaggtactcgttcatctggcggcggcggttgcgctcgacggcaatgtgggtcatccgctggcactcgatctcctccttgttcttgacgaccttcgtccgcctccgtttcctcctcccggcggccaccggctccgcccgctccgccgccgccgccttgccctccgtggaagcatccgagttatccttggatgccacctcccactcatccacggaggcgacctgcagctggtcatcccactcgtccactccgtaaaactcaccgaagccgccgccgccgccggcagcagccaggacgtcgcaccacggcatcccgtacgccggcgagtcccttccgcacccgtagccgaaatggccctgcggaaacaccacggcctctaacgccatcctgcacgcacccggcaaaacgaacgggcgttttttttcgcgaactgacgacgccacgatacgatacgcacacgattcagggggaggcgaattaaagagtgagttgcccagcgacgcgaggggcgccgccgtttttataaggggacgcgcgaggtgtgtggccgagagaggcgcgcgcgcgcgcggtgcggggcaagttgcagtggtgcacgcatgcattgcgcgcggggggaggggggccacgtacgctacgcgcgaggggcgaggcggccttttgcgcgagggggacgggaagggaaaacgcaatgatttacacggagagcggaagcaaagcaagatgacgcgcgcgcgcgggggcacgggcacgcacgcgggcggggcgcgatctgcttgcttgctgcggagccgtggggacggggctcggcacgcgggcgcgcgggcgatcgatcgggtggcgcggcttgtttgatgcggtaacgcggcctgcaagaggggtggcaacttggcgaagaacgcgcggcgcggcgcgcgcacccggtcgggagaggcgtacgtcgcacaggcgcgaattggaacggcgggccggttgctcagatcgagagattctggcattctgcgctgcacggtgatcggagggggcgtggcaaacaagcgacacgtacaggtcatcttgtgcagccatgagtcgatctgaattttctgattactcactgcgtccgttgatttttactgttcacatatatttcgtacatttctgcttgattgttggactcgtaattggagaattctgcttgtgatcgtctttcactacagtgtttgcatgcatgtggctttcatccgcctacaaaggtgatctggcttgatctactgtcttgtatgtttcaatcggcatcaaatttacgattaccctcttgtacaagtatgtctacttgtctgtatcacccgtcgctttccttggaaagaagcttcactgagtttgcaaagaatcggctatgatatgtcacttctctaaaggaatatgtttaggtgtactacaagtagtacaaatttgtgtagtgtgattattttacagctgattggcgcataaaatctgtgagatgggatcatcctgagtccgacgtaggaaattacacaacgtaacaaagattaaggcactaatgctaaatcttggcacattaaatttaatactccctccattttagattataaatcgttttgatttaagtcaaagtcaaattacttcaaattaaaccaaatttttagataaatatattaatgtttacaacactaaattagttttgttaaatctataattgaatatattttcataatatatttgtgttgggtagaaaatgttgttactttttttaaaaaacttagtcaaacttaaagcaatttgactttaacaaaacgacttataatttgaaacagagggagtatgatagatcatatgcgacatgtcacaccttaaacatataggtttaaattcaacctatataaggggaacaaaaataacaaatatatgactcaggatcgtactattcacatttacccctatcacatattctaacttcaagtactccaactgtaactaaatataattagtatattcaacacgtattacgtattctaaccgatagtatagacattttcctaataatcatatattattatcagggttgtactgaaagatgagacattatgactagatagttagccgtgaggatgaggattcggcacgataagtttcaacttctatgtacgcttgtgatgtacagatatactctcgttgaagtgttggggtccatgccacgtacgctagggagctcacattcatcgatctaggcacagttcgtgatggtgttcgccaaagcatggctcaacttgcgccccatcatgtctaaccccaacaaaaatagccgcatcagcaacagtaaaaacgaaagcgaaagatgcattcatgcacaaagtttttcttattcggtatcattttcgatctgttcgtttctaacttttgtctaacggcagctaggcagggagaacttgaggaccataacctctgtggtatgccacagtttcatgcacaaagctgaacaaccgttggcatctttttgggacgggtgttttgcatataaaaattcagtaacacgtacttctctgtaagtagtatttttgtttttccaggaagaacgtgttaacctgtttccaaaagacagtagaaagacgtacggcacacaggttccattggaatccccaacaagattgaaaaagaacagttggcagtgcatatactaatcacatagttgatcagtctatggacgacgacaagtactttagactgtttatcacagatgctggagaataagaacaaatgttcccttgcaatttgtaaattattgacctcatggacacgttagatcaagcccatgaaagaactgaaaccgctctccaaatatattgccggaagctagttcaaaccaggggcagaacaccggattggcctgaagaaagcattttgttctgttcttcaggtatactgcactgaagcattattatttctgctgtgtcacgcttggaatgtaatgagacctttcttaattataagtacctaaaacaatttgttcaattcacatcagtttctggatgcagttgtggcgatgctaaaagaactccattatctctcgggtacgtggtgtgccctggagatgctgaaagcttagcctggatgctttccccgggagaatctgctcagatcgagactgaaatgcttacaatgacgcaaccgtacggcaaccaggcattttcttttgcttcagttttccttgatgaaactatatgacgccaatgctttgttctttttgcatgaatttgattgctgccaatgctgataaagctggctggctagcaataactggcaagcactctcctatgtctatcagagtttcagagtaggataaagacccaaaatgttattcagtgacagcttaacatttctcggataaaatctcatactacagctggtgataagaacattcctacgcgtaatttacctggtcgtctttggttctgaacgtaacatcaatggtctccttttacgtagtataaaactagaaattatgattggtgaaaagatacgaatccgtgtcaataaatcagagcgtccaagtggctgtagtacaaaattatatttcacatagtcatctagaatgaagccatttctgaccgatcgagtgttactactatacgataacatatcaaataaatggtgctaaaattaaacaaaccaccatcgtactactcgacttgacatactatatcttctcaaaattttctgatgtgtatagtagtccatagacaaaatctggaagagtgattatccggtattatacaccagttttatgagtggtaaaataataatttattaatataatgattagtaaattatcaagtgcatctcaaggatgtaatatgtgaaaatagaattaattaatacagttgtcacaaaatactttcatatggttatattaatacacgagagaactaggactgggcatttacaattagattaaatctgaaccgcaaattacaaaaattatcgtataaaattttctatcaaattttcaacattgcctttattaatttatactgctagtatataccggtactagtatattataccgtaaaagttatgatcggctagatctagattagagttttctatatacacattgtacttcatataatctggatatagtttaggtatatgcatacaaacaaaatatatggatattatcttgcgggaggcacgaacctgtacgtaaaacctctatgcacacacatggttttacgaattcttatctttacacaaacgatctcagatatacttaactattgccaattatctaatgaaacgaagatatacccaaatcttttttgtgtatctaattgttcatgcaatgttccagaaatcgtgcgacacctagtttgttgtttagcatgtacaaaatgtcaattcggtcgtgcagctcctacgttataggtaggcgctaattaatactatatccttaacgtaatcctcggcaatcttgttccattctgcccatgccctattatgcaccaaaccataccgttctctcgaaacaaaggcaaaacagctgtgttagctgagctctcttgacatatagcatcatttctccagttcaaaggtgaggaagaaaaccatatacctgctgcagtatgcgccgcattaccagacgcagcacgacgacatgctcgaacaatattgttaatcagtgcaaatcttggagagatccggtgtgggggattaatttggacggacaagtaggtaaccgaggatttggtttggtgatggtcttttttgcaagtgtgaattgcgaagtttggaagcattgctaaccgctgccgtctcgggtcagcgtcctacgtactcccggggtcctctctgcccttaaaataaatggattttgcaacgcttcctttgggaagtccctagcaagtttgttaattgcaacctttttcgttcagagacttaagtttatttgcaacttggtcacttggtcaggtaaatgctttcgatgtacttgcacatttcaaagattcttcctatagctttcgcccggaggaccccgggcatagtgttgtgccaaattccaagatcgacaccggattcttgaaaaggtatgcccagttacaaagtacaaatatacatacaacaaactgaccaagatagtgtcacaaagtggttggtagaacaagtgaacaatcctcaaccattcatgtagtatgttacacatcctctcaccttatttaaaaaatataactggacataaattaatctactggtgggtctgcatgcattctgttgtttacggtgacaatgaagaggctgtaagatgttaatacgactcttctcgcttggatcaggcagtgctataggctgggaatgctgccatcacaggccagctgcagctaagcaaccaaatctgaatcatctaattagaagtcatgcaacagacaagctaactaagctagttcactaaatgataatccagtagatatagcagaagtagcagattattaaggccatctaactacagaagattggtttgttaactgcaaccgatgtcggcacgggaatcataccataatctatagctcggcctgcaggcatgcataaaaccaaatgctactagagaatttgtcttggccatggaggattgagttggtacatcagggaatctatcttattcttacccctagtcaagctcctaacacttcgaaccttgtaaagtatggtactaaaatagaaccaatagtgttcgatcatgcatgtgtgtgcgcatgtttgtctcctgctacctccaatgtgtggctggcaatgcatggtacagtctccgttatgtcagcatggcgccaattgaccgggcagtggtatttttctactggcgagcccgtgtttttttttatgccttgtgcaaatctcgacggctgtgatttaaagctcggttcgtgtacggagtacgtacgtggtcgtcagatactcgcgtcgtcacaacagagtcacagatatactactctttctgatgtgtaatttcgtgcagcgttcggacacacaccggtcacaaaatggcagagcaaaaggaccctgcctctctgccggaatctagccaacgtgacgaacagtgacgcccacagagttccgctgaccccgccgtacaaggagcagtggagcactggcgaccagggtttaccttatcgtttgggccgagattaccaccaccccgcggtagtgcgataaccacgataatcgcgtgataatcgtctaaaatcgcacaaaaatcacatccaaaaattcgaactcaaaactcggtggtttcgcggtttcaccacgataatcgcacggtttaccgcgataactgcggtattcgcacggttatcgcgggctatgtaactgaaatcatataaatgcaaaataaataggggaaaaaaataaaaaatacggttgaatatatgtagaaaactagaaattgagaataattggaagaatatgtaggatacttaaggcccaatattctctttccttttccaatttgtaaactattctcggtttgccctcaaatttgaatatagcttactctgttcaaaaaaattcttcaccattgataattacaaatcaagaactacttacatgattttttttttaatttttttcaattttttttattttttccgggattttaaatttagtcaaaattcatccaaaccatatcgtcgatttctcctaccgtaccccacaataagcacgataaccgcgataatcgcgtgattatcgtgcgataagtgaaacctgctcgcgactcgcgactcgcgcgagaaacgaatcgctctccggcatcgaccgtaatttggttaccgcacaacacgtcctcgcgctgccacgcgcacgcgggggcccctacgtacgcggccttggggcctggcctctctgcggccgcgcgggcgtgtgcgtgggcgtgtgcgtggtcggtcgctatgcctaggcgcgcgcctcatcacacgacacgcgggatcgcgcggttttatacggcggcttggctcatcgcatcgtcctgctgctgcgggcggcttccgcacatgccatgggctatattacgccgcgaataccactttcccgacctcctgtttcgtgtccgcggtttgcagctgcgcctcagctcctgcgcgcgcggcccagcgtgccgggcgcagagcatcgatcggaaacttggttttggatcggtctacagactactacaggagagtggatgcgtggccggtgtcaattaaggaccctctggtctggacggagaagtgtccgctacaacttccacaccgatatggagccagatgcagatcgagttgcaggttatgcagcgtggcactggcagcgtcaggttattcgagccagccgaatcatgagggttactgaattgaataatgaacgcgatcgagccggtgtgtgtgtgtgtgaggcgccgaccggtacgtcgcgtcatgcaagcgatcgatcgatcgtatgtcgtggtcgccgtcgtcaatcatgcgatgggtgcaatggagtagtaaaaaagacacaaggaacgcaccaacgtttcgggtcagtttccaccttggaatgattcgtgtcataatctgtacgacgtaggagtacgcaggtcgtcgtgcccgtcgcttcaaacatcaggcattggccttatatcacaccacttgtgctacctaggacacgacagagccgcgtcgttcgatgattgttcgtcccggcatggctagctgagctctgtgtgaactgtgatcgatcccatcatggtccatggctatgcacgcaatgcaactagtaggtcgcacatacatacatgattcgtgcagggatattgctctcatacacagcgcgaccgtggtgatcctttcttgtgttctgcgaaagtgcttatgtgcagtggactcgtgaaacgcatttacactgcatattcgtggtttctcgcagtaaggttattctgttatggcacgaaaccaatcggcatttcgtggcgtgttccactatgtttcatatatacatgcatcaagatctctatcactataaagtcagaaacgaacttgatcattggacacaatttggaacgcagcggcttgttctccggttagaaatgctaggcattcaaggaggtacacggcgtgatggcgttacaagtttaggcccatttgcccggtgaactctgcatagtaagcatcagcttgatcagatttattagcagcgattggtttccacctagcagttaaatatggctgtcacaactcacacgcggcaatatccctactgttatttggaatttttttagataatggaataattgttatttggaataaatctattttgcttctatctcttgcacccattttaatcatctatcttaactacaaaatcgggtataacgcatttgtcatcttcaaaaaccggtgtaaactaactccttcagtagtttaggaactggcttttcactgaaccagcaagtaggacctacatgttagcgactcttctatctatccttcctttctcttttttcttttccatctatcccctaaggctggtggcacaaatcctctatcccgcatcgtccctacgcccgagggcccaggccgaggtcaccgacaatctggctatgagctactgtgatggcagcagatcggtgacggagcaacccaagctgctatgaaggagaagcaaggcagcggatgggatagaatactttccctaccgccctcagggagagatgaaaaaaaaggagagatgagacttgagagtcctagacgtgcgggtctacatgcttacttagcgggtcaacgatggtcaacgtgtcacatcgttaaaaaccacttcctaaacatcaaaaaagtcgatttgcaacggtttgctaagatgaggaagacgattcaatcaagagcaaaatatgagggaggccaaatagtttttttagaaaaaaaaacttggcaaaaaataggttattccctgttcttttgttaacagtttttatgctcaggccgaaggagttgtcataatgtgcacagaatgcgtgggcctttacttcatctaaatatttgcgccagtcaatacagaggcccattactgctaaacttctcctacttctgtaacctgatggtataaagcaggccggacactcgatatttccaggaataagttcactataactccctgaaatgaacacggaaaactaaattgtatccctcatccgcagtaccagacccacaaactgtcaaaaccggtataatttgactcccttagtggttttgtaggacggtttcactaacgtgacgcacacgtggcagtgttgtcttggtcttcgtcccacgtggcattgatgtggcgcttttgtggcattaaaattaaaaaatacatgcggggcccatttgtcattcacacaaaaaaaattatgggtcccacatgttatcttctctctcactacccttttttcttcctcctctctcccatctctctttctctctctcgcctttccctcctgagctcctcatgcatggctgcacgatgccgtcgacggcaccaccaccatcgtggtccaccgcgacaagccaccgccgccagcgccgccgctctcgcacccgcttgccgcacatggtcgaagaggtcatcggtgacgatcggcggcgcagtggcgccggccatggcgcagtctattgggaggaggaagcaagcgaggggcggatctggcctctgggtccgcaactccagcggccgcccgctcgccgatgccgctccgtccatcgcctgccaccgttgccgacgccgatccagacgccgctccacacgcacgaagagaaagagggagagatagagaagggaggagagggaggaagaagaaaggataaatagaggatgacatgtgggacgcacatgtcagtgggtcccataatttttttttgtgtgaatggctcccgcatatttttaaaaatttaatgctacataagcgccacgtcaatgccgcgtggtacgaagaccaggtcaacattgtcacgtgtgcgccacgtcagtgaaaccgccctccaaaatcatcaagggagtcaaattgtatcggtttagacagttcggaggtcaagatttctagtattgcggataaggtatacgatttagattccgtgttcatttcagggagtcaaactgtacttattccatatttccaagcctaactgaaacagaatcagcccattatgaagcccataaaacaggtaacaaattcagtgcgctattgttccaactgatgtctgcttttctttcttttcagattcatgccagccatattcacattaactcaaggattcaatgtcaatgactagcattctttttacaagcatgcctatttgttacttttgctaattgtgcagcagcagtgacgaaacaacgcgaagaggttattctaattgatctagcgtacgtaacttacgtgacatatagacaaagaattgatccaaggcaaccaccacatgtccacgtgattgatgattcataatagtaaacaactgcgcattattgttcggttaaaagttgactgctacaaatttcatatgaccacgtcaagctttataaaattataaaaagaaaactttcggcgacgacctcagtggtggttgcaaatatcggaattagattcagtttgtacaagttgtaaaaaaaagaagatttgagttcgtacacatacaaagtcgttagtccacatgagtcatcaaaactcacaaaatacacagtttcaaagcttgttcctagaaccgacaagtagaatgaactggtcataataatgcatccctaatctatttttttaactaaatgcatccctaatccaagcatggcgtcagtaatcccgaagctgacatgtagggattgtaacgcgagtgcatgctacatgcttgacatgggcggcaggataggtcggaaagtgaagaatacccagccacaccaggcgccgtccaatcgctgcatattggcgacttttgggcactttcccgtcgtctttgtgatgggtcgggggcacaaaacgttgcgtgcaaaagacagcggcattgctactcgatgtactgaacccacagtaagttcttgttggctaggaattttcggagccatcagatcattcatgatcaccgtacatgtaagttgtgcatatggattagtacattaacgacgtgttgattctgtaaccaagaggtttgttgtttgtttgttcagatggaactctgaccaaaatccaggcacgcgtgaaacggtgacacgaaaaatgcttccagctgatttccaccggcaacagccagtgagggagtcagcggcaccgcccgctcgtccccgcagtcactgactggtggggcccactcgccacgcagccatccctgacgtccgcgcgttacaccatccgcgtcgtagttaacacctccgttactccattccttccaaaagaaaactcgaaacctccccctctccggccgccggcgagcggctcatccatccaccccaccttggccggagacggcggcaatggctcaccgccggatcgcgctcgccgtcctcgtgacgctgctcttgtcggcgttccgcccttgcctggcgcaacagagcaacgacgacacgagcaaacaccaccggagcgccacggccggcgggttcacgccgaccaccgtcgtcgtgctcgtggctctcatcaccgccttcgtcctcctcaccgtgttctccgtcctcatcaaccgctgcgcccaggcgcgcgctcccccgcgccgggcgttccgcagcacggcgtcccatcagcccgtcggcggcgccgccgccgcgtcccgcgcctcgcgtggcctcgacaaggaggtcgtggaggcgttccccacggcggtctacggcgacgtgaaggcgcgcatggcggcgaagtcggggccgctcgagtgcgccgtgtgcctcgccgagttcgcggacagcgacgagctacgggtgctcccggcgtgctgtcacgtgttccacccggactgcatcgacccctggctcgccgccgccgtcacgtgcccgctctgccgcgccaacctcacggcgccaccggtgtcgctcgccgccgccgagagctccgacctgacggcgccggaggaggcggtgcaggaggaagagtcggaggagctcgacgaggcgtccctgatggccaccttcacgccggaatccgtcatcgacttcggcgcgacgcacgaccatgaattcgacagagcagggtaccctcactaccggaggacgcagtcggccatggacgccgcgccggaccggcacacgctgaggctaccggagcacgtcatgaaggagctcgccgccgaccgcaggcaccggcgcgccgcgagcctcgccgggtacccggacagcgtggagaggacgccgaggtggctgacgtcgctctggcgatcggtgtcgtggcagaggcagagccgggcggactgggacgccggagaggagcacggcggcagcaaaagggttcacccggtcgccggagctcaggacgagacacccagcgggtccggctccgatgggagcaaggagaactccgattctgacgcgttaaaccgagtttgaattttgttttctcctcttctttttttttcttgtgcttcgttctaattgtgcagcggtgtagtaatacaaattaacgataaactaccttgcacaattttctattagcaaacaagtactctactactctagatcgtcgattcttgtttgagtttatcgggtacaaaggtttaatattccggtagatcatgaacattttaggatatccttaacagtacctctcagattaatggggataattagtactgattagtgattaattatgctggtcacttgccagaaatgctgctccactgtgtgctaggcttgccagttgcaaaaatggaataaacgaagaagtgatatgatacaccggccgatgcactccgtgaatgtcagtgacagagaatgtatccagtcaaagaatacgtacgcacgcgattgttcgtatgcacctttctatcccgttcttcaatgtcaactctcatgctgacattatccttagagataccagtaggatgatggcgtcctacatggcaattcgtcttgaataccaacggtagttgaaaattttctttttcagggcagctacgtccaccaatacggcgagcatgcagggtaaaaatccaagatgaagattgtagaaggaatacggttggtgaaatcactttagataagatcgattcaatcttcacatgtcaccatttgccatacatacgttacttcactcggccagccgaaatggtaaattctcttcggtagccagaagaccaataccataaatttggacgcaacgaagccaatactagagaccaacaagagcaggtgatgaagaatcgtcttgtccactgttcacctatgcagttaatcagctcactcgtcgcgaccatcttgtcctctcgtatggcagaatctggtgacgagcatattagctcaggaacgtgtgcgtcctctcccatcaccggacttgcgaccacttgtccatgcgtgtgcttgcgatcatggcctgcaaaataacacagccaaaaaatgtcaaaatttcaagtcgctacggcatttgatcgttttcttgggctgtgtggagggattgatcgttttgttcacctccttgtcccagtcacagcggatggttatgatggccagaattagcgtctgcactgcggttccgccgatcatacccgcccaaattccctgcaaattaaaggtttcacgaaagaaatggtcaggccggagatggctaacattttcacggtttaacttgaactggtcagaaatcaagtagcatagtggcataggtaccaggacgccaagtttgaagagccatccgaggagaatgcccatggggatgccgatgaggtagtaggtgccaatgttgacgtaggccaccatggattgccacccagacccaacagccacacctgcacgtatatgaccggcccatttatgaccagttcagctgggaactgaaggcccatgtagaaaaggaaggcccaacggcccaggtgtgtgtgtactttacctgagagaacgggctggatgctgttgaggaggatggtgaaggcgaggaggacggagaggttgtcgacggcgtcgagcacgacgtcgctggaggtgaagatgagcgcgaacttgtcgtggaggcccacgatgagcacccagaagaagagcccgatcaccagcgacgtcaccgacgacacgatcgtcgcgaacctcgcgcccttcccgttgccggcgcccagctcgttcgccacccgcaccctgcaaaccacaacaaaaacacgtacgccgccacacgtgctctgctttagttcggtatattcgagtttcgtaagcaaatcgagtgagaactgagaagaaggcagtgcgtgcgtacgtacccggttccagcgaagaatgccaggggaatcatcagctcccatgcattgatcgtcatgctgtccacgagaagacataaaggttagctacaatcagacgcatgtcagattgattcaggaacttggtactgacttaccagatggagagcgcgtcgaccgcaatagccgcgttcttgaggttaccggtcagcaagatgaggattctgtagtaccagttctccaagctgcaaattaagcacacaaattctgtcagcaactgcaaaaaacgtacgaaacgtgaaatcaaacagaaaccaaatcacacgagaattgaacgttctcggtttcacgtcgcgtacgtaccatagcatgacaccccgcgaacgcctcgagggagaggccgttccacgtctccgggcatccgccgcaggcgacgtaggcgaagagcatggcggcggtggcccaccacgagaagttgagggtgagcgcgatgccgacgaggccgaaccggaagcgggagacgaggagccagctgatggcgacgtggacgcacagcgcgacgccggacgccgcggcgctggcgaagttcttcatctggcactgcaggaatcgctgcagcgggaagaggaaggcgaaggagaggtgcagcgggatgaaccagacggagacgcggccggccatcgccgacagctccggcggctgacccgtcaggagcagcacgtcctcggcgtagatgtacatgggcagcagcagcaccgcgcacgccagcagcacgatccacgaacgctgcatgtacacccccatcatgtggtacttcttcgcgccgaacgcctgcccgcacagcgtctccagcgcgctcgccatgccaagctgcgttccacacggccaattaattcagtgaatcagtaattgtgattcagtatttccgtacagttagggtgtgtttagttccacgctaaattggaattttgattggaattagaacgatttaacggaaaagctaaaaatttatatgtgtagaaaagttcgatgtgacgttttttggttcagtgtttggaattaaactcggccttaattcagaagcagcaatcgtacaaactagtatacaacagtagtataaagaagtcatcactgctcaggtagccaggtacaattatacagtaagagaatcagtagtaccaattgattcagtacagcataattttttttgaacaggattcagtacagcataataattcagtggtttttcaaactgatgccatttcaaatcttgtcaattttttaaagttgccaacgatgcatacatttagttttattaccaaactttcataaatacataagaaatcctatcaaaacttgacaatattacaaacttactaaaattttagcaaatatcaaattttgataaggtttattttacggatttgctatcgatcgaacctgagacttgcagcttgaatgctcgttcaactaaccaattgctccatcaattttttcagagttatttctttagttacagatgacttatattgtagttacacagtagttacaatgtaattacattataattacatagtagttacaattgaaagttttctatttaaaaaactgtcgaatgttgtatagctactcccttattttatctataatcttaacagcccctatcgtacaaaccatactacagcaagaagtcactgctcaggtagtcgggactatcatacagtgagaaaaatcactaaaggcaaatcggttttatgctatgatccctctgcgcccatttacttgtttaaagtatagtgaaagatttcattaaacaacaaaaactgtccaatctctacactaataaaaaatgcacacgaccaaactgccacatcttttcgcttatacttatgtttatcagccaaaatttaaatttttagccttaaatttagaattgattttggggcatttttatcgtagtttatttttcagtctttacttttagatcgttaagaacatatataaaaaatttatttataaattattttcatttgcaaatatattgtttgacttatttctcgaataagccaacgatggggttgctagataacatgaacatgtgtataatgttgccttataaggatgttctcaactagaataaggaggagggactttcaagaatgccccatcatctgtctattgttgtcgtcgtactcatttacttgtcactattaattatcggtatttcaactttaatcattaataatttttaaatgattgattcataattaaagaacgttacattgctacgagtaatcaaaattaaaaaaacaaatataataaatagtgataagtactcgtatttggaaagggatcggtgacatttttttgaccggcaaagagaagccgaccggaatctattatattattaaagggatagaaaaaggagccaccacgttcactctcatgatctagaaattctcatattaatcagagaaaaagaaaaatcagattccatatagaaatacaatttagaaatagctgaaattcggattaaaaaataaggaatattagaataggagactagagtccatatagaaatacaatttagaaatagttgaaattcggaattaaaaaataaggaatattagaagaggggactagagtccatatagaaatacaattagaaaataactaaaattcggaattaaaaaataaggaatattagaagaggatactagagtccatatagaaatacaattaggaaataactaaaattcggaattaaaaataaggaatattagaagtagagtatagagtccatatagaaatacaattaggaaataacataaatttggaattaaaaataagaaatattagaggtagagtatagagtccaaatagaaatacaattaagaaaaaaatagttgaaattcggaattaaaaaataaggaatattagaataggagactagagtccatatagaaatacaattaggaaataactgaaatttggaattaaaaaataaggaatattagaagaggagactagagtccatatagaaatacaattagaaaataactaaaattcggaattaaaaaataaggaatattagaagagaagattagagtccatatagaattacaattaggaaataacataaattcggaattaaaaataagaaatattagaagtagagtatagagtctaaatagaaatacaattaagaaaaaaaatagttgaaattctgaaagtgcatctagacccctaatgattttgatgattgattacaatgcgattagagaggactaacatttttattcaagcaaatgtgaaggttgttaagtcctcaacgtgttgtaatacaatgcatatcccgtgaatgcgacatcgtgatgcaatgcggcaatgatcaaatggtatattgtatctttttcctcgcattgtgtcgtaggaaagccatactattaagggggatgatgcatagacatataaggagtgatgcgtgtgctcaaaatcaattttacttcgaagcatttctcttttggagcgttctggaaattttcggaagttccgaaaatacaccgaaccgtgtttgggcgttctggaaattttcggaagttccgaaaataattttcggaagttccgaaaatacacagaagcgttctggaaattttcgaaagttccgaaaatatttttcggaagttccgaaaattgcgttgacttcgattttcctcagatctggaattttcggaagttccgaaaatcccttttattgcactccaacgggcagatttgtgctgtgggtataaatacccacctcccctcacttgtgagggttgctggttccattccaattatttgtgcccttggcttgctctctctctctagttcatttgagacttgcttcctcgattcatctctccacccgtgtttgattttgatttggtgtgtgtgtgagagtgtggattcgagcttgtgtgggtgcttcttgtggtctttgtaaagatttgtgagcacttgcatcatctccgggagttctttgcatcatcttttactcttggaggttgaggactcctagacggctaggtgtcactcccgagccaccgatctccttgtggttggccgggaaaagtttgtgaaggccggatctcgcctccgcaagggaagagatacctcttagtgaaaggaggagtgcttagtgcaacctcttgaggaaagtgttagctaagacccggctcttagtgagctcctcaacggagagtagaatcccctcaaggatttgaactctggggaacaactttgggagctacatcttggtgatatttcttccctctcctctagctttgcttgcttgtactgctattggtctagttgctgattgtgccttgtattccctgttatagtcttatagatctagagttttcattttgtgtgcgctgctctgtgcattttcagaagttccgaaaattcctagcctagctccgaaaattactgctttcgcatttcttaagttttaaattagcctattcacccccctctaggcctaattgaccctttcaaattcggaattaaaaaataaggaatattagaagaggatactagagtccatacagaaatacaattaggaaataactgaaattcggaattaaaaaaaataaggaatattacaagagaagactagagtccatatagaaatacaattaggaaataactaaaattcggaattaaaaataaggaatattagaagtatagtatagagtccatatagaagtacaataaggaaataactgaaattcggaattaaaaagaaggaatattagaagtagagtatagagaccatatagaaatataattaggaaataatagaaatttgaaattaaaaataaggaatattagaagtagagtatagagtccatatagaaatataattaagaaaaaaaatagaaattcggaatttaaaaataaggaatactagaagtagggtatagagtccatataggaatttaaaactaactaaaatttagaataaacacaataaaattaaaagtagagtttaaaatctgtataaaaattcaatttacaaataactaaaattcgaaattaagaaaaacataggaagaagagtttaaggtcaatataggaatacaatgtagaagtaacttaaattcaaaatgaaaaaattaaagaatattgaaacatgagtttagagtccacatagaaatacaattagaaataataaaaattcagaaataaaaataaataatattggaagaagagcatagagtctatatagaaatacaatttacagaaaattcggaatttaaaaaaatattaaaagacgagtctagaatctatataggaatatatataatttacaaataactaaaatttgatattaaaaataattaataactaacacatatataaaatataatatgaaaactcagaaataaaaatatatatatcggaagaagagcatagagtctatatagaaatacaatttacagaaaattcagaattaaaaaaaatattaaaagacgagtctagagtccctatagaaatatatataatttacaaataactaaaatttaatattaaaaataattaataaatagcacgtatataaaatataatatgaatattacacattagtagttttgtaaagttattgcaaaattttaaattatgttgtcattttaatatatttgaatataatgagaaaacatatatgctattatatgagaaaatataatgatgctagccgaaaattgtgcgggccaccatgctagtttatttgataacaggagaagtttttttttttcgggggataacaggagaaggttaacgttgcaggtgacaagtgacatcaattttgctgaaaagaaattgcaagcacggcaaataagtcggaatatatgctggagatgaatagatgccacatgtatgtgtgctttggttgataaaatcgacaggtggaacagcggaagcgaggaatttattcgaagcttcaggaacaaaagagatgaagcttctcagaagtactagaagaaatgaagaattcactcaagaggcccagctccttccggtgccttctctgtatacttttttttttgacaccgccttctctgtatactgatgataagaaaacgtggacaccagataaaacccaagtgtttgcgggcacagaagcgccagccgttgcattctggattattgcatttatgattttccatttttcacaaacgaaattaaaaaaaatattccggacacgtgcatctttttatataaaaacaaacagaaattatactggcctcaagaagtaccgaaatgttttttaaaataaaattttggtacctctgacatcgaaagtattgaaagtcaataaattatacaataaaaatatatggttgcttctcatgtaccgtaaaatgatccctcgaatagtaaataaaataatttaccaataaaatgtttatatatatgtgtttttattaatttaaaaatatataaaataaaatataatgaaaaacataaaatcaaacttcaaaattagagaagttttattgtcattgagaaagaattttaagttacctaaattttacactgaaaattttaatgactcgagaaatctagtacttaagttatcaagttttacactagaaagtacgacgattctagtattttttaagaatagtaaaattagctttgaagttaaatttaaataattttagcttataaacatagacgaagtaatgcggccttaaatttcacgatcagcctttcaacttcgcatgaattcacgaaaaggcaagagagattccgctctcatgtcgtaagtcgtaactctgacgcgaggaaaaacagtcatatcgcagtcaaagaaatacacatccacttgactactcacgattcggtttgtcttcacaaattcctagttgaactcttcaggtgggctgtctgcgatatgtacagggttgcacgaggattttggccgctgaattgaacaaatccatccacatttacgtttcaatttttttcaaaaaaggaaaaaaaacattgggcacgcatgcatggataggagcaagtgtaacaaaaggataccccacaaatgctgcgatatgcatgccaattaacacgtcacacctgtccacactagcaccatgcataaatggactttacgatcatgggtcatggcagctttgcagtgatcgaactccagaagcgtagcgttcttgcatgcttggcgctagctagctgctcttgcagtctactccatccgttaaaggttataaaatcaaactactttaaattttatcaagtttatagaaaaaatagtgatattttcaatccaagataagtttattataaaaatatatttaattatgaatttaataaaactaatttggtaatataaatattattatatttatctataaatctagttaaatttgaagcggtttgattttgactaaagtcagaacatcttataatctgaaatgcagtaattcacagcacattttgttcgaaatatttactgcttaatgtttatgttttttttccttgctgggataattaaaaccaatcctaagttgccaaccatattgaggagatagcacccaaagatagcacgtacgagctagcacgacgaattaattaaccagcaaaaaaggacgtgttcaatcggcctaccatgaggccgaagttgaagccgacgacgacggtgttggcgatggagatggcggcgagctcgaggtcgccgaggtggccggcgaacgcctgcgtgatgacgttcatgctgtaggtgacgacgcggctgaagatggccggcgccacgatgacccacagcttcctcgactcctcccacaccctcctcctcagcttgccgtcgccgccggacaccacctgccagccctccttcgccgcgccgccgccattcagcagcgccaccctgcactcctcctcatcccctcgcccgtcacccatcgccgccgaccgtgtcgtccgaacgaacgaacaatccaacctcctctgcttcgattaattcttcgattcctcctcttgtgttttcccccgatgtcaatgaggtgtcaaacccaaatggaacgagcgaccgagcgagcagaggcaggtggaacgccttttaataggagaggagttccgtggtggtgttggcgagtccaagctacagctaggcacgcacgagagggcgacgaaagcgcggacgtctgccttgcgtttcgtggcgcacgtatagggcggcgcacgggacgacgtcgctgttgggcaaatctgccgcgcgcgcgcgcgcgctgtggtgtttggtgccaactaacctcgcgttagctcccgtgtccgtggagacggatcggatcatgctgcggcgcacggctttcccgtgttctctcctgcctttccggaaacgatcggctcgatcaaatctggcgcgtacgtgacgcgtgcacagatcgcgcgcgaacaaccctcgagttcgcgatcgagtcctcctagtccgaacacgcgcgaatccactgtgtgttggaactggtgtgcacgtacgactgatgggaatattaaatgagattgttaagtgagatgttggtgtatatattttaggcgcctgtaccgcgtgtgagatctgcggccgtgtcaacacaagattcttatacgttgatcgtgattgtgaatattggggaggactacgtacggagaagctagctgtgctgttgaccaaaccaattaccaactcactctttgagtccatcatggctcatgcaatgcatgtcgcagatcgatcgatcgttacctgcccgggctcccaaaaccggtcgtctctgcacttgtgcagtggtttgatataccgcaggcagctgttgcggcacacggagagattactagtccgtatccgtacacgtcggcagatttgtggctatacatgcatatgcatcaacgtatgcgttggctctctaaacttgcactttaaaatcgcgtttgttgcttgctatcttctcatgaatctcgtcaaaaaactggggttggggggatcacttgctttggaagttcgggtgatgatgacgtcggatggggcccatgaataagactactaactaaaaaaaaatgcgcacgagccctttgttttctgccaagtctgtatacaataaaacctgacccgaaccgaaacaaaatggacatacggagtatataataccaggaggcatcgatcagttatagtgaatattgacgcgcgctagctacgctgtgggtcatgcgtactgccgtagaggacacagatactcccaagccatcgacaataatgtgtatctagaaatcgattggtgtacattgccaactaaccacaaaataaaaaataaaaatgaccaccattaatacaatggtaacaaggtagagtctctctaccttttgcgtcaaaaaaaaataaaaaaataagaaaataaaaatcagacgagttactggtatcatgatggcacacaaccgctggtgacatatgggtgcctacttttgctcacatcttcaagagattcacacgcatatataagcacccaatttgttgggggcggccacctccgtataagctcaaaactgggcttgccaatgagggaggcaaaccgaaaaaagaacacaagtaaacgcccttgaatgggtaggtaatcagggttaagaaagcgagagcaaactgtcaaactgattgcaactccggattgtttactacggagtactccagtagatagaatgtccaaattaatttccaacgggtcactatcgttctgaggtatggacgcgatggacagccacaaacaaagttcagttttccattttgcacagcaaacgggtcgttggcattgctgcttctccatcgcccacccataacattgtagcatcacaccactcgttgcgttcgtcattgcccacgtcttccggaccccgtctttggaacaagcaaagctatagctcttcgcctgttcgacatggatagatgcatgccattttatttttattttcattttctttctgatgagatgatgcatgcatatgattgtatagtactccctccgtccataatataagggattttgagattttacttgcaatgtttgaccactcgtcttattcaaaaatttttgaaattattatttattttatttgtgacttactttattatctacactttaagcacaatttttcgttttttatatttgcaaaaaaaaaaattaaataagacgtgtggtcaaacgttgtaaacaaaaacttaaaatcccttatattgtgggatagagggagtactattaagttcgatcttatccatgggcccgtggctgcgttcgtctgccgatcatgttcatggccgacgaagtagcaaaggatgcagctgatcgatcaaactgttgttaatcaatactggcatagtaaaggatacagctcttggctacgattaatagcgacgtagctcttggcaccatgatgcatgtggttgtgagttgcgacgcgatggtcacggcaaaacttaacgagtcgtggttcacgcctcgatgtgtagcgacatgtgttccctctcgtagtgtcgcaggatacatacattatatgtggatgtaaatcatataatcatgttaataatgcatggatctgtttatgttacgcacatgaagcccaggcaggacgtgatgccctcgtcgtggtgcggcgatcgagaggggaattttggatcggtgcctgttgtctccatggatggcagacaaaccggtagctgtatgcaatggttttggaattttcgtacaggtttgagtgattaactgattattatcactgtatggcctgtgaatatgtgattctctcgccgacacaaaaccgaactgaagtgatctgctcctcgcacgaaaacgccagcccagagtagacgtgcaaacacaagaggccggccctgttttttgtactgggccagatggaaataggactcgtccaagttgagcgagatgggccttggtgggttcaatctctcagttaccaggccacacggccgaaggaggagtgggctgccggcctgagcgaggccgatcacaaggccgaacaggatggccaattagcgcagctgcgtctcacacttttggtccacaaatttcacgtcaaagtttcatatgagaagttttcgaatgaaaattttcaggtaatttttttcagatgattttttttttgcagatgaaagttttacaaataaaagctttcagataattgtttcaagaaaaatatgcgttgatgaaaacgtagctacgctaaatagcagtcccctaaccccaagacttttaagacagagaattcagctgcattctctgcaccgtcgtgtgtcaacttgaccctttccacggtgtcaactaggaagctgggagtaggtgcgcccgttcgattcgcctgatggattaatgttgggttagttagttaatcggaacacgcatgcagattgttagacatgcaggttccaagcgacctgcaaagcgcggctgcgatcagaagaataatggtcacggtctcacggattagttgggtttcagtttgacctttatttgattgatcgaccaaggtggcacgtacgtctccgtactcacatctgattatttatttatttattttatttaaattacacagtacaacgcagacactcacaacatacgcataatcacccctatgaacacacgcacgtaaacccaacccatttgagcatcttcgaagactgggctagcaaatctatcttggagtcaaacccaggatctaagatgctactgaggctattgtaaccactaggttatataaactttcgctgattatttatatgttttgagggaaatacatctgattatattagtatgacaatttccagcttgctgtcctaaataagttatacctactacggagtagatgctaactagattgaacatatatagtaagcatgttgtctactcgactgcgtgcagtacgcacccaaggaacctgtggattttttttcttgaaacaaagaaaaagaaaaaacagttatccgagctctcaacatgcacaatcccttggtcttttcccgtggtaggtgaatgcacttcaactctgacaaacaagatccatgaaactgacagagagcttatatgtctccgcgcgcagatctcatgcatgattcatacggtgactattgactatcgactttcttatgagctaataacattcatacgagatagtcgctgttaattactacacacttaccacctactaataatccccttcaagacttagcacgcgtgcctgtgccttcccctgcaaatctcaaatcctaattacctgaaccatcggcgacctcgagagataacgttcacacaaaagcggaacactttgatggaataactgaatgatggatcagctagctgctagtcgatgtctcgcagttggtggaaatggaatacgttttcagcacctgctgggatatcattgagaaaccaactaacgcattatgcatggtgccgtaaagttaaaacgaatggaaacatagctgaacctcttttctcagacaagagaatgagatagtgtgatagcttcaagttttaacacatcatctcattaattaaaagtcaatatatacaacacatttatacattacttctaggcttctagcacttttatatcctaatacaccatcatatataatttttattttattttatttgtttgctcttaatttattgatctatttttttaaaataaaattagaatttgtgcactcactctgaaaaaaaatctaatcatttgtctagatttaaatttagaattgggtttttttggtacggaatgagtagagatgatctcttaccgataggtgactcatgctctcttctcttctccatcttatctaccgaggagttttcatgtatttttagtctctattatacttttccacaccatatcggagtcgttcctgtctgtgactgtcacttttctgaacttactgccaccaactttttactgtgtcatgcagccatatcatcaccatccatgatcagtaaggacactagctaggtaaagtactggggaattccatgtactggatattgcatatgccaaattgccaatccacaagagtattaattaattgcatatgctgttggctgtatatgcggcagataaaatttaaattaatactggaacaacggactggcggtatgtacaccacaaattaccacaatgtatacagtttaaacacatgcagagtccaaccagtctttaattaactccaggcaccaacaaattaagctacaccaaacagcggaggggaactaatcaaacgactagtagtttcttcggtttgaacagggaaaaagatcgaagcaaaattctattaggtaaaataatccaaatcatcgatatatttaggatcgctatatatagttggagagcaagatagcacatgtgttaattacccggtcttaacagccgcttgaaccaaacggaacaagcaggcactttccacggaggcgcttctgcttgttttgtctcactaaacaatgatcaattagctagtctccgtgtagacgcatcacggatgtgtgtggattattgggaagaaaaaaggacgttaatttgtttcagctcagtactatatttcactatagtactatctacttggactagacccatgacacgtcaggtcatcagcttagctaatcctacggagatgcatggtggttggttatggatgcgaatgattagtacatgcacacacggtgggtcgtcaaacgcagcaagtccaagcacatggaacgttgaacatgtttgctcacaacaggttgctattacgagtacttgtggtcaacgtacgataggctttactcggtcataaacttatatatacattaagcgtatgatttgctgaaatgataacggataagttttagatttgtgacattttgatgcaccttatggtcacgcgcgtattcatacgaaagtgattttgagatatatatatatcaagttccaaaagaaaaataaattcatttcaagttgaattagtctgaactaatttcatgagtacatcatgtcatcatgtatggaattatcacaccatttcctttttctttagaaaatatcacactatcagaactagctagcctttctctacgctagctactccatcagttcaaaaatataacaacatatgattgaacatgacatatcctaatacgattagcttcaaataaaaaaaccaacgttggttttgtattaatttctactactatatacgaaggggtacccttttattttgtagaaaaatcagtattaattcattgtacgcatgcaacaagtggagtccctagctactccctagccgtagcgtgtaacaagtggaataatagtccatttacactgtagaggtagctaagggacgatttctcaagtatcttcagaacaaacatgtctgttgattattttactgtaatccctgtgtacttcttgtctccttcctttttgttgactcacctactctgttaatctctacgttactccaaatctccaacatcttctcctagaccttcacatccttcacacatctatataaaccctagaacacaccatgtcatccaacacccaagcagattaagctaattaactaccatcaacacaccctaatccaaaggtgccaagcttgcaggaaacagtaagctagctagcagtctagcactgcttcatttgatcatggccaccattactgctgctagtcccagacccagtgctgctcctgcagccatggaagagaccagcaaggcgatgcctactagcgagtggcctgccgccagcggcggcaatgcgtcgccgccggcgaggtcccggccgtcgctgctggtcatattcagcgcgtgcctcgtcctcctcggcgccggcgggccgctcctcctccgcgtctacttcgtgcacggcgggacccggctgtggctgtccgccacgctccagatctccggctggccgctgctgctgccgccgctgtgcgtgtcgctctaccgcggccgcaggcacgggatcggcaacctcctcctcccgcggcgcctcgtcggcgccgccgccgtgctcggcgggctgtacgccgtgtcgtgcttcgtgtacgcgctggggtcgcaggcgctgccgctgtccacgtcgtcgctgctgctggcgacgcagctggccttcaccgccgtgttcgcgttcctcttcgtgggcctccggttcacgccgttctcggccaacgccgtcgtgctggctgcaggaatt

SEQ ID NO: 75101 - DNA, 55004 bp, Oryza sativa
caagctttcaccaatgtgggagggtccgtatcgagtgatcggggtcccccggccgggttccgtaaggctggccacgggggcggcactgagctgcgaaacccgtggaacattgaacaccttcgtcgcttctacccctgagggggggggtcgggtgtcaggtttcgggctcgggctaaccacgcacccccctcgggtgtgcagggttagccgggggctaccacacatgcacaaccttacttttcttattttagcatttcaataaaagcagtttcaatttcctaaaggttgtgtctgtgccgtttttccttctaaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggcctcgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgtgttcggcagctgcgaggcgggcgactaagtcgctttcgcccgtagccgccccgccgctgcgcttcctcgcatccagctccttttctcgcgtctcgaggttagcagcctgttgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccctgtcgcaagccgccccggaggttgtcgcctgagcgtcacccgagggagtgggcccgagcgacgcgccggcggtcttgtcgtaaaccgcctcggaagacgccatcgcctctgcctggcgagcccgggcggtttcctcccgggtggcttcttcagcctgacaagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgcgccgccccgccccctcggggaggagatgggggaggtattcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgagggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattctggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgaggcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagggcttgagatctcaccctaagcccccggccgaactggcaaaggggggcctgcgcggtctcccggtgaggagccccgagctccgtcaaatgccatttcacaattattcgaattaattcaaagttgaatctttaaactagcatagcttggatttgaatgaaacttaaacctaaatttatctaagatcaagatctatctgatggtatcacttttatcatttattttgtattatatgaatttatggtgattttatttgaattctattcgaattcaaataaaatctttcgtgtctaaatctagatccctaggaagttgatgagttgagtgaagaccagggtcagcaaggctgtgagcaaggcaagtcatctctaatctttgagcatgttaaacctattgtgaagttatgttgatttaagtaaaatttgcatgctatatatatatacacacacaccatactttgatgttgattccctgcaattatttgtatccgcaatattgtgtctcgtaaatctaataactgcttagtcaatgccacttagattcatgcacatccatgtttatcaaatgctatggtggtgtttggatccagggacttatcggatgtttagacattaatttggagtattaaacatagactacttacaaaactaattacaaaaatgagatctaattcacatgacaaattttttaagtctaattaatccataattagcacaagtttactgtcatggattaattaggctcaatagattcgtttcacgaattagtctagggttatggaataggttttgtcaataatctacatttaatacttctaattagtatccaagcatccgatatgataggaactaaatttttagtcccatccaaacagcccctaaatgcttgggcatctactttggggaagctagttgatatacggcatgtggagacatgagcgccactttgatataacatgaacaaaatggtttgtgaaaggaaatctaaactaaacaaatgtttttagactagtggctggatgacttgggtggtgtccggtaaaggctagtgccgtccttggtctgttaaggaccgtgccttgaagctaagcatgaaatgaccctagtacaaccatacttctcgtatgggtatagacctagcggagtaaatagccgagcagaggtggtacccaagtgcactggttttcatctaggtgtgtgaataggcggggagcctacggtgggtaaccatctgtgggcaaccaaattaaaacctaacttaactataacttaacgcatgtgtgagtttttccctcctcgggaacgccagaactcctctcactactagaaaccatgtatgcctagagtgcatgagggctcaagttcatggagcgggtactgccaaagtgaggttattgaaaggctttgccatgacgcatctcattcgttcggactttggctcatgtgttgggcaagtcacggcgtacaggtggagtgtatatccactacagtgtgagtaaaccaacatattcgaatagctgtgcgcgtggatattgagcaccgggacatgtgttacacttgcctagaatctaaattcttaaaatgatgggtgggatatgcatgatgattttgtactggtggatgaacttctcgaaaagcgagaaagggtagaccctagaaaaccatgatggtccagtggccggaagctatccttgggatcacaacggatggtggacagaagcgttactgtttaatgaataatggtattaaaacctgatcagtctatgctaggtcttaggcttatgaaaagaattacaaaatgagctttacacaaaaagaacctttaaccattccttgaatatcctctatgatatgcatcgttgagtgtaattaataatggataatttaatacaaattaaatccagccatgctttatatttaggaaattttattttcccacatttaacttcatttgtaaattaataaacatttaatataaattctaaaaataatttataaattctgaaacgaaaatcaggatgtgagagtgggttagcccaattcaggtagtgtctaagaaaggtggaatgacaatcgttaaaaactcaaaaaaacgagttgatcccacaacgtaccgtcacgggctggaggatgtctatcgacaatagaaaactcaaaaaggctacaaagtcagtccccgttgctctttgttgacagttattaaataccaaatttaaaccgtcaatacatgcataaatctaaaaatataaaacatccaacatagtggtagggtttaattccagcaggaaaagcagaactcgaactacacacaagctccaagtcacttccagatcttcattgcttgcatggtgtgtcactcgcattgtgttcactctaatatccttcctgggtgccaaccataacttgtttacaagatttcatttgtgacttggtttagcagcacatccacccattgcagcttgatgacttgcctcctatgatttatgtagaactaaatgacaccccgcgcgttgttgcgggcataacttgatttacatagtagatttttttaaaaaaatctactgatcctcatcatcaagcatcgaagttgagtactcctaccttgctcagaaagcgtaaaaacatttgacatcaatgatgcaagaaatcactatgagagcgaagaaaattaaatataaagaccttttgatcattacgattttcaaatgaatgaaatcacagcacatgttagtttgactccatatgcatttgcatgagcttgaggtagcacattggggaatgcacatggccacaacccacaactatgtatcaattgtatacaacaaaatgagaaaaaaaaacagcttgtaaaaatagataaaatagaagaaatgagtaaagatctgcacaagctgcaattaaatctttggataattacatatccaatattattagtttttacttcatgtgctaaaaaaagtgaactgaatgatttatcatgatcagaatatgaattttcgtcgcagattttcactgcagtgggatcaagttccatagtgaaaaattaaagcattcaaataggttcctctagcagcgaatggcttaaattcaagaattgagtaagggatgttagaataaatgggctaggcccgatttttctattaaaatctcaagggccaataataaatgttaaggataataataccagcttaggaattaaaagtggagtatctcaacttaaatagggagttattggaggctccctgttgaccggtcgaggtggggatcggaaagccacacgcgcgccgagccgagccggccgggccgaggccatgggcgaggcgtggcgtgcgttgcattgggttgggttgcgttgcgtctctctctcgatccttttgcaatggaccggaatccaaccccgcgagattgcctctgtaacgggcaggcgattcaatacgcattgatcgcgtcgttactatggcaacgggcggattcctctcttgcgctattaggaaacagagacccccgatcagatctccatgctttctctcccatttctgtttccccggttctgatcccgattagatctccacgctttccttcccatttctgtttccccggttctgatcgcttgcgcgcacgagagatcggaacgagcaaggcttttggggagtgcttccgcacgactgctcctcttcttctgttcgttgtccgttcgtctgcatcacctgactgctcctcttcttctgttcatcgtccattcgtctgcatcaccatgtcttctggagatggcgcacccggaggcaaagctggcgcacctggagctggagctggcgcaccgatcgacaacaccaacagagacagttctacctcacaatccagcgaagggactttcacagggtataacattttgtcgctatctctgtttttgttacttctgttagttgcaatgttattgcgttctctacatgatgatgatgcttattctatcttaagcatgctcctggttatgtttaattttatcactagatcacctcacattgttcatgtcatgattattgtcttaatattttggattaaaatatgccgatatatgactatatttccaacaatccaaaaacctgatatatcattttcggtagttgtctttgttgctgcactaaaaccacatacttttgatggttctaattataaaagatggaaagcacgtgcactactgtggttgacagcgatgcaatgtttctatgtttcatggggtaaccgaagtgaaccacctctctctcctgaggaggaggttaagttcgaggcttcggattgcctgttccgtggagcattgatcaatgtactcgctgacaacatagtggacatgtatatgcacaatggcttcagggaacgacatgtgggatgcacttgaggccaagttcggagtttctgacgccagcagcgagctatatgtcatggagaagttctatgactacaagatggtcgatgaccgttctgtagtggaacaagctcatgagattcagatgctggctaaggagcttgagaacaacaattgtgagttgccggacaagtttgtggcgggtggcattattgccaaattgccacctttttggtcggactttgtcacttctctaaagcacaagagacaagagttcagtgtttctgatcttattggctctttgggtgttgaggagaatgcgagggcaaaggacaacttgggcaaaaaggtcgagagaggttctagtgccaatatggtacaaaagaagaaccctcaagcatcccacaacaacaagaaagttaagcctgatgtcaaacccaaggctacaaccaattttaagaagaaaggcaagggaaaggcaaagggagactgctttgtgtctcgcaagtctgggcattgggccaaggactgtcctgaacgcaaagacaggaagtctgctaacatggtcattagcaagggcggaggaacatcggggtacggtaaaattttacctacagttctctctttttttcattcacctaattggtgggttgatattggtgctaatattcatgtatgtgctgatatttccctgttttcttcttatcaggtcgggagaggtttctccttgttgatgagaaaagggtcacttgcggctgttcatggtgttggtacggtcgatatgaagtttactttgggaaagaccgtgcagctgaagaacgtgcaacatgtcccttcaataaagaagattctagttagcggctctctactgtgtagagaaggttttagacttgtgtttgaatccaataaatgtgtcgtatctaaatatggaacttttattggaaaatgttatgacaacagaggcttgttccgcttttctttggatgacatgtgtaataataataatgttgttaaccatattagcgagaatgatgagtccaatgtgtggcattcgcgactttgtcatgtgaatttccgttgtatgacgcgcttggctaacatgagtttaattccaaaattcactttggtcataggttccaagtgccatacttgtgttcaatcgaaacaacctcgcaagcctcacaaggcatctgaggcgagggatttggcacctctagaacttgttcattccgatctgcgtgaaatgaacggcgtgttgactaaagggggaaagaaatattttatgacactgatagatgattgcactagattttgttatgtgtatctattgaaaacaaaggatgaagcattgcattactttaagacctataaagctgaggtagaaaaccaagttgaaaggaaaatcaaacggttgagttctgataggagtggcgagtatttttccaatgagtttacatccttttgtgaagagtttggaattattcatgagaggacgcctccctattcaccccaatcaaatggggtagctgaaagaaagaatcatactctaactaagctggtgaatgccatgttagacactacaggactttccaaggaatggtggggtgaggcagttttgactgctttgtcatgtcctgaataaaattccaatgaagcataaggaagtaacaccattcgaggaatgggaaatgaagaaattaaatctctcatacctacgaacctgggactgtttggccaaggtaaatgtacctatagccaaaaagcgtaaacttggaccgaatactgttgattgtgtgttccttggttatgctattcacagcgtgggttatagattcttaatagtaaactctggagtacacgacatgtgaattggtacaattattgagtccagagatgccacattctttgagaatgaatttcccatgaaaaatacgcctagcacttctagtcaagaaattgtcataccccatcagcactttgcaccgataaaacacaatgatcaaacgcctgagggaaatcctgaggaggataagattgtagatactcgtaagagtaagagacaaagggttgcaaaatcctttggagatgactacattgtatacctcgtggacaacactccaagaaacatagaagaggcatattcatctcctcacgctgactactagaaggaagcagtacgcagtgagatggactcaattatgtctaatggtacttgggaagtcgttgagtgtccatatgggtgctagcctgtaggatgcaaatgggtttttaagaaaaagcttaggcctgatggtacaattgaaaagtacaaggcaaggcttgtggccaagggttatacccaaaaagaaggcgaggaattttttgacacctactcaccagttgcccgtttgaccacgattcgagtactacttgcattggcagcctctcatggtcttctcgtccatcagatggacgttaagacagctttcctaaacagagagctggaggaggagatctatatggatcaactagacgaatatgtactagaaggtcaggagggaatagtgtgtaaactgttgaaatccttgtgtggccttaagcaagcatctaagcaatggcatgagaagtttgacaccacacttatatctgctggttttgtcgtgaatgaagctgacaaatgtgtgtactatcgctatggtgggggagaagaagtgatcttgtgtttatatgtcgatgacatattgatctttgggaccagcctcaatgtgattgaggaggtcaaggactttttatccaagagctttgaaatgaaggatttgggagaggctgatgttattcttaacattaagctactaagaggagatgagggtatgattacacttgtgaaatcctactatatggacaagattttaagtcgctttggctacagtgactgcaagccagctgctactccttatgatcctagcgtgctattaaggaaaaaccgaagaatagcaagggattaactgagatactcccaaatcattggttcattgatgtacttggctagtgcaacgaggcctgacatatcatttgctgtaagcaagctgagccggtttgtctcaaatccgggagatgatcattgacaggctctggaaagagtaatgcgctatctaaatgacactataagctatggaattcacactaccgggtacccaaaagtactggaagggtatagtgactcaaactggatatatgatgctgatgagataaaggccacaagtggatatgtgttcacacttggaggtggtgctgtttcttggaagtcttgcaagcagatcatcttaacgaggtcaacaatggaagcagaacttacagcactagatactgcgacagttgaggccgagtggcttcgtgaactcctgatggatttgccggtggttgaaaaaccagtgccagctatcctaatgaactgtgataatcaaacagtgattattaaagtgatcagttcaaaggacaacatgaagtcatctaggcatatcaaaagaagactgaaatatgtcagaaagcagaaaaactccggagtgatagcattggactatgtccagacggctaaaaatctggtagatcagtttaccaaggggctactgcgtaatgtgatagacagtgcatcgagggaaatgggcttgatacccacctaaggttgcacaatagtggaagcctgtccattgtgatcggagatcccgtgaatttggattgcgaaacaaactattgtgtggctgagagaagagactcttgaaaaggagatattgaactatatgccacttttagatgtggcaattaactatttgccactggacccacatgtcatagacacatgtggacctacatgtcattgagataggtgtggcaaatagttaattaccaaatctaaaagtggcaaatagttaaaagcccccttgaaaagggctcattttcatgatgtacttctcttctattatgcatggtaggatggcttatgccttaatgtggttcaagtggcttttctaagcagagatattgacctgcaaaacatctcagaaggaacacacctatatgagttcgactgctagtcacagtctatgagatttgggcgatctctagatactcatgaaagggcctggagtttgacttatatgctccaaacagagcggatgcaaacggcagcccagtaccagtcaagggtttgagtgaaacctgctcacacaagactgacaattcaaggcatagtccattgttcagttgtggtctgatgtaactcttttcctaggtggaagttcaacttaacagtctccaccaaaacactggtatatcaaacaggttgaactttgagaacatttcttatgagccatgaaatttgttggggattgttagaataaatgggctaggcccgatttttctattaaaatctcaagggcccataagaaatgttaaggataataataccaccctgggaattaaaagtggagtatctcaacttaaatagggagttattggaggctccctgttgaccggttgaggtagggatcggaaagccacacgcgcgtggcgtgtgttgcgttgcatctctctctcgatccttttgcaacggaccggaatccaaccccgtgagattgcctctgtaacgggcagacaattcaatacgcattgatcatgtcgttactgcggcaacgggcggattcctctcctacgctattaggaaacagagacccgcacccagaggcggagctggcgcacctggagctagagctggcgcaccgatcgacaacaccaacggaggcagttctgcctcacaatccagcaaagggaatttcatagggtataacattctatcgctatctctgtttttgttacttctgttagtcgcaatgttattgcattctctacatgatgatgatgcttattctatcttaagcatgctcctggttatgtttaattttatctctagatcacttcacattgttcatgtcatgattattgtcttaatattttggattaaaatatgccgatatatgactatatttccaacaagggaaacctaactacttaaatcatagccaaggtgacaacatcctgaaactaataagtcatgtaaatctataatcatccaaacgattaccctaaagatgtacaatagtaaaaatataattttagtgcagtggtgacttatacctttgagagattaaaaaaacagaggtcatcaggaaactatgatgccttgtgaaagctacaatttatcgagcagaatcagtggcagtagaccgccaccgttattgaaagttgagagtggttagctcgaagctgcactactgatgataattaatggccagaaacatcagagatgatgaaaaattcagtttgcagcaaagcaatgaaacaaatgttgtgtggtgctcaaatgtctaattatactcatatagcaagcaattgatctgacatctggatatatagtgacatttatgcatgtgtatacaggttgtgcacttgtgcgaaaggatacagcatagattcattaagtaaattcaaaggaagatacacatagaaaatgtcagttacagatgatgagagaatcaggctgagcaacagggcaagtacatggtacttcttgttggtgatgcgatgggatcaggggaagatttcaagtgacgcagaagaactatatattgatcggacggtctatatatattgagagtaagctggcagctagatcgacgataatgatcgtgataatttctgggttagtggaggaagatggagaggattacatggcgcaataaaaacaaaaacaatcgtggtgatgggtggaataaaatggattaaatgcgatcattcgcctgctctttcatggcgacagtttcagcattggcgaatgatttccatgggtggaaggagcgcagctttaccatttgattaggaggtgggtctacctgggctgacccagcaatttgggcacgttttcttgtaggtaaatgaagatctaatggtatatatctgatgtacatattgatcgaatggctgatatgatgttaatgacgtggcgaattggaggtagctttgggttttaactttatagaaagaagggataggcaaggaagaaacccaaaagcataaatatttaattagttccacggaatgagaaaacaatttatttctaaaacaacactaatatctaatttggcagatagaccactgaaaaaatctattgttcactgcattccaaacaaatcgagaaacttaaccacatgtgcatgcatctcctgatcaactcatcccccctttacttaatcatctaaaccttctttcagaacttttgccacggtataaagggtatgatattttcatgcccacaaagatgcagcttaatttaacatacactcacctccaccacaggcagcgcatcagtccaactccctgacttaataatctaaccttcttccgctgcctgatgcttgccctcgctgacccagccgccgccatcagctggcgcacgtggccaggagttaggcggagggggacggcgacagcggcgcataagttgatgagacctgaggtagggcaattgtaggtgagcgagccgacggcgtggaggagaggtgattctagtccaatggagacgagatggggagaagggaaatcacggccagagaaaggcgaaccgtcctgctcgatgactccgctcaccctaactgagccttctcacaatgcgcctggagccgagcggcctgaaccggatcccgactccatccacgcgtcgggcatccgactcgggattgcagggattggggtttgcagctggtatccacaacgtgcgcaggcgtgaggagacgtgcggagtggtgggtcccacgcagagtgggagagtgctaattggatgagagcaaggctaataatacagccaactacttactgtatagatctttatggcatatctatcagctcactcatatagtggttagctcttcagtataaatatatagttcatctatctatttcatagattttcttggttcctgtacctaagccagctgtaaggttacagcccgcttctcatctctctcctttcctctctcatacacctcagcatttagccttcttattgccctctattatacttgctctgatggatccaactcttggtatgaaccattggatgaatagatctaagagttagaaaatgcttgttttgatgaaactggtgtgttttatattagtagagatagagatgttgggtgactattgcaacttgattcttgtcctgaacaaaaagacacaagctcatcaattaaggtcaataagcagcagcatcgcatgtacctaccctctcaccaattaggagaccgcatcatctcggcactctcgccaggcaacaaccaccaccctacgcctagaagggtgttggttgggcgctggagtgggaagcgatgacggtgccgatggcctagggcatgtgcaggaagaggcaacggcttagtatgcgcgagacgggcagttgattgggccagtgaggcatggaaggaaaccggcgagtaaccgcatcagtgaaagccagggacaagactcgagcccccctctccctcatagcgcgaccaagatgtgccctcgtgatcgacagtgtgtgcagtggaatggagactagagagcatgcatgaggcggtgggctaggggtgagtgcagtaggcggtggcagccgggtagggcaagtgtgggaggaggcgacagcggcttagtgcgcacgatggtagcggtgggctggattcggtggagcggcgttttctggaaggagtcaggagtggagaagtgttattttttaaccgaccactattttggcggtgtgtagtggacatcgaggggagggatccctaattgcagatgttgaatccaactcgtaatatggaacaatgttagattaagagatcctatggataggaaacatctgtgtacatttttctacgagatgaaactggtatattttatattagtgtagatatagaaataagagaatagatgtatggggagtgagttcagtcaatgacaagtgggttgagatgagaccttgttaatcttaccattttgctagctagctcacattgtccaatagaaaacatacagtaactatatacgtctggttcagcactgaacccaacgaaccactgaccaacttggtgatgggtcgaccaccggtccagtttttttcactatggtgtccacgaaacactcgtccgcgtcaacaaaggtgggtgcatgtataaatagtcaaatgggccaccagacacgtcctggcccgagcatgactcgaggaccgaccaacttgtcatgacgtgccgtgcccgcccaccgactacacctacggcccaggcgcggcccaataaagcacaggttgtgccatgccagcacaaaggcacgatcagcccactgtgctcgtccttcaataaagtctattgtacctcactcatttctttggtccatgcctcatatggctggaataagtttattttacctccctcatctctttggacagtaccttatatggctggaataagtatatttttctcccttatctctttggcctgctgatcgttgggccgtgccgtgccaggccagcacgtcatgctgagaaaaaggcctaggcatggtccaacggtcaggccatacctaggcagccatacattggtgaggacctagcactatggctccgtttctcctctagtcgaatgcgtcgaaggcctcaagttactgtcttatggggctggaataagtctatttcgttttccttatctctttgggcatgttgatcgttggggcgtgccatgcttggccgacacgtcgggctgacaaagaggcctaggcagtaggcacggcccaactgttgggctgtgctgcgcatgtgccaagccaaatctccatgctgtgagtcaggctattgggctgcaaaccttctggctaactataggcgcctaggcggtgacacatcggtgaggacctagcactatgactttgtttctcctactagtctaatgcgttgaaggtctcaagctaatgatatggcttttcctcgtcattatccaattagagacaaacctactggatgcatggattgctcatcctcgttgtcctaggagtaggggaaccgaggaaatgatcttggcgaaactgcagcagatgtgaaggggggaaggggagaagaaaatcacgccttggaaagagtgattcatcattcaaagggacaaattgagtgggcccgaggaacaacgatgaaaattttgtggtaggagagaggaggacagtacatttgaaggtggcatatggacttctagatacgattatgtttccttttttgcttctcccgcgataacaaccatggacggacttcacgctatatgtgcattcccaagccagacttgtagatgacagactaaacgaaccaactgtgtgtaacgaatcatctttatttttataatagataaagataaagacataatagatagatagatagattgattgataaataatattaatatatactcgctctgattcatattataggtcatttgactattttactactttaggtcgtttaggtttaaccaagtttataaaaaaattatcaaaatctactatactaaattagtttcattaaatgtaacattgaatatttttagataatatgaattattctattcctctcttccttttcgtaaccgcagattagtggaggcgggatagctaattgcaggggtgatccaactcttgatataaaccgttggatgaatagatctaagggttaggagagacaggtgtttgatgaactcgtactttttatagtagtatatatgaaacggagggaataatagatatgtaacgtaggccgctccaaggttacaagaggagtttaatttaattattttcttttatcttttccgtcataagtaatagaaacaaatttataaaaagctcacattacaaactataatgagcgaggtaactttacaagttaaaagtatgtgcgcatacattaaagggaggggtgtattttacaattaaagaactgatgaaaatccaatagcctgtgcagatgaacaggtagacacaactgaatacaattacatatattgtagtactccactaagtaaaccgattgtcccactaaattagatgtgcacaactagatcgatcagaaatgatgaagtgacagtgataaaaatgtgctttggtgaccattagctgtttaagaacctttgcttgaaatgtgtggcaacaactacagcgaactcataattgtcaagctcttcttgtcatctttgttcaacaaaacggccatctccttcttgaacctcgccatggccaccctgggcagcagcatcgacaccaccgtcgacacctcgccggccgagttcttgcacctcgtgtggtcgcttccgagcttggaggtgagatcgcctgcgagcggtatgccgccgccggcgaactcagcccacccgaacttgagcaagttcacggtggtccacttgatgtcggagacctcgtacaccctgtccatgctcgacggcggccactcccgcagctgcgccaccgtctccaccatggcgctcatccgctcccgcgtcatcccgcgcttggtcctccgcacgagctccaccgtgtcggcgagcggccgcccgaggaggtcgccggcggcggcctcggcgacgggggagacgtgcgcgttgccgtagaagccgcgcgggagcggggtgtgcgcgttccacctcccgcgcgcgttcatggtgatcattagccggacgcggaggtcgggcccgtacccgagcgccgccgtgcggcaccgccacatgacggcggtgagcagctcgaacaccgtggtggagtccgccaggtgcgccggcagctggccacgcaggtaggacacctcccgtggcccgaacaggaagtactccaccaccatccggtccggcggggtcgacagcatcgcgtcagccggggcggcggcgcggcgagcaccgttctgtagtgccgggctcgacgccgaggccgacgccgccgccgccgatgcaaagggcgtgcgtgccaccgcgccgctacctaggcgtgctgccgtgagtaggtccctcctccatacgggcagaatggtcggggctggctcaccacgtgcgaggtcggctatggccatgatcagctgcgccatgccgaagccgtcagcgatgttgtgacagatgtggaagcccaggacgaatccgccgcatttaagttgcgtcacctaatgaaaccgccacatatagaaatcagtaacagtcaaattaattaattaattagacatggtaagtatggtacctccatcctaaacacttctatatgacattggtcagctcaatcagaaataagaaacagaggcagtatatattcttataaaacattaaaagaattcttccgtgctcgagtattgtcagtattatgtgaaaatccgaccttttatgttagtatgaatatatagtcggaccatgcaacttgatcccatatgtatatgtgtttatatatctgtacaaattcatatggatgctagtgaatttaaatgagggatggagaagctaaaacgttttataatattgaaaataatacaacacaacattaccacattcttaattcgcaatcttaatattgccggcccatatatatatcatccaactgcaacatcacactccagttggaacccctcttgatgggcccaaagccagtccaactaatcgttgtgttgaataaccatttcaatgcttttctggtccaatcccattcaccactacttcagactaaatcttagttaatgtggctgttgtatttgtattttaagtttttgttatcaaaatatgatgccacattcattgtatttctcatgtttgtggcagtgttcaaaagaaaagcagtttggcaactgaaaactataaaaccaattgcacagaaaagagatttgttaactccagaactaatttgtgcataatcaaatctgcaaatctaaagttggattatttcttgcgtaaatgaagatcagtgggttgctgtaattaatagtaggtacaatccctaccaaccatgcacgaagctaccatcactgttctcgtaacaatgtggcgtccttacgaatccttattaagatcacggtccctagtaccagtgaacctaaacccaaccaaagtaatattgttgtcgaatgaatgaatcttgatccatgcctacaaccaatccatagggtaaataagatggactgtaaattaatcatgtcactaaaacacaaataaagtatttagctacccctccaccataaaatatagcgatataatactggattagagacatcacaataaatataaatttaaatataccacagttcagatctgtaatattaaaatatgttttatttagttggttatatcttaggacggatatatagtagacaggttagttaaacattaactgagtggtggattgtaaacaaaaatgaaagaaacaaacgtacgtcgtcgtgggtgttacctgcatgaggagcaatggtttgccaacgacagccctggtgtcgccggcgtcgcagagcagctcgccgacgcacgggtacggcggcagcagcggctggccgaagtcctccagccgcacgtcggcgtcggcctccacgaacaccaccccttcggccgtgcagtccaccaccagccggttccccgcgccgccgccgtcggcgacctccctcagccggccggcgacggggtagtagtacaccagcgcctccgcgagcgccgccctgatggccttggccgggtcggccggtgcgccaacggcgccagctgcgccgccgtcgcatcggcggaagaagccgaccaccgtctcgtagtaccgcagcgtccgctggtcgtcgaggtcggagagctgcttcgtctcccgcggcgtcggcctcgccggccggagcagcaccggctcgctccggcgagatgtgaaggtcaccaccatggcgttggcacactttggtaatgcgaatgcagcgaggttgggcgatgctatctatgttcttcggtggttcatatgtgagcttgcttgatggtggcgcacggatacgtcggttttatatccatctgaaaattaacattggtttaattttctcctgtaagtaacacttggagaatattaaatgctttcaaccattaaccagaatttactctggcagtcgtttctagggctaattatacgatttttatcacttataaaggcacggccccaaaaaagtaatggacattcatgagttacagcatattcatgaaaatgtatattctatctggtcataaatatttactacttaacataagatttagataaaagacccatgtcaagttgaaccgaccaatgtacccttcgccaaaaactacttgtgtactggccatagctgtggagttattgcttgaatccgtatagcacgcccactttaacaaactcttgtccactggatgtaagcgataatgggggccctttggacaaagagatggtctgacgagcaggaactgccagtgaagtgaactaggacatacatgaaagactcagacttggaaccccatccagtcatgcaggagtccaaaacaatcagacgttgcgttaagggcatgtactgctgctgtctgattaacaatgggtatggattgactcacttgcttaaactaaatgaagtaaataggcattgcaaacaagaattgttttgtttaggctgagtacgtatgggcaactataagcaatattacctccttgttccatgcaaaagttttatgtatagacgaagttcctagaatataaaagaataaatcatttttgtaagcttatggtaatcaacacccgatttatcacgcgctcatgacttgcctgatttcacataccgtcgaaaattctaacccaaccacccaaacgaactcaaagtatactccggttcaacagtaggtaatatcgagtaaatttaatgacaaataatacctccattcaaaccttatgattttaaagttctataacaaatatacgattcatacaattcgccctggtaaggacctaccattttctatatattcggctgcgctattaattaagtcaattcgatcttcgatctatttactgtttcagtgttcgatcgcatatatggcctgttgtccaatggacatagtacaacgcagaggagggaattaactaaaactaccggtaggagagaatgccagttggaaaagatgtagatatgaatgccgatcgaacaaatcctgtacgtacaccaactgacatgtcatgtacatatgctggcttatctgcattaattgtatctctggaaactctgatccggaacgcattctatgtatactccgcgcaaaccatctactccctttgttttaaaaaagtgcagcatctagttcaaatttaaattagaggactgcgcttattttcagacagaggtaataacaaatttcaacaaaaaaaactttagagagaaaagtatgcatgtactgtcaatagtattaattatacctatatataaagtctcatcttcaattcattatatgttagcaaaaaaaaaaaacaaacttctatcagtgatatactcataaaattatcatatttcctttttgttatggctagaatataatgaatttaaagttaatattttatagatatatacaacactattgaaaatacatgcacaattttcttctagaactttttattggtattagttggtgtgcacggagtacgggttgtaagcttgtgctctcatacttgtccatgcatatatagctagctctaactcatcagagatcaatggccgccggccaggacatcagatcgatggagccagccaggaaatcaaatcaatggatggcaattggcatgcatgaacactacaaccaccacgttatgtttgcaggttgtgtgcatttgatgtcattgaatgtttcatttcttttccttttgttaacttgttccattgctttgtaaaagtgggagatcccgcgtgggtgtttttgcattcatggttccaaatctaggtagttaattacatgtccatagcatgaaacctattaacgacaaactggcaagaagagtttaaaattaaaattttaagttttgtcaaattgtataaaaaatcacttgatattaatcggacatcaaaatcatgagttgaatttaccaaccgtcgatccatgcgcgagattgagctgtggccgttctatttgttgccagtgtcttctccgatgacgaagatagtgataatgccaccggattagggttcgaggtggctagttgaggtggtaagaggagattaatcgtgggatggtaggcgcatgagagaaaggggctgggccggtgtcggcagcaaggattaatgatcatcgtaggagtggctagcccgtggtgcgtcgtgaggaagagagttgaatggaggggaaagtggaggaatggaggttggctggatccatggaggggaggaaaggagaagagaaaaaggagggggaggagagaaaaaggtggggggtcggggaaaaaagagaggagctcatgaggcgctctcttcgcgcgaccgatgcagggactcaggcggaggatagtaagcaccacatgtgaaaatcgattctcacaggtgagttttgaccggacaccctttatataattttgcacatggaaacttttttagccttgtaaaaataaattaaacggtggctgcgaaaattatttgtgtggtagtgcatcatcaggatgagattttgggcagagtaggaggataagttagggttataaagtttgcatgtaaacctgaccgttagaaaggtgagtgccatttagcatagaatcacttgatccgttttttgaatcatttgactagaagaatagcgacaaacttccgtgagtgatttaaaattttcgcaacaagcccgcattgcatccttttccaatgatgcaaatttatcctctgcaactaattaatttgcatttcgtgatgaggtggttacaaatttccattggatgccaggaacctgttgtggtgtactccctccgttttttaatagatgacgccattgactttttctcacatgtttgaccattcatcttattcaaaaaaattatgtaattataatttattttgttatgagttgttttatcacttatagtacttttaagtgtgatttatatcttatgcatttgcataaattttttaaataagacgaatggtcaaacatgtaagaaaaagtcaacgacgtcatctgttaaatggaggtagtatataattaagatctccaagcccatgctataacagatcctgttcctacgttatatatatatatattttgagcactgttcctacgttatatatgtccaactaacgcatcctactacattctatcgtccaattaaagccaacaaatttatcggctcctatgttcctcgttaatttgtacatatactactgtagctatagtccatgcgtgcacaaacagctggtagttagcagttacaagttgatcagctgcatgcactgtgtgtgcatggcaatgtggggttcgcacacaactagataggtagatctagtatgggttcatcggtttcatggatgcatgtacgtagtaccaagtggaaattaagaattagtctaggcataatggtataaacagtagtgtacagcacgcctcaatatataatgttatttactgttgaaaagctgttattattaggggcttatatatagatacacccccatgaccccatagatgaagacttcacgctccttgaagcaaagacgagcttaaagttaacagccactatgtcaagctcatatatatctcgtatactccctcggtccctccaagcttcaaattacgctttaagcttatattaagtcaaacattttaaattttaacaaaaattttcatatagtttaacatcagaagattatatttactatgagaaatacttttgtaagatataatttatatgtcaaaaatactgcatatgtttgacttaggacatacctcgaataacaatataatttgaaatggatggagtatgtagcaaaacgtatagagttcaaatcaacaacaaaatcagcaagattaaccttgcagtgcgattttgaccttgttcgcacgcaccaaataagttcgtgcaccaaaataagcattttacaagttcatgtactatattgcacctacctgacaagttcgtgtaccgccgatgcaatttactcttaatactaatacaaataccttatcttttttccattttttcatctttgagttgagtcggaccatacaagaatacgaaaataaaattatcaacaatctccaaatagaaacccccggccaaacctatgctactcatcctagatctagaggaaatgctagtcaaacacagtagtgtcagtttgccacatcagtatcctctttgatatcctctttgatttcaaacaagctaactactgatcaactagttacttttaacactacataaaaaaaacagtgtggttgctccctaacctagataagaaaaatctccaataagtaatattagtatcaattcgttacgataaccggcactaacaacattatttttctgtgtaaaattttcaaatttgggttaggttatgaactgacactgatgacccttatcatatatatttatacaaatttggatatgaacggaactttttcatctggaccagatcatttgagacaaacttttgtgaaaattatagctctcgatgagatgtccaattttctattggacaacttttaagtttgatgccatttaagggctcaaatatgtgtgttgtcgaaatgacaaccgcatacatcgaaagacgtggttactcaacagtggtaggaagaaaacgaagtgtattaaattttgagtttcccttctttccttttttcccattacatggccctagaggactatttatagccccattataggttcttactagtaggctctaggttatacaggggaatttacatgattacccttatgaaagggacatttatagaggtacatgatgatataggggctcatgggcccctgatgggccgtctggcgatcgccggccctattgcccctaggcttgataggccgaaaaggcttcttcggcccttgcgggggtgaacttgccaacgcgaagtcatcttccttcggcagatagtcttcgccttgcactcttcgcctgagacgcctctggcctggcaaggcactcgtacgactcttcgccttccgccgttcttgccccatagccttcgccatgggtttcggcagatttggtcgaagggcctcatgccatccgccaacaagcccctcacgggcaagggtgagattggagcttcggccgagaccgtgcaaaccatgtggtatggtatgcggcgccccctttcgaccgatgctcctgccgaaacctacattattcctgtgagtgaagtttgttatttgtgcggctggtgttattttgccgcgcttcgcctcctgcgtttggtggcatattcatatatatatatatatatattatatacattttttatatattttcttttcccggaccgaaaggaacagtattgggctttcccttcgtgggcttttcactgtgccgctcggacggtgggaagttaccgtttcgcctacccttgcgacacgtggcactttattactggtgggtaggcgaacgctcgcccgggcgagctatatattctcaccgacctttccttttcaccgccacacttgccattttaccgcgtgcgctctcttcctccgtttctttcttccaaagcatctcttgacccctcaagcgtttcgcccattctctttcttcgccaccgcaaacgcaccattcgccatggcccctcgcaagccaaaccctgcttcggcgaaagggctggatcccggccgagtcgatgacgacagcaccgtctttttgggggtctctcttgtggacgacgtcgagctggcgaagctggtcagctctggggcgttggtcgaggggcaggctttcgccccagtgaaggccgtggtgccgaaacctatcaacaatcggacggtggtattcgccgtcttttttgaagcagggctacggtttccctgcaacgtgttgttgccggagatccttcgcctcttccaggtggaacttccatagctgagcccgttggcgcttgttcggatcgctatcttctactgggcgtgccggacttccgggtttgagcctaacgccgagctcttcggcgccatatttttcgccaccgtgaactcgaagacggtgattaccccggctagaacgaagaagacagtgttcgggagcatgaactttaacgttcgtcccgagtggtccgatctctggccggtgaacgctgccatgtcaaagtgggaccaccattggatggctaggtggttctatcacaccatccccttcgaggctggcacttactcggcgaaagccctccgttgccggcatagggcgatcgcgcctaactggaaacccaagatcgccgtggacggcgctatggaggcgcggttcgttctactgcggaaggtttgctcccgccttagctgccgtgacttggtggaggaattctgtatgcttcgcatctttcccctctcccagtcatggcaagttacagttgatcaaggcgaagaggttgacggtttgccgaacctgattcttcctgaagggacagacagtaagactgttctcttgccatacactgctgtgctttgttatcttgccttgtctaactgttaacatagctacacactttacttttgcagcgttgaccctcgaccaggctgaaaacgaggcccgcaggatgatcggcgacgtgtcggtcgtcgagtatagccagttgctaacacgacaagcggctgggcgggcgaaccgggtttacaacggcgaattgcctcctcgggcaaacccccacaaagctgacgacgatgcagggccttcgcgaatgtgaatgtgcggacaagtgaagcttgcccctaggaagtgaagcttgcccctaggagaggaggaagaggaggaggccgtggctgataaggccgcgaacgaggcgatcgaagaccgcgtcgacaccctcggctacactcctaccccaagtcctggtcacaacgagaccggggtggagtttaacagctcccaccttcgacggaaggatttggaaggggccaaggccctagttgcgttctcctcgggcaaggcggcgaagggaggtccggtgcagaagatctctaaaaagaaaggactcgtcgacatcgcccgcgttttcagcgacgacgaatcttctgacgggactccaacttcgcccgctggccgcagtttagacctttcgactgctcccctcgctccgctcggcgttgctggggcaggcggtaatgccgccggggcttcagcctccaccgaacggattgtgtcggctgtggcgagggttttcgggagccctctgcgtgagccagctatttcgccgctagtcaaggcgatggggaagtgtgcggccaccgaagcatcttccaccggagtattcccttgcggcgccccacttcgcccctggtgatttcgagactcgggtggaccttattccctttatggagggggtgagcaaccttgtcttgcccgccggcaccccgagcttattcaccgaacttaatgagttcgacgaggggtgttccgccattaaaagcctggcggttcgggtatgccttttcttccttcttcgttttcctcttcgtcccttttttttttacgtctgacaattaaccttttgttcttttcacccgctcctatctttcatctagattcttgtggctcactgttcgacggagcgaaccgtacgggcccgttttgacggttttaagagccgtcttcgggccaaggacgacgaaataagccgcaagaacctggaggtggaggccctggccaataccctcaaggaagcgaaaactgaagtcaaacgccttcagtctaaggccagggccgaggttgatcacctcaaggccgaactggagaaggagaaggaccattcagcagtgctgattgactactacaaccttactgagccgaagatggaggttctttgcctgaaggctagtagggccgaagcgagcgccgcggaggagtcgcagcggttcacaggagatggcgaagaccaccgaatccgcgagaacggcttgccaaacgctccgcctcgcccttactgacatgggcgcgaaagtgcggggggtctctgctgaggatcggtttcggactgcgccaccgcgtacggcgattgctgtgagcatgtatcggcggccttcaccttaggacttttgcaacagttcggctgcgagcacgtcgccgagttccctacctatgcgaagggggactgggagattagtgcgcagaacatttcgcccgctcttcgcgcgtggcgaaaacagttctggcagaaagatggccggtccgctgccaaagtgcgccttctagagcaactagcgaaggcggaggcggcagatcagggtgaaggaaagggcacgacaggcgaagaggttggaggcgatgcccaggatcacccagaggttttcctccctcttctgcgtttgcctggagaggcgaatgatgtacattcggcaggctgccgccaaaccttaaaaaaggcttttttgtacaattggaatatatgacacaatcttaattactttttgatgatcgaagtctttggcatattattatttcgctcatctcgcattatgccatacctcccccttcttcctcctattcttactatgtaagctgtgttttgctttttctgcactgtccatcagggggttcgccaaaagtcatgcatccggccccctttcgggagctggcgaagtcaaaacaagaaatttgtggcagtgaagggtctgccgaaggtgcgatgtccatttcggcctatttatcgcgaaatggagataaacggtcgcagctataaggttttcatggttgccgactggctgcgggcgcaccccgggcgaaccttagaagattacgatcttgttcattcaagacgtttggaggatatggctcgctttcggcgaaaccatcagaagactaaacgtcaggaaacgatctttcaacgtcgttacagtttagtctgtgtttcgccccctactcctcttaaggttgtgtattatattagtagtgatgatgaacctagttcgcctgatcattccttagggagtgatagtgattatggggacgaagatgtaatttacatgtaaggtgaattgtatcgtgttgtgaaacttctattcttcgattattttttttcgaagttaataaagacgtgttttatttccttttcgctattgtttgcatcgtcacattttgtgcttttgttaggtcggaacatgccggcccctttgcatatattagcgaaataggtgtactgactttttagcttttcgtcgttcgttttcgatctgtagcattctgtgttgaaagaaacgcttttgcttttatgctgatcgaacgtaacatcgttcggctatttattttccgagacaagctgttgcggtttcaacgttcggcgagcgatgcttcggccgattcgtttcgcccccctggcctttttcgctgatcaggcgtttgccttggggtttttccacaaattatcaatcacacgaaaaaaataaaaagaaggcggaggacacatagattttatactggttcgggcctccatggtggataatagccctacatccagttttttttcttttttctctctttcttctttttttttcttgctgaaaggctttcatagtgccaaagggcttacatagtgccgaagggcttacataacagtatgtacatttttacaagttggcgatttgggtgccacccattctagacatagaagcgctttagagaggtggcgttccaggaatggtcgaactcctcgccttcgagtgtcgctaggcgaaaagatcccgtcctggacttgtgtttgatgaggtatgatccttcccactttgattcaagcttgccaaccgctactgggttcgccttcttccttaggacgagatgaccaggcatcagctccgtgggtcgaactttttgttgtaagttgccgaagtgcttgtggtgtacttgtgcatgtgctcgagtgcttcgactcttactccttccaagagttcgagcgatacttcgcatccctcttcgcccccagagaacatcacccttggtgagttagcccctagctttactggggtcattgcctcatcgccataaaaaagcataaacgggctaaacttggttggtcttgtgggggtcgttcgaagggcccagagaactgatagcaattcctctggccatttgcctttcgctgccccctcgagtcttttctttagtgcttctaggatcttgccatttgtacgttcggccgccccatttgactgcgggtgtgcgaccgacgagaacctgatttccaggttaagcccttcgcacatttctctgaacttatcatagtcaaactgcttgccgttgtcagtaataaactcttttggcactccgaaacggtaaacaatgtttttccatacaaacttctgtactgctgccgaagtgattgccccaaggggttcggcttcaatccatcgagagaaatattccacagctacaattgcgaatttatacccgtttcgcgccaccgggaatggcccaatgatgtccagtctccatctggcgaagggccatactggtgcaatgggctgcagatcatactggggcgcggcttggcttcggccatgacgctggcaactttcgcacttcttgatttgctcaacacagactttcaacacagtgggccaataaactccttgtctaaatactttggaggccattgttcttgcagcctagtgcacgccacatagaccctggtgtatctcctttgccatttcttcgccttcggcaaaagagatgcaacgaagtaaaggttgaagtaccccaaagcggtaaagctgacccgagaccatcttatacttcgtggctctgagttgcaaatgcttcgcttctgcttcgtctaccggaagccagccagtttcaaggtgtttcacaaatgaggttcgccagtcatatgggtcttcgcccagtttctcctggtcgattgccatgacttccaagctgtccatgggcacacttggagcatgtaggactttgaaaaagatgccaggcgaatgtgggccaccacaagcagcagatttcgccaaggcgtctgcttcctcgttctggtctctaggcaagtgttcgaccgttatgccggtgaagcatttttccatggaccgaacagcctccagatacctcttcattccctctttttttacctcgaaggatttgtcaacatggcctgctaccaacttggagtcagttcgaattagcaggcgccggactcccagtgctttcgcctttcttaggcccaggagaacggcttcgtattctgctgcattgttggttgtgtcgaactgcagtcttgctacgtaccgaatcggcacaccattcggcaaaaataggactgccgcaatgcctgctcccctgtgcgaccacgagccgtctgagcacatcacccagaattgttcggcgggctcggggtcgggggcaagtaccggtgtccattcagctacgaagtcggctagcatttaagacttgatagcagagcgtgcaacaaaatttaagtcgaacggggatagctctgtcgcccacttgctgagccggccagtgacttccttgcctcggagtatttcgcccaagggatactgtgatggcactatgactttgtgggcctggaagtagtgcttaagcttgcgcgatgccatcactagggcgtcagtgagcttttccatttcaatgtaccttgtcttcgctccttgcagtgcttcggagacgaagtacaccggtttttgtccgaactctgtttcttggacgagggcagcactgactgccaccggcgaagctgctaagtataatagcagttcgcttcctgggggtgggcttatcagaactggcgggctttgcaagtattgctttagcacgtcgaatgctgcttggcactctggtatccaattaaactttcctgcgcctcggagggtcttgaagaagggcaaacctctttcggctgcctttgagaggaatcgactgagtgccacaattcggcctgcaagcttttgtacttcatgtacgcttgacggaggcttcatttgctggatggcatcgattttctcgggatttgcctcgatgcctctttcggaaacaaggaaacccaacaacttgcctgcgcggacgccgaaaacgcacttctccggattcaaccttgtgcctgctgtgcgcaagctgtcgaatgtctcctgcaggtcgatcgcatggtcgaaagccttgcggctttttacgatgatgtcgtcgacataagcttccacattctgccccaactgcttgccaaggaccttgtacaccagcctggcaaaagttgctcctgcgttcgttaagccgaaaggcatcctgaggtgacaaaatgtgccgaatggagtgatgaaggatgttttggggatgtcgagcgggttcatgtggatctggtggtaaccggaatatgcatccaggaaactcatgagctcgcatccagctgttgaatccacgagctggtcgattcgcggcaaggggaagtcgtcatttgccgttcaggtctgtgaaatcgacacacatgcgccatttgccgtttgacttccgcaccagcactggattcaccaaccactccggatggtcaatctcttggataacccccgccctgagcaatttttgtacttcggctttcgccgcttcttggcgatcggcagacatcttgcgcaacttttgttttcttggcttaatgtccggcttgactgctaggtgatgcatgataagatccaccgggacaccccccacctcgttagggctccaggcgaagatatcgatgttctttttgagcacctctaggatactctcaacttcttcttcgcccatgtcgcccccaagtgatacgagctttgtggggtcggcatcatcaatctacacttttgttatcttgccgtgaggggtgggctttggtgtgtgcttcggccgttcatgcggttcggtctcaacactgtgcactgctctgttgattatggctagatcgcctttcgaagcggccgaaggctgaagccccttgactactatcacccctgtcgggccgggcatcttgagcttgagataattgtggtgggaaatggcttcgaacttgttcagggttgcacggccgaagatggcgttgtagttgtacgggatgtcgacgacgtcgaacagtatttgctcttcgcgtctattctcccccgagccaaaggctatcagcaaaagtgtttggccgagaacttgaactgcttctctgctgaaaccgcggagcgatgctggtgctggggtaagggcttgggtaggcaaccccatcttggcatatgcttcagcgaagataacatcggccgaactccctccgtcgaccaggattcgtcggacttcgaaaccagctatctcagctgagattaccaggggatcttgatgcgggaaaataactccttctgcgtcttccggcccaaaagaaattagctggttcagatactgcggcgccccttcacccgccgaagtgatgctgtggaccatacggatctgcatcatcttctgccgtttggacaactggcttggcgggtcagcccttgtaatcacttggattacccttcgctgtacatcttggcgttgttcggttgggggtgtttgctcctgaactgcttcgcggggtgcttcgacaattgttccctgctgcggccttaggtcttgcgcattgccacattgcctaatgtttcgacattgctccgtggtgtgcgaagagcatccgtgaaaggcgtagtagaggtcttttcggaccttcttgtgggctggctgctgatggttgctcgcttgctgggcatcgaactccttgcggagggcttgcacttcttcgaccgccatcacagctttgctcgcatggtctgttctgaactttctccaagttatgggggcttggctttgccttggcggctgtccttggatcgccggctgagactggcgaacgaagaggggaggtggttcgacaacttgaacttgtgcttgagcttgagcagcggcgatggaggctttgtcatactcagcttgtatagcttgctgtcgcttggaattctcctcgccccttgcgaacccgtcaatgatgcgaagtaggtgctcgagcgtctgaggctccttgttggtgatttttcttgtgagttcgtcctcgagcagaccggccgaagtggcatttataaccgacgcctcggttatgtcttgaacttggcaccgggcttgcaagaagcgacgcatgtactcccttatcgactccccctgcctttggcgaatgccaagtagatgttgttgcgtcttcggctcctcgttggtgcctcgaaagttaaggacaaaaacatcgtgcaattgctcccatgagtaaatgctattggctggtaaattgaaataccaagaacgggcgatgccgtctagagcgagatgtattaccttcgctttggtatttttgtcaccatgagctgcttcgatcgctgactcgtagatggagaggaactccttcgggtcagtttcgcctgaatagcgcgggacgggtgggaacttaaactggggtgggattggacgagtcttgattcccccacacagcggtagccctttttcgcctcccgccctgtttaccgcaccctactgcgggtacggtgtggcgaagggcgaaatcgcagcttgtgcgtgtggttgggccatggcattcggctgcccggctccaactggaggtacttgctgagccgccatggatgggtcaaaaattggctgtgaccacatcatggcagcttggattggtgcttggtttgttccgaagcctggagttggagcttgctgccgaacggttggcgcctgagcagcgttgatgaagtcgaactgcggtccctgattccacagcgaaactctcaggcccggctgaatcggtggcaaccaattaggcgcaccttgacttgtatttgtcgcgaccgagaaaaatacattttcccgaacgctagtgtattaatccccatcccagtaaaagccagggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagaattcttctccaaagcttctcttactgaagggggggggagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagacattttataaagacgatcctagagttacacagtgttattaatcaaggccgtgaaccctcacgaacctaccttaactcaaggcctacgatgattcagaccgaactggcaacccgaccctaggtcccagctcgtcccaagccaacccaggccaaccattccacattttagttgttaagcaaattttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactaccgggccgcagctcgtgtagcctttatttgtcctagagatgtccatcgacccccgacttcgtcaatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactggtggaaccatgaatagagtacccactagttggggttttgtttatcctagggtgaacaaggtgataataacaatagcaataataataaggtcataacaaaggtaaataggcatggctaaataaaatagtgataatgcaggaatttaaataaagcgataatgcattaatttaaatcaaaataattttataaactgggattcaatatgctcaaggatgatgtgacttgcctttctcagagacaacgaccttccaaaccttcggcgacgaccacgaaccacgcttcgggaacctccggaacgatagaagctacgcgaagcacacaagcaaagctacaagcctataaagaagcaataacaatacataaaaagaaagcacacggttctttaggttataacaaacattaggagacttgaacggatcgattcggagctcgtatgaccaagacatggtcatccgaagtttaatgctgttacatggagatttgcggattattataattaggttttgcaactataaaacaagtgtaagcgctagcctggaaaagacaggaaggctgcgccgttgacatacggaccccacatgtcaacctaaaggaccgcggtagaccgagtacacagagacggtccacgggtcgacggaagcagatcccgtgtgtcaaccgaggcgagtggccgacaaacggactccactagacaccacacaggctgcacacgtggaaaccacgcggctaccgagcgggcacactaacacggtcaccacacgcacaagcgaacgactaccgacaccggtacacgggtaccggggtcgacaaccgcacaacgggcacgggcgacaccgaaaggacgaggacggggcagcgaaggagagatccttaccaccacgcgatggggcgagggaacgacaacaacgaacgggcgcggcggagacggccgggaatgacggagacgaaaggcgaggggacgacttcggcggcgatccttggacgaaggcgagacgcggccggcacgaggcttgacgacgcggagccgatgacgaagacaacgacggggctgcagcggctggcttgacgaacgtggacgacggacgagaacggcttgacggaggaacgaacgccacgacgaccgggaacgacgagaggacgacgaccggaaccagcgaggaggcgacaagggcagccggcagcggctgcatggagacgaggacggcatggaacgcgccgctgcgatgacgacgagggtggcggcgcagcgagaccacgtgccaggcaaccgacgggacgtcgacgtcgaggacgaacggagacgacgacgacggacagcggaggggttcggatggaggggaggcgaggccgagggtgaccttgccgctacgaggccggaggagacgacgacgcgatcgaccggggaaattccggcgaggaggatggagaggccggtgcggcacgacagttttcctgcaaaatacgggcgacgccgtggcctggccagggaagaggacggcgttccggtgccgggagaggcagcgacgacgaaagccgacgctccggcaaagcggcacaggcggctggaggtggtacagtggcggcaacgccattgtacaccagcgaggacgtgtctccgatggtccccgtgcgaaacggagggcaggccggcgtagagggacacctgcgaggccgaggaaggtggtggcgacgtcaaccgccgcacgggcgaggcggcacaggcggctggagggtggccggcgccgaggaaagagaaggaggaggcggggagaggtggtgcggccatgggggagctcgggaaggggctaaaacgagataacgcatggcgggggttccattttataggtgaggggagggagccaggcatgggagagggcggaacggcgacgggaaacacggccggcggcattggaaggcggacgggaatggcgcggccgttccgggcgattgggggcgccattcaagggggaaaacgggggaaattgaagaggaaggaaaggggattaattccccctaatcaattttggaattcccggtttgaatcgcgtggatttaggggaggaatcgacgctaggtttcacgggagagaagagagagagaggatgccgggcgggaggaaggagacgaccgggcaggtgggacccaccggtcaggcacgcgtcgtcagcgcacgcacgtgcgcggcacgggcgggagggcgccgctcggcttgggcaggggcgcggcttgggccgggcggccggcccaggaggagaggagggggaggcggcctgggggagagagggaggaggagggagtgggagagaaagagagggaggaagagaggactttggccgcgggccgagagagagagaggactttgggccagacttggcccaaagggaggagggggattatttttaggttttctttttaataaactttgttaattgttgttgttgtttaataaatatttccggtgctctgaaaattcaagtaaaatttgagggctccttttagacctaggagaatttaacaaaaattctccggaccacattcgaatttttcttgtacgtattttagtgtttgccaatttcttttcgaattttaattaattctattattccttttagaaaatgatttttattttcggatgaatttatcaggacgtgacagtattcccctccgggtgggccgatggggttgtacttgaaatgcagtggggttggttgagttgctgaaggaaagcttggagttgcgcctgcagagccaaagccccttccgccactgtttgtggcgcttggccgggtggttgatggtgtactcgggcagcgactgcggctgattcctgcccggcgaagtacattggcgcttgtgcgacttgaggcggaaagggctgggtcgtcacttgcggatggacttgaggtgggacataacctgttcaatactgaaggattggagccgacgtgaccttggtccgccttgccgcctcgtatgcttgttgttgttcttgtatttggcgaagcatgtcttggagccgtgtcatgttctgtcgcatggcttccatgtcggcttcggcttgtgttttggggtcagggctgacttgggcctgcacagcggcgagcgcagtcggggccgctgtcggctgcgatggtgcggcttggggcaccaccagttggcttgtcgaaaggatctccgccctagtctggagtgcccttgccaccgcagccgccttcgccacgtcggccgcgttcggcacttgcacagaggtggcgagggccgaaggcggttgtgatggcgcagatgtggaagcgaatggtcctcctccatcttcggccacgggcgccgaaggctctgctccctcctcggcggccatgtccggtccggcgttgctttccttccaccttgcaaccttctccttcacgaccttcttcggtggcattcgctctcagtggtttcgctcggaggtccccacggtcggcgccagctgttgtcgaaatgactaccgcatacgtcgaaagacgtggttactcaacggtggtaggaagaaaacgaagtgtattaaattttgagtttcccttctttcctttttttcccattacatggccctaggggactatttatagccctattacaggttcttactactagggtttaggttatacaagggaatttacatgattacccttatgaaagggacatttacaggggtacataatgatataggggctcatgggcccctgatgggccgtctggcgatcgccggccctattgcccctaggcttgatgggccggaaaggcttcttcggccctcgcaggggcgaacttgccaaggcgaagtcgtcttccttcggcagatagtcttcgccttgcacccttcgcctgagacgcctctggcctggcaaggcacttgtacgactcttcgcctcacgccgttcttgctccatagccttcgccatgggtttcggcagatttggtcgaagggcctcatgccatccgcctacaatgtgatgattgtttaaccattcaaaataattactaacaatcacagattgcaaaaaaaatgtacataattattatttattttattgtgaccttttatcattaaaaatacttttaggcatgactcattaatttgtgtaaatttgcaaaaattatttaaataagacgaatgatgaaaacttatgtctaaattaaagttgatggtgttatatatttaaaaaaatggagggagtaaaatgtaagacccacatagcgataattgcataatctaagtccatctttgaatattaattcctatgtccacaactactatcagaaagatctgagaacacattaatatctcatttaactagctaggtgtactagctgcaacatttttagttgcagaagagttttttagcattgctaatcatatattagcataaccacaatcaccaaccaaacttgtcgattattttacaatctattccaaggatgataagttgggatgtaatccaacatactgtgggatctaataataatgatcatacatcctaactaatttgacaaaaatgtaatagctttaacacaaaatgattacaaaagggtgatgttacatgtactaaaaaccaatttctctagcccttttatctttatctctactattacttcgaatgctcctgaagtcctgatctatggacgtctacagtacacgaatgaaaattcaggaaaaaaatgaacactgacaaaatctgtttggatatagcttcatgcatttcatggaaaagattgctgacacctccctcgccacctcttgtcgaaacaagatttcggcaatactaaaaggaggtggctatcaagctggaaaagtggatgggtttagagggaaagaattttatacaggttcaggcctttttaatcaagaagtaatacgctactcttgtccggcgattgatccgccgagtgtattattgatcgtatgatctgggagaaaaatcgtgttcctagagggacccggacccctccttatataggggaaggggtccgtattacaaaatacagtccatatccctaacggaatatataattacagataaaatataatcataaccgactaggatctcaggtatttccttgacatacaagtttaaaacttaacccgagtcctcttaaagatattctatctatacatggtaccctgtacctagtcggactatacgtgccgtgtagatatagggtatccataatctccacagtagcccccctgagacctttacagtcgacgaaatagccttctcttggaacataaagtaataatccgagtgctttaatttcttctgtatagatctccgagtaccaaaatcaaagactgtgaaggtctaaaatagaaaaaaccgggtgcatcgactagatgcacctaattaggtgtagccccccgactatgtggttagttaaaaaactaaacatatagtcaagaaccgagtggttttacaaccgaatatcatatagcaaagcatatgcggcattcaacaaaacatccagtcgactgcttttagctttaatataccaaaaatgaaacatggaaaggtccgagtgataaacactctaaaggtccatgaattcacatatttgacaagaatccgaataaaaactctcaaaaagatccatgaaatgtggtataaatgtgataacataattagtgataagtctaaatagcctaggctatgacccacaccagaagaataagcatataacatgccaagtaaataactattcaaaaaccaattatttcaacaaacccgaacagcttttgcagcctaaagagacttacaaaatcaatataacacttttctgttgggtacctttttgtccgcatcgtagtaattccaaagaatcatctaactgcattaaaaaggattttaacagcatcgggctatactgttgtgagaaaaaattgccaaagcaacaatgcctaagtccctaaggatcacaactaaccacactgataatagaattgggctgaagtactgtataggctcaggcccattagcactcccgataccctggcgaaataaacgctgaagtcaaagcgtcgctttcttccccgccgagactctcgccactttccccatttcacgctacagtacaaaagcactcccgcggaactagggttctccaattcgctcaaattcaccttccaaaactccacagaaatcattcacgcacccaccgcatcaatccctcatacattctcagccatttccaaagcaaatcgcatcacctaactcgcatccatggtagaggagagagagagcttcgagagccaatgggcgccctccgatgtaacggaggaaaacctgaaggagatggtggcgcatggtgttcttccggcgaaggagatcattggatggcgtctggcattcggcgaagcattcccgacccccaacactcatgaagtcgtggtattttctcatttcttctatggcggattttctcttccaacctcaaggttcttccggggaattctggatttctacggaatcagtttacatcacctaaacccaaactccatagttcatattgccaacttcatacacacctgtgaagcttttttgggcattagaccacattttgccctattccgtcgcatcttcttcctcaagccccaaccgaacaaaagcaagccatccgtagttgggggagctggattccaactgaggggaactctgagccaaaagtacttctccatgccgtttaaaacttcaaacaaaggctggcacgcaaattggttttatgtacaaaaccccgagcctgcactccccgagtactcctatctccctccagtttatcaggacacctggaattcactaccaatgggagaggaagccgtccaagcggtcaccctgatggatcgcatgctgaagctaaaggagcaaggtctgcagggagaacaaatcacccggcacttcatcaagagccggctggccccgatcaaagaaagatctcgcacagcctttgaattcgacggcaaacatgatcctaaccgcgaagatcccaaatcccttgaattcaaggtcatgaaggagagaatgtataaaatcttctcaaatgcaattgttgtcagctattctcacttgctgcctgtggtgccatataatgccttcaatccccctccaccggtatgtatttaaaatcccagctcgtttctaagcatgcttttatcatttgcaaggttgataaaaaagcttgaatcatcatacccaggaattcgccttgatgaaatcagaccctccaattacccaacgccgatcacctcgccagtagacaggtcaggcaagcggaggaccaaaaattcggtctgaaactcaatcaaacatctcaagatcaaccatccagtcagactcgcgcaagaggaaattggtcctgagcgacaatgaaggcgatgatgctggaaaaaccggcaataaagaggtgaccggaaaactgccaaggcaaaccaaccctaagaagaaaacatccagtcatccaatgctaaagatcaggaaatcttccagatatgaatcgtttgaccatctccctcgtagcgctgctcactcactattgcaataataataatggcatgactcaaacttgtaggaagccatctgacatagatcctactggaaaagactctgaaccaactgacatggagacgggtccttcaaaagaaaccgggccgactgcagaagatcacccgagtgacaatcagccggcaaccgacaatgtaaaacccagcaacgaaccctggaaaccagtcggccgaagttggaatcggggttaatcaggaacccccaactggaaaccagtcaggcgtagaaccaaaccgagatgtccctaaagttgaaacccaaacggacagccctcctaaaaaggatactagtaatgacccagtgtccagctctcctattaaggtacaagtgccttctcgtccccgaccggaaatcatcacaggtaaacatatcctccaaaaccattttgatttaaccgacttcattcgattgtttcacctttattcatggatacacaagggccaatgactagtgatgaagaagaggtcctctggatatgagcagctgaagattctcgacctcccattctagtaaagtggtgggatgacgatatgcaacctcagggaatcgtaataaacaagcaaaaagaagatgaggaagtatgtctgctgaaaaaggcactcagccaggctactcgtatcgtaaacgtaagtttcctcatgcacggcctcaaccatcctatttgccacttagctcaaatgccaataaaattgttttgcagagaatccatctcaggaatgaagcaaaaactgcgactcttgagaggttagttccccaccttggaacccttgaggccaccagaaaccagctgcacgaagctagggaacttgccaggaaaactgaacatgatttgagagatcggatcgccgaacttcaagactccaacttcgaactgagtggctcatcaaaaggtacacacaaactctgtccaacttacttatgctgccatccttgtaatctcaattaaccagaagcaatacagtgcaagccgccaagatatctgaactagaaaagtgaatccaaactctggaaaatgacaaggtcggattggcaagacataggaactcggctttgaaagatgttgaaggtattagcaattaatacttcaaaaaccattctcttctttatgcctactcatcgatatgaatttgtttatgcagaccgcaaaatcaagtctcaagctcaattcgatgtcttagtcaacaaaatcaagaggcttgaaggggccagggatgaagtcgccaacgctactaccccactcgtccaagccatgttctttaataacaatggtccgagtacatttgatgcttccaaaatcttcgacaagctgagagttgctccggatacatattttaagaatatcaaagaggctggaagtatgggggcaagcctggtgttggcaatgaccaagtctttatacccaaagatcgatattgacgccattgatggctttgcagatgggacgagcgaagaagttgctcttgacctcatcaacgaagcgtagaaagccgccgataagatagcagttgataactccgatgatgaaaaaactgataccgattgatgttatatcataacaatgattctgatgatgatgatgatgatgatggaggcacaatttgtacaatactgatgtatttatgctgtgctcaatatttcaaacttagcttctgatttcttaaaagcttttgtcaaaccttattgagcctaaaacccgcaaaagctattaaaaagctttcagtcctcattgactaagccaaaaaatcaagcaaggcaatgataaatcaagtaagcaaattgaattgataaaaatcatactccattattattataatagcccccgactgataactcaagggaaaacttgatgttagcagtcaaaatagggaaatacaaaagtaatgcttaagcataaaaacaacgaagatgttcaatattccaagaattgtcgataggagtaccgtcttcgcgcttgagtcggtaggaacctggtcgagtgactttggagattatgaatggtccttcccataaggggataacttgtgccgatctcgtgtagtttgaatttttctcaataccaggtcgccgactaagaaggctagtgatcgaacgttatgattatgataacggcgcaacccttgcaagtatcgagccgactgaattaaggctgcttcgagggcctcttccagtcagttcaaatcatctactcggtcttctccgtagcgctcctcgttaaagttgcgaaaacgtaaagattcaaattccacctcactgggccacattgcttccgctccataaactaagaaaaacggcgactggcccatggcccgactgggagtggtgcgcaaggaccaaagtacagacggcagctgttctacccacttgctggcatagggattcagtcggtcgaaaactcgtgcctttattccttggagcaccatgccattagcgcgttcgacttgtccattgctcatagggtgcgctacggaggcataacaaattttaatgccgaagtcttcacaaaagtctttaaatactccgccagcgaattgagtgccattatccgtgatgatccgattaggtaccccaaaccggtgcacaatgttgatgaaaaaatctctagccttgtctgtcatgtttgtgatgaccggtttagcttcaatccacttggagaatttgtcaatagccacaaagaggtgagtataaccgccgactgccattttaaacgggtcgaccatgtcaagcccccaaaccgcaaacagccaagacaacgggatagtctgcaactcttgagctggtagatgagtttgtctggcgaaaaattgacaaccttcacatgtctgcacaatcttgtcagcatcggacacaactgtgggccagaaaaaccttgccgataagcgttgccaacaatggtccgtgcggcagcatgattgccgcagatgccagaatctatatcctttaacaactgtctcccctcctccaaagacacacagcgttgcaggattcctgatggacttttcttgtacggctcggtctcatgaataatatagagcctgctgcgcctggagatccgctctgcttcatctttatcttctgggaattcttgtttggtcagaaatcttataaggggctctctccagtcggcttcaatcatacctacgtcttgagcgtccgtggcctcgattgtttctttccttggtacggttggttcgtaaagatgttcaacaaacacgtcagaaggagctgcttcgcgttttgaaccaaaattagctagcctgtcagctgcttcgttattgtgccgaagaacatgggtgagttcgagtccaacgaacttatcctccaacttgcgtacctcttgccgataagcggtcatgttgtcatcaaggcaggaccactgtttcataacttgattaacgactaattaagaatctccacgaactatcagacgccgaatttccaaagagattgctatcctcagtccgtgaagaagcgcctcgtattccgccacgttgtgagatgcagaaaaatgtatccacaacatgtagctcaatctttctccagtcggggaaattaaaacaaccccggccccagtgcccgaaagcctcttcgacccgtcgaagtgcatggtccaatacaccatcttctcttcgggcataccttcttggcactcggtccactcggcgacaaagtcagctaaggcttgggacttggtcgaagtttgcggcttgaacgatatatccaaggacatcaattctagggcccattttgcgatccgcccatttgcttcgcgattatgaagtatatcgccgagtgggaacgacgtgaccactgtaaccgagtgaccttggaagtaatgagatagcttcctgatggtaattaaaacgccatacaatagcttttgaatctgaggatatcttgtcttggagtcggccaggacctcgctaacgaagtagattggtcattgcactttttgaatatggccttcttcctcacgctcaacgaccaggactgtgcttacgacctgggaagtcaccgacacatatagcagcagcggctcttgcggatgcggtgaagctaagaccggtggggtagtgaggagttttttgaagtcttcaaaggctttttgggcttcgggtccccactggaaactgtctgttttcttcaacagcttgaaaaagggcatcccctgctcgccgagtcgtgaaacgaaccggctgagcgccgccatgcaaccaatcagcttttgaacatctttctgagaacttggcggttccatgttgaggatggcattgattttctgtgggttggcttgtatgcctctatgagacaccataaatccaagtagtttccctaatggtactccgaagatgcacttttcagggtttaatttcatcctgaaagcgcggatgcttgcaaaggtttcttctaggtccgtgatcaaatcatctttctgcttggtcttgacgactacatcatccaaataagcttcaacgttgcgaccaatctgagttgaaaaacatctctggatcatgcgttgataagttgctcctgcattctttaatccgaaaggcatggtgatgtagcagtatgccccgaagggcgtgatgaataaagtctttaagcagtcggattcctttagtcggatctgatggtaacctgagtagcaatccaaaaagctgagaagctcgcagccggctattgagtcaactacctggtcaatgcgaggcaacccaaaaggatctttgggacaggacttgctgaagttagtgtagtcaacacacatgcgccattgtcccgttttcttctgaaccaggattgagttggccagccagtcgggatgaaggacttccttgatgaagcctgctgctaacagcttagggagttcttccttgatcgtatccttcctatcctgtgcaaagcggcggagtcattgcttgattggcttagcgtcttccttaacatgtaaagagtgctcaatcacctctctaggaataccaggcatatcggatggtttccacgcaaagatatctttattattttgaagaaaggtgatgagcgcgctttcctatttacaatctaactcaacgcctattacagcagtcttagtaggattagagggatctagaggaattttcttggtcttggcttcgctttctccactctttgggatcttggttgcaggcacttctccttcacttgccgtggttgcagccaatcggatatcttctcgggcgatcatgatctcgcgggtttgggctatctcacagctttcctagtcgcatgtgacggcttgtttgatgttgctctgcagggatatgactcctcgaggaccaggtatctttatcattatgtaggtatagtgcgggacagccataaatttggctaacgccgggcgcccgagtatgtcatgatacgctgtatcgaaatcagcaactttgaagcagacgttttctgtgcggaagttctcccgagtaccgaaggtaacccgaagagtgatctggccgagtggtgtagcggatagccctggaatgactccgtgaaagggcgcattactcggtttcaattctgtgcgagggatctgcatgtcgtccagggttttggcgaagaggatgttgagtgcactgccgccatcgatgagggatctgcgaagcttgacgttgcgaaccactgggtctagtaccagggggtaccgccccgggtggaccactcggtctggatgatccgagcggtaaaacttgattgttgtctccgaccaccgaagatattggggcgtatcgggctgaacagcgttaatctcccgttcagtcagcttttgttttcttttagattcataagccagaggtccgccaaagatgtggttgagctccttacgacggtctcgaaaacctatcggggcatcgtcgtcatcgtccttcttttttgacatgctttgatctccgtcggaggcctttcgtgcattcttggtgttttgttctgcaaactgtttgtagacgaagcaatctttggccgcatgattggaatttggatgatgcggacattgggagttcatgatcttgtcaaaagtattgacgcgcgaacgttgtcgggaggaatgtgtagtagttgcaacaagttcctcgggcttacgcttacggtccttgtgattggtacttccactccctcacgtagtcggcgtatctttcttcggcttctaagtggtgcccaactgcttggacgcgataatggcatcttcggctttggcatactcgttggctttttcgaacatccgcttgactgtcttgggaggcttgcgcccaaacttgccgactaaatcttcgtgacgaatccccttggtgaaagcagcaatgatgacgtcatcggtgatgtcggagatctggttgcgttgctcagaaaagcgtcagatataatctcgaagggattctccagacctctgagtgacgttgtagggatcaaactgtgtgccagggcattcaaaggtgccctggaatttggcgatgaagtggtcgcgaagttccgcccatgatccgatcgtgccacggggtaacccatgaagtcaggaccaggcagaatccgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttactatgatgagaggtgtgagactaatcacgaaagacattgttagagccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattacttaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatatgtgtga

SEQ ID NO: 75102 - DNA, 95904 bp, Oryza sativa
cgcaccgcccgcaggacggccggaatcgtgcatgccccgaagaagaaagagaacggggaagaaaaaaaaaatgaaacgaaaaagaagggagagaaggccgtcgatggcaacgccggctgccgtgttgccgccgaccgtgccgacgcccggcctctgcgccaccgaatagaagggcaggaggcagcaccggccgccgccgtcgcacctgcgccgcccggccgcacgccttcgtagccgccgcgctgcctgcactgcccggccgcacgccgccgtggccgccgcatcgccgccgcacggtgctcgcctggccgcaccgccacgcgcccctccgctgcgccgtcgtgtgccgctccggctggccaccacgcgccgtaccgccggccggcgcgcctaccgcctcacggccgtggccacttggccgcctcgccgccggccgccaggccgccgtgccggtgccgcccgcgccctcccctgctgcgcctgccgcctcacggccacgccgcttggccgcctcgccgccggccgccgggccgccgtgccggcgccgcccggcagccgcatatggcaggcggcgccatcggcggaggaagggggaaagaaagtaaggaaagagaagaaaagcaaagaggaggagaaaaggaaagaaaaagaaaaagaaaaggaaagattcccctgtgattttgcaaaaatgcccttgttgttttcggaaattaactgcatgttcccctgcattggaatctttgccttttaaaccctgaactttccagaaaacaagaaaataaccctctgcatttgggatatttgtttgaatggcattagaaatttgcaaatatcaccaaaatcatattctcgcgtaaaagagccacgggacattgaatttcgaccccgactttgcatttaaagtacctttattgctgatgtttatgattatgaaatttaattatcgcatttacgattattaattatttgtgatgtttttattacttttaattaatatcgctgcgataaaatgtatagaattgcatagaatatactggaattatttgcgggaattttgtgtaccattatattgcaacaattgtgcatttttgcctgaatctaattttgcgcatatatagaaaaatgacgtgcatcgcgaattagaaaatttgccgaatcttgaatacctctgacatatttattcaatgtcgaaattacaatagagcaagaagctctatggtaccattaatccaatcacgctgtaggcattgactcgatgagtttgatctagcatttcaaactctcgccagtgcctccaaactactctcatgaatgagtacgctaaacgaatgagcgcattagcatttagagtattatggtatatacattacctttcgtagagcaagaactataagcaagaacatgtatttttcgactatgattcaccaagcaaatgacccagagagagtatggtattacgatgcatcgcatttgcattgaataccgctgaaactcttaatgttctacccgaacatgacgaaagtcgcatgcaagtatcactagtacacatacaagaagtatgcataactagtcgataatagaatcgcgaaacgttcaggatagtgttcactagaaaagcattatcttccaaaaaaaccaactagcacagttgataacgaattcaacatgagcagctagcctggtgcagttaccttaacggaagaagaggaaaagggggagtagaacataggtcaaggtgaacaatctagaactatgaacatgaaaaaaagaggacaatcctaatagcacactcatcatgacttgagggggagaactcctagcctatttgcatggccatggacgtagaatctcctatgctagattggattggtcctaaaatttatgtcagaatgccatagctgttgagcaaggagctcgctatgaagttaattgaatccgatgtaccagaatactttgttaaatcaatatacttcgtcatcaattgttgcaattcttgaatagagcattgcatcaaagaaatggttcttgcccaagtagagcacacattttccctgcaataaagaattatttccagtataaaatagcatatttaaagcatttactattttgttgctcttttctagcacatagttattatgctttgaattttgtgtagcgcccaaacataagagaaaaagaatgaattgtggtccgcataaccacaaataacattttaagagaaagaggtatttccagacccatagaactggaaacattatgactattgctagcaccaacaactgaatttgtcggcctagaatgcgccacaatcatattacctatggaacaattgtgcactttatagaagcatctattgtccgtcaatcccattgaactctctaaaaagtgtgatgatttgggctacacccttttagcaatggattttcagccattttcggtcttagaattataagaataaatattacaactcgtatgatcatagcacatatatgcataattttcctaaatcatgaagatttgtgtgccagtatgcaccgacaggagatcaatgcataaaccgcatattgttctagcatccctgaattggattacgaagaatatatgtggcttccatttggtactgtatgcataaatgcgcttccgaagcagcaaacatccagtgtctcttagacaccatgtctttgccaagactgatccagcaagatcatgtgaactccaatagaactcactaaatcatcttcagaagtctgcgaggacaatgctagcattgtatttgatgattggtgaattggccgcacgaagtaccaaatatccgcatatgctataagtcttagaaaacttcttatttcagatactgatgttggtaccttccattccatcacatctttaatcttctctggatatacgacaactccattcttggtaattatatgtcccaagactgcaacttgatctagctaaaattcacacttacagaatttggcataaagttggcgttgctttaacttctccagtaccaatcggagatgttgtttatgttcttcctcattttaggaatatataagaatgttgttaataaacacgacaacaaattggttcaaatactccacaatatcttgttcatgagattcataaaataagtcagagcatttgttagtccaaatgctataactgtaaactcctataatccataccttgtcacaaaggcagtctttgatatatcttcttgtctgatctacaattgatgataccccgatcgaagatctattttagaaaatacactagctccttttaattgatcaaatagatcgtcgttcgttggcaagggatatttgttcttaatagttacttcatttaaagctcggtagtcaacacatattcttaagcttccatctttctttttgacaaatagcacgggagctccccaaggtgaagaacttagtcgaataaaaccttttgtttctaacttggctatttgtttctttaattcttctaattcattaattggcatcctataaggtctttttgatataggtgtcgttccaggaagtaactctatgatgaattctatttcccgatctgggggtaattcacttagttcttcaggaaatacatccaaatactcttgtaccactgacacttcttcctttggtatatatatatatatatatatatatatatatatatatatatataggtaaacactgaatccaactagcttttgtggataaaaaggaatgagaagcatcggaatcgaataggacagtaactggtttagagtttatggtaagcatacccattaagatgttagggtcctgctgagcttcttctgctttgatatggtgtacctaaccatgttcaaaatttggtccgcctttaatgattggaggatttttctttataaagcctgagataggtggtttttgattggaagtctgggcactgtgttttggcgattggggcattgcctagcgaaatgtccagtcttcccacaaacatagcatggggaatcttccatactaatacatggtatttggattattggtggcatacccggccttgtattaagtagagatggcttaaaaggatagggcttccgaatctgttgcggatttttagttggtgattgtcgttgaagattcattcctcgcttacgaggtcctttcattatcttgcggtcattctctagcctgaccactttattgactaagctttgaaaaatttcatgattttagccgatcatcagtcctcgtagctcatagcataatccttctataaacctttcaatcttttctgtttcatcttaaatgtccgaggcagcatatcgagcatgttgtgtaaatttgtttagatattcttgtattgacataaaaccttgtctcagtcttcgaaattcattcttcttcattctaattactgcagtgggtatgaaggtttttctaaaggctgtagtaaattctgcccatgtaataatatgggtagggtcttctataaagacttgatatgcttcccaccatatattggctggtccttctagctgatgggttgcaaaagttattttctcttgctcatttattctgactaaggctaatttcttttcgatagcccttagccagtcctcggcgtccataggttcttctgttttggaaaagattggtgttttaactctcatgaattcagaatgggcactgtagcctttattttcttgattttgaactatagcctgtaatagttgggtttgtcttccattaattctactaaggtggcaggatttggtagagggatatctcctgtctcaccttaacctgaactgccattgactgaattcctctagaaaaggatagttgctgtcttttcaaaggggagttaacatccttaattaaccatagattttatttctggacagtgtatcgtaaatgatgcataccacaaaagtaataaccaaaagcaaaagaagaaacaagagagaaagcaaaagaaaccaaggaagggataatttcacataggggttagagaggagtatggtcatttgctaaactatactagcaagtttatttatttatatgacctctaactattaacactctatctacaactcctaatcatcaaattactcaccactaccttcagcggggttagtgaataatgatgtaggtgcgaaatgtaaaaattcagcatgaggtgtagaagttgatgcagcagtattaggggcagagcatgagtaaggatcttcatcatctccttgatcatcagcatacatagaaatatgttcttgcatctcaaacactcgttcttctggatcctcctcttcttctggagtttcaatccaaattgggggaacatttaggtcattaatatgaaacatccgggttccccttgctacttcaagctcctgacttggctcactgatgtccatagctgagggcgtttcttcagcttcatcctcggaatggataggatataatggtggtggcgatggtggtaaaccttgtagaactccctcaccatcattttgaggatttggcccttatggctcatccccacttcatcatcatcatcatcactatctatcccagggacttggtgaagacagaatgacgcgcccacaacacaaatattaagtatagagttttgtttatcatcatataattcttgtagcacatgatatatgtgcttaagaacagcttctcatcgctcagcttcttccaaacgtttggactacatatccatgtgttctaggacttcctcatacatgtcatcagcagctttcatccatatagacatggttgccttcactggttgttgatgacgatctatattctggagggtgcaatagtcttcgcctggttcttgcataggatgaaataaatagcgagaatgcagaaacttgtcttgataaatatggttgaggcgtaggaaagcctccctacatgcatcatataaagcagcttatagtgtatctcgcctatgacgcgtccggaaatagtatatatcatcttctcctttaggtgggttgatctttatggtcatatcatattcccaataatctcccttctgataagcatgggaatagaattctgtttattcacttatctttagcttcgtcattaacctgattagctgatcagtgcaatcattattatggatagaaattgccatctcaatatgttctcgctcatgcctttatgccattaacctgaaatacataaatggaatatatattgtgtgctcgcaagtcaaatctaccccccttaaagcattaagttcgaagtaaactcaaacttaaattggttagtaatccttagggtttgtcctatagtccaaacatattctctgataccagtcctgtcgggtcccaaaactaataacttggatccgactgagattaatgtatcaatccctggatcagtaaatattgatacatgtaatacaactggttcttcattgcatacgttaaagtttacaatactagggtttttacaagggtaggtactcacctaattaaacataggtgctaataatacacagcggctgttctagtacattctgactaggaaggtataacctctagggattttctaagttatcaaagtcatcataataataatcataggggtcctcttgacccaaatctgaaaaagggttaataagagcagggtgagtattcacaatactcagcaagttaccatggaaatatgttatgcgttggcatggagtggagttctttgcagaaagcaataatagacaatctggaaatattaaagcaagagtttgtaaaaatatatactttaggtttctaaccagggtaccatatgagtcccggtactcaaatccgtgagcacggctattcgaatagtttcaatgatattctactgcagcagatgtacgctttacccgcagtccacgacttgctgataatcatcagctttagccatggcccagtattaggttattaacaattgtggcacctgttccatgaacttatatcctcatatgctctgaacgtaatgttaacagcagcaagaggatttctggcgttcccgaggtatttaaggggaactgatcgtatgacaccacgtcatatcgatcagggtttagaaatataccatataatttatactcgagtatcacaaaccatttacctgtacatggtaacggttaaaagttgcccttcgcagctatagttgcctcctacgcgaggacttaaaaataagaaccactatacagaggtaccacattgctaattaacataataactaggtctgtccccattctagagactgcggtcgtacccgttcgttcgacataagtacctggtaaaaactatatcgatcgagacagtactagccacccggaaatcatccaattctaacgtactgtcccaatctaagtataaaatattttaaccagattgtaagcaagataagcaatactaaattatctgggtttctatggttgaattatgcatataaaatagagtattgaatagaaggctataaataaataatttgtaaaatataggcttaaatgatcaaaaggtagatagtaacttgccttgcttgatgtcctgagattgattgagattatctaataggttaggagactcctaaagacctagggttaagcatgtaaaattcaaattcaaaaggaattcgaataaaatccaaaaataggaaaaatagagaaaataaaataaaatgcaaaaatagcaaaaaggggctcaaaagatagagaaagattttagaagaattttggtccaagtttcactggaattgggtttatattttaaaagatatgggcttctaaagtttggattttgaattaaatggagaaattagaaaggttattacggaacaggggcccacccgtcagtattttatctttttcttcttttctccttcttccttccttcctttcttctgtttctttttcccgtgtcaacacaaagagagagggagagagggcgacggctttccggcgaccggaaggtggtgacgccggcggtgggtggtgttcccgagcaccacgcacctggggagggcggtttcttgcggagagggagagggaggagaccggaacgccggcggcaagagcttggctcagccgattgggagctggcggtggtagcttaactcaaggtggaagggatgggggaatggggtgaaatgggttctcctcgtcgaggcatacgtgatggagcaagggcttggccgacggggcaacggtgagggagatcggccggtgacttggtggtagccggccatggtggagagagagaaaagctcgaagagcttagttgtggggagggatggcgagcatgccgactatttataggcggaggaggtcggttcgcaaaggagggagaagggaaacacggcgccggtggagtggagcggaagaaagcggcgccggcttcattcggtgattggctaggcatgtcggtttggaggagagagaaggggagcacggtggcagtggcgtggagaggaggattacggcgccggctctcctttcttagcggcgacggaagcgagttggcggcggcgtgcagaagaacacggcacgacaaaagtggcggcgcaagccgtgggtggtgcgctcctgtggcgcacggcaacgacggctgggccgcgtgtgtgacgtcacacgcgcccacaaagaagagaaaagaggcggctgcctcttgggccggctgggccaagggaaggggctaagttgaagattttcggcccaaaggaattttgaatattttgcctaaggagaaagaatttatctagagatctttggaagagttttgcaaagattatgcactataacaatgtctcactaatagaagggtaatctagagaaagtttctaagttttggaacttgaagaaaatttgctaaattcactaaggtttaggatagggtaacaatttatggtttattggtaaactaggttaagggaattctaggggtaatacttgaaccaaaatcaagaataaaaagagaacttttaaaaagaaattttgattttactaatctaagattaaaaccagcatgatgcagtcaaattttagtttaaaatttgaggatgttactagaactcaacctaaatattgataagcattgaagatagaatcaatgaatgtatttcaggagcttggatcgaacacttgcataatagtacatgaagaagtactaggttccgaaccaacatagaaagaataaagcagaaaagaatcgaagaagcaaactcgttcgttttgaatttgagtttaattttgaaatatttggctgaacccaaatcatgctcacacttgcagctaaaagcaagcgatagatggaagtctactacatcagtccaaccgcacttagaaatgttcatggtgcatagctttggttagtcaattatcgccaaaatgggacggaattcccaaacacaagtgtgccatagcagcacacaaaaacttggctaattgaactaaaccgaactaaacatcgttgaactattcagagcctcggcatggttttgagatatggttacccgcgacagcaatcgcgatttggaaactatctcaaccccaccatttatgaaacttaagcaacatatgtcgcacatatgcaaatgagttacgtgagaagcatactcactaagcacatgaaccccaagcttttctatgtgcatgaattacataggagctacgaactaagtcatatggaagtcttgcagatttgtccactaactcattattgacatcttctcttgaataggtctgtccgagaaatcggaataatgagacttagataaatgcaaaattcagggggagaatttcgctgactcattctataatcttgatataaaaaatcaagtacccaaaatcaatctagaaagattgaacagagaattgggtggattgtactctttttcccttggataagttttcctagcagtttcttatcaaggtttttaacgaggcaattcatgcgacattgcaagcgtatgctatgtactctttctccaaatttttcccactgggtttttatggagttttgatgaggcataggcatcacgcagtgagagcccaagggggagtgttaagaaaccgccagcccacgaaggcccggcccggttacccactaattgggcccatcactaaacatggaaggtggaaaagggaatggctataaatagaggagtatagaggaggattgtacacttgagaatgcaatggatgaatgagaaaggatgccacaccctcatatcttgtgtctccactttttgtagaattacgggaccctcttggactacttcgtgtagcaggagggttgcgtaatagtaacgtacacgtcatgtcttacttttttaatccgtttgcatcatggcgttcgtaaaaaaagttctaaacgaaactagaaccatcataactattttttaacgtcgttactgcggaaagcagttgtggtactatacactggctgtcacgttactacgctgtttcagtaagacgaggactaaaaagaggtaaatctcaatctttagagagcaatatctctcacatcataccttgtatttccaatacgtttgcaccatgttcataaaaaaacgcttaacgaaacaagatccatcatggctactttttgacgttgttactgcgataatgttgtcttggtactgcacgatgaccgtcctgttactgcacgattcctgcaagacgagagcagcaaagtagtggacgggggagggagtggtgggcgggtttgaccggcgggaggacactttgaccgaggtgggaggggggttttgggccctagggagggtgggggaggtgggtttgacccatgggaggagggtgtagaatagattcactatatctataactaatataaatatttggatttttccggtcgtcacctcgtgcatgcggtgatttttcgtcccgtcacaccccgccccccaaatcctagtcggaattccatatcacacaaatagaatcccacattctctccaaaatctcaaaccatcacaatccaaatcaaaaacaaaaacaaaaacagaagggcggataccaagttcaacacgaaagacatagcggattcgatttggactcaagaacggatgaaatcaaccccataaatacaactaggattccacaagattgctacggagcaattggtgagatgagatgagatccaacctgatttcgggggatggctttgacttgcggtgtcaagctccaagtggcagtgcacggcctcggcaagcggcggaagcttggcggcggccctcaccggcaaggcgcttgggtgtccgggtgttgagggagccaggaaatcgacgaaggcgacaaaccatgaggcaattcctcgcagcggcggctcccacgagcggcgatgtcgaggaagtaggcgacggcggtaacttcgggaggcgggatgaagtatgcttggaagtcggctagaactaagacgccggatacacgcccttgagcctccctcaccaccagatccgccgcccaccagcctcgccaccgcccgcccacctcccccgccgcccaccatcctcgccacagcctgcgcgcctcccaacaccgaatccactgcccaccagccccaccgtcgccctcgagcctccccaccgccggatccgccgcccacacgcctaccactgctcaccagtatcgtggccgcctgcacgccttggccgtcgcagctgtcgcggggctgtcaccgccatggccaccttcgccaacgccatcgcggccactgccgccttggccattgcctccatggccgccgtaagaaggctgaggttgagttggcggcgacgctgatggaggatgcagtcgactcagggaggtggcccagggcggaggccaaggtggagttgggggcagcacgtcggacgtcgtggttgaggcagggaggtggcacgagtggagggtgaggttgagggggaggcgccggtgaggttgagggggaggcgccgatggccgagagggagaaggctacgatgagaagggaggggtggagggtgaggttgagggggaggcgccgatggccgagagggagaaggctacgatgagaaaggagaggaaacgaggacaggaaagaggagaggaaaggggatcgacctgatcccgatctaaacgggatgggatctcgatcgggttgactaggaaaaaaacatatcattattgatttttttactaggaaaaaaactgaccggtatttttaaaaaacatggaaacagaatacagtgtgtgttttactgggaaaagaaaattcgactggtaatttttaaaaaacatggaaactgaatatgtgcatggtgtgaaacttcacacaatatctccgttccttttatctcgatttttgtcaccacgcttttcaaactttctatagaaaatttgttttgaaatatctaataaatctatttttaagtttactagcaaaatgctcgtgcttcgctacggtgtattaagactaaaattatttgtttttaaccaaagttattttcacactgctttggtacttttgctcgctagaaaaaagtctcaaatgatagagagaaatatagtagctcataataaattatactctctactaggctactactataaaaattgaagatgtttttaccggtattttggtacatcatccgtgtatgagtcggttttatattcgttcgctttggaaatatatatccgtatttgaatcggtttttaagtttgttcgattttggaaatacatatccgtataagaaacacatttagcgaatcagcgagcaacctcaggccaatcgacggatgattgatgactgtccgctgcctctcttcttcctccggcggcggtggcagcgtcagcggcgggcgcggatggatccggcagcggtggtgacggccgagggcggatccggcggcaggggagtcaagtgttgtgaattatgtatgttgttgtttcattgatgtagacatcgttctttgattttgatctagtttttttgctcaacttttttttctggaaccgagttggacacaacaaacaaatcgcataatagaaatcggctgcggtgggaaaaacggaaaaacatggagtgaaaaggatgcgatgacggaaaaaaaagaggttacggacgaaaaaacacgtggggtgaaaagatgtgacgattagaaaaatacgaatcttttagttagttaagataataattaaaagttaactaattatgcgctaaagacttatactcagagaggttttctagaaaagaaaaaaaaaaggaacggttaggtccggtggcactatttagatttagtcggtcagggcattacattgcgaatataaaaatataatttaaaataattaatgtcctcataatatttcatcatcgtcttctatgcaaaggtgtgttattcaagccatccatttctccaatgctacaatcatcgtcaccattggtcaggacaatcattcatatcctacatgtgtagaatagactaaatgtccaaacacaaatatttctttgtgataactgtgcgcatcgctggttcttatgatcatacatgtactttgataaaatcattgagataaaaccttatccatctcgcaatctgatcatacttacattctttgatgtattattgaggtcaaactttatccaccttgtcattaacctgtgcaatgcacgggcattttgctagtgtgtatgtctctctctatatatatatatatatataacaaacaaacaaaagtaatgtcatggtcgggataacgtatcaacgcagaagctgcacagggcagcaggatgcagcgtcaggagatgcagcgcagcgcgcgtaatccgccgtgccggacgacaacagtattgcgataggataggttctgttagccagttttcttatcagtttgttagcttgtttttagtaatttggttaatcagttgtaagcctatttagaggcacaattcggagaagttaatcaagcagattcaatttctaattctctcatctcctattctctatttgttcatcccttgctgttcatcacgggtcgccgttcctccaaactccctcgtccacgtccgccaatcacacattcatatcccatacgttcttatgccggagctcgtgacaacttggtatcagagctcatggcaacggacgaatcctccaccaacgtagccaccgccacagccgcagctacggccgcagctccggtctccaatgccgacatcgccaagctccgtgagtccatggccgacatactccatggcatgtcgctcctcgcatccaaaagtgacttggcggatctcagccattcggttgccgtcgcctcatctcgccttacatcgttggagcagcagggcgccacgtcgacctcaactctgccacgactcggtggcgacggaatgttctggcgaccaccaccaccaccaccgccaccacctccgccgcctccgccgccgccgccgccgcagcatcgcacgtccttgtcctcggacaccaatgcaggcacgggtgttcctcgcttttataagctggaatttcctaaatatgatagcaaggaagatcccctcaattggttcaaccattgtgaacaattttttcggggacagaagacgctagatggtgatcgcgtatggttggccacctaccatctaaccggcgacgctcaagagtggtattttcactacgagcaacatcacggacctcgattggtccgctttcaaggacctgtgccatgctcagttcgggccaccaattcaccgtaattctctgggtgagttgaagcggctgtcccagacatcttcggtggcagcatatcagacgaagtttctggcattggctagccggacgacggagccactcatggattcgcagcaaatacaactcttcacagctggcctacgcgaggaattggccatcgacgtcgagttgcatcagccggatgacctgcaggaagccatggggcttgccagggcctacgaacggaaggcgtcacggctggccagcggcacgcgtccggcactccgcgcaccgttccggagcggaccggctgctgccaatctgccaacagcgccagccgcgaccaccgagggctcacaggagcaagcgccccgacaatttcgtcgcctctcaccggcggaactcgcggaacgtcggtgccaagggctgtgctacaactgtgacgagaaatttgtgcgcgggcacaaatgcgctcgtctgttctacatcgaatatgacgacaacgtcgaaggggacatggagccggcccccgacgagccgcgtgtgtcgctcaacgttctcgccgggttggacggggccaacacgatgcgcctgcccgttgagattgccggcgagcgcgtggtcgcactcgtggactctgggtcgacacacaacttcatccataccgagctggcgcgtcacctgtgcctccatctgtctccagtgcgccatgatctctatgtcgtcgtggcgaacggcgatcgtctggtcagtccaggccggtgcgccaacctccgtcttcgcattgaagggaagctgttcacagtcgattgcttcgcactcgacatctccaccgtcgacatcatcctcggcaccgagtggctcagcacgttggggccaattttgtgggacttccggaatatgcgcatgtcaatttggcgcagtacgcgcgaggtcacccttcacggcctcgccaaccgccggccgccccattgtgagatgctggaaacagaggacctcctaccccgcctacttgacgacttcgccgacatcttcgcggagccgcagggactgcctcccgcgcggccgatcgatcaccgcatccacttgaagccggatgcatcgccggtggcggtccggccgtaccgctacccgcagctgcagaaggacgagctggagaaatagtgcgtggcaatgttacgccaggggatcatccgtcctagtacctcgccattctcctcgccggtactgttggtccgcaagcaggacgcctcctagagattttgcgtcgactaccgtgctctaaacgccgccaccgccaaggacaagttcccaatacccatcgtcgacgaactcctcgacgaactccgtggtgctcgattcttcaccaagctggaccttcgctcgggctatcaccaggtccgcatgcacgacgccgacatccacaagacggcgttccgcactcatcaaggccacttcgaattcttggttatgccgttcggactcacgaacacgccggcgacattccaggccctgatgaactcggtgctcgctcccttcttgcgtcgattcgtcctcgtattttttgacgacattttgatctacagtgcgacatgggccgaacatctgcaacacgtgcaagctgtccttcgcgccatccacaacaacaagctggtgctcaaacactccaagtgccgtttcggcgagcgccaagtctaatacttggggcacaccgtctccgccgaaggagtagccatggatgaactcaaggtccaggccattggtgcgtggccgacgccgcgctccgtccgagccgtccgcagctttctggggcacaccggctactaccgcaagttcatcaagaattacggcaccatcgccgccccactgacggcccttctcaagcgggaggccttccggtggtcgctagaagcggacgcagctttcgcggcgctcaaggcggcgctctcctctgccccggtcttgcaacttccagacttcgccaggacattcaccgtggagtgcgacgcctctggctcgggcatcggtgcagtgctccaccaaggcgccggcgcactgaccttcttcacccggccactcgcgccgcgacacgccagcctcactgcctacgaacgggaactcattgggttggttcaagccgtgcgccactggcgtgcgtacctgtagggacgacagttcgtcgttcgtacggatcattatagcctcaagtacctcctcgaccagcgcctgtccactattcctcagcaccgttgggttagcaagttgatgggcttcgacttcaccgtcgaattccgcccgggccggaacaacgtggtggctgacgccttgtcgcgccgcgacgaggacatggcacccacactcatggcactcacaggaccggcgttctctgtgttcgacgatttgcgtcgcgaggtcgcgaccgactcatccctcgtcgcgcttcgggacaaaattgccgccggcgagctgggcgcgccctgggcattcacggacggcctcctcaccaaacagggccgcgtgttcgttgccgcgagatcgccatccttgccggcactgctggacgtggctcacacagggcacgagggcgtggaacgcactctgcaccgcctgtgtgccgacttcaccgtgcccaacaccaagcaagtcgtccaggaccacgtgcatgcatgcacgatctgtcaaagaaataaggtcgaacaccttcatctggccggtctgcttcaacctctaccggtgccgacgcgggtgtgggaagatatctccatggattttgaggaggggctgccgcgcgtcaacggcaagtcggtgatcctcaccgtcgtcgaccgccagtccaagtacgcgcacttccttccgttgggccacccgtatacggcaacgtccgtcgctcacgtcttcttcaacgaggtggttcgcctccacggcataccgctctccatcgtcagcgacagagaccccgtcttcaccagcgcgttctggacggaactgtttcgccttgccggggtcaagctcaccatgagctcggcgtttcaccctcagagggacggccaatcggaggcggccaaccgggtgatcggcatgtacctgcgctgcctgacgggcgatcgccctcgctaatggctgcgatggctaccgtgggaggaatattgcttcaacacggcgtttcaatcatccctccgcacgacgccgtttcaggtggtttatggctggccgccgcccgccttgcgcgcttatgatcgtgggacagcacgggtgcacgccgttgagcaagcactcacggaacgcgacacgttcctgaacgaggttcgcgaacgattgctgcaagcataggactacgccaaactcttttatgatgacaaacaccgggatgtggcgtatggtgttggtgactgggtctgggttcgactgttgcaacgccaagcagcatcacttccaggcttctccaaaggcaagctgtcgccccgttactatgggccatacaaggtgatggaacgaattggagaagtagcgtgcaggctgcaattgccagcaggaacacgcatccacgatgtgttccatgttggtgttctcaagaaattccatggagagccgccggagattgtgccagcgttgccggcaatggcctatgggcgcgtcctgcctgttcctgtgaaggcagtccgtggcagaatcgcgcgtggcgtctgggaagtgctcatacattgggaagggaaggcagcatcggaagcgtcgtgggagaatgaggcggagttccggcgacggtatccggcatttcagctcgaggacgagctgtttccgaaggacgggagagatgtcatggtcgggataacgtatcaacgcagaagctgcacagggcagcaggatgcggcgtcaggagatgcagcgcagcgcgcgtaatccgccgtgccggacggcaacagtattgtgataggataggttctgttagctagtttccttatcagtttgttagcttgtttttagtaatttagttaattagttgtaagcctatttagaggcacaattcggaggagttaatcaagcagattcaatttctaattctctcatctcctattctctatttgctcatcccttgctgttcatcacgggtcgctgttcctccaaactccctcgtccacgtccgccaatcacacattcatatcccatacgttcttacgccggagctcgtgacaagtaaacttgttcaaaacaagtaaaataaaagtttaggatgtttgaagttacaaattttcttcaccataatgctcataacctgaatactgcgtacatcatatgctcaataatttagtttgtaatttacaattggatacccatctatcagtaagtcatagaacaatataggagtacactaaagactacttgaatagtgtttgaaacaaattcaatataccatgtccggtgccagatcaattctcaccgttattattgacatgtgtagaaacaaaaaaaaagtttataacaagcaaagacatagattgtctaaaagttctctaatgtttccatgctgcggtatagtacgtagtatataccacctaatatccagatcctgtgctactaaaaaattaccgtcagtcttaggtagcacaaatttgaactatcattctctaagagccaactgcgtatttcatgatattttgcaatttctctagcatcccttctctaagtaagtctgctatgataaaaaatagaaagatgaggtaatcaacattgcacaacttgaggagcaccaaccccctgcttcttaggctattccacatggcattcaggtaatcagcatttgtacccaatccttttttttttcaaatttgtattcttcatagttgcaaagtagatggtcctgcatgcaacaaaattatttgtcagaatcattggttcagaaatttgaaaaacataatttttgtatatgcatgtgcataagttgaactctaataagcatggacgaataatggtttatataatttttttttagaaactgagatgatacatttgagattctttgcgagcagaattcatgccaagaaaaaaaatcccaactatgctcacctaatttagtgtgatgataaatcataaattgatggatcaaccataactttctgttaataatattcaagatttcatcatcaaatggttctcattattcacattatcgactgagatgaaatgcagtaatatctgacaaaactggaaaaagaatacatgattaacacaaatttggtcacattttgcacattaacttaacttaccttgtgagtacctctataaatgatgaaacatcaaaagacttggccatttgctttgttgttaccatcatccatcctaagccattgattttagtaccatcgatggggtgaaattgtttagcaatcacatatgcttctctctttcctatgtttcctgaaacaagcaccagcttgattggtgagcaggaagcatgcctgagaacaaataaaattttttacactactgtagcttaaacaaaatgataggggaaatgtgcaactcagtgactacaaaatctcacacattcagggaaaatagtaagaaagtacatgttgcagagtcataatcacattggaaattaatatgttgatggcgtagtccctgcttgacaccattggtcatgccaaaaaccctgaaaatgtagaagcaaatggtatgaaaggaaaatatattcctaacaggtagtaaaagagctgtgcacaaagagcaacagcttgaatctttctaaagtgcatcatctagcataaccatgcattgatcgatggcataagtcaaaatattcatttcacaaacagaaacatatatcagtttctcttcttccacgtctccatccaaagcatcatctgtagcatccccatgacatcactcatcatctccatctctaaattttggtgctcaaagtccatcataatcgaattaatgcatagcttgtgttgaaattaaataagtcagggatttcagcccattgcatcgcatatctagcagctacagcatcttaagtaaaagattgatcccaacctgaccatgttgctactactgcttagtacaacttaatgaagtcaaaatcatgtactgacggcaaaaaacttagactttcacgtttttccttataatgcacagtagattcatagaccatgtaaaacacatcgcttggtcagcatggaagacactgctagttgacgaggcatgcacacattgtataaatagcaataattagcatttagcaagaaagcggcagaacaaatgcacagttatctcaacactcttagaaaagctccttgaagctgagatttaagttggtagatctttgtggtatgatgttgtgtacaaataagatctttggctatcattttcacagctacctgagtgcgtcatgagaaaaaccggcatatcgttgttgaaattgcatggaacacaagaaactacaaataatgggctctaatttgtctccacggttttggatgatgtcaacaaccaacttgtgggatgctccctgagagatgaaaagaagtgaattagcattagctggacaaaaacaagtaaattagcattacctcaaaccataagcttgtaaccaaaatctctatcgcatttgcttcttaatattccagcgcacttaaattagagatgtcaaaacgcagtccttcccctaatacattttgcagccagtaaatacccacaatatccgtacaatgaatcatacaatggtcatatatgctttaaataaaaaaatgacagcctgccaacagcaaacgggtttgtcatgcatacgcattacaatgattgtgtcaaaagttctattatagtactacaaaagtagatcagttgccttatcactgcaaaataaaaccaatgttctactgatctgtatgagcactatataaacttgtattagcaagtcaggcgaaagttggtgactaattacctatcattataaagacttgcggtgtagatatgcaattattcttgtatattgtccagtccattgaagtaaacccatgtggaatggaggacgaagacaccgacagggcaagatattgctagacgcgagtgattcccctatgcaatcagctcactatcaataagttcaaatcagcatctttaaaaaagcaaaattctgttaattttcaacagaataagatattctctgtagtggtgatgatcaataattaactttcatcaagctgtacaatggatcgagaatgaaaagaggagaaattttcatataggggattaatgagcttaaaaggggaatcacagagtaattttcagatgaatcaatctaacctgcacaagagaggaccagcgtccagggaggaccggcgccctggaagcatcggagctgcttgatatgggcagactctaccccttaactgtcgcggccacaagaggcgtggcagggagccagtggaaggcaggatcacaaggacgtgacggggcgactgcgccggtggaaaggaagctccaccaggacgttgattgatgcggaagaacttatggcagcgcgagcgaacaagaaggcccccgggggcgggaggatggggagggggggcagcgatgggaggaggcggacggcgatgcagaagggaccgaagtcggctccggtggcggatccgagtgggagaagcacgatctggccgcgtctccggcgaggacgcggcgtagcgccggcagcggggcgtggcggtggggaagaaggaggacggccgcggcgtagcggtggcagcggggagtaggaggagcgagcgaggaggacggccacggtggctccggcgaggacgcggaggagcggcggcagcggggagtcgctcctgcgaggacgcggggaggagtgaacgaggaagagaagcgcgcggtctccgcggccgcgggtggaggaggagcgatgtcttcgcgcgtggaatcctcagctgtgaaatcttggggtggagaaaacttgcgtgcggatggacggtccagattagttcggataatttggcctgtagcattggagaggacaactcctttatgtaagtaaataccatctctttaaacaggtaatagttatttttattttaattctctcgtacagtgtgttctgtttaaattttgtaaatcaacagtgtaaattttcaaattacaatggaagttttgtaatttacattgtgcaaaagtctaatctaagtgttttataaaaatatggcgctaatctaactgttttataaaaatatgacgatataaatatagcttatgactaatctaaaacaaccaaagtacctcggaataatctagcacacgaatgatgaggaaaaaaaataaggataatggcatgataaattgggaaaagatatatccagaatcatgaaatgccaagtactttttggaaataggttcaagcgtataagttactcgaaaactgaaggagcaataatcattctaccgttccattcttttatctttggttaggatgtagaatttttatgttataccctcatagaagtttaaaaccatttcattattaaaaaaaagttttaaatttaattttgtttctcaaagtctacaggagaagtgtgtacatgcatgcatcaaccaatcgatgttaagaggtttggtggtaagttcggtgacaattggatgccccattgataaacattgcgatcatttgtgttcttcaggattaatgattaatttcacaaggtgcaatgcccatctgaaaagccgtggtacgtgcaatctaatctacctatgagctgcttccttttagaaagcgaatgattggattcagcatcattacaccaaggatttttcaaacaggagggtagcttagctaaaagagcagataattaacgagatagcacatgattctgtcaaaaagggaaaagggagtcctaccacactctttgctcaaaaggtagacgtgacaagtgacatacgtcgtcctttaaagaccaaaaggtgttggtctgcctgctgaatggataagaatctctacaagtatttccacagagctaattaccgagggattgagatccgagagcgtctccgacgtttaggcgatagcagtgcagatgtatcgcaattttttcttttttttgagggaacaaatgtacagcattttttgggatccccctacaaatcaggtgcccgatggtaggtgggaaaaaatcggacgctaacgtcagcatgacgtcgcgcccgatttacgtacaaaactattttaaactgatttttctcttaaattacttattcaaatcatgatccgattgcaccattaaattcattataattaaattttcaaaacaagaccgcacatggatgtattccgacgaaaaaaaattagcttattattgaattatttttaaattttgcacgatgttccaccaggtatattagaattgtttcactaggttgatcaaaaatgtttcacttgtttaaattgggtgttgtttcatcttatataaaaacaatggttcagtaaatagcaaaaaattatttcagttcattgcaatatttaatccatacatagtgaaacattataagtacactaggtgaaacattttttggtggcacaaaaaataaaacgaattcccttaataggggtttccaaaatatgtgggttttttgttgcactagaatatttcgtttactgcaacactagatctatacatagtaaaacattgtgagtatactagaacaaaaaataaaccaaatttccttaatagagaatttccaaaatatgtgggatttttgttgcaaatgagtattttaattcactgtaacattagatctataaatagcgaaacattatagatagattaggtgaaacatcttttgtgaaaaaaagggagagagaaatgggtgggtccacgtggaaggaggggcgtgcggggggagcgcccgatctggctccccccgcgccggttgcacgaccgagagcatttttgcattttttgagtcttaggttacgctagagtagacccaagcccctgaaactgtgcatgcttgacagtgcaggttacttctggtatatcccacctcttttactttcaatctctctcctgtctctccccctctctctctctctcatgtctgcgactctatatctttcctcaccggccgagcgagccaaggcgtcgtgtggagaaatcgagggggtgacggtgccagctttggcctagggcaaaagtgtcccaagcgacgacagcgatggtgatgagtggcgtggtggcgaggcatcccaagcggcgacggcaacgacgccaggcggagcagcggcggggtggcgaaagcggagtatcaggcgacggcggcggggtggccagatctagcctgctgctcgctagcgcaccacccctcctctcctcccctgatcggcaacccttcgtccttggcgagcacgccgacaatctcgacaccacctcctccgtaccaaccactatcgtcgagatcctgtcctcgccgctggatgggacggcgagcttggggcggatctggtggcgtcggcgcccctactcctctcccctctttggcaagcttctacggtgtggatcgaagctggcaggagcttgacggtgtggattaggaggtatgggacggcgagggcactatcgttagggtctggcttgccgccgcttcaccacctccgcacccctctctagcaagcttctcctctcgatctgatgctgatggcggcaagctccagtcggacaccattctcccccttctctttctcctactttcctccccttttctgataaactgctgcaaggccaccatgatcaactttggtcacgtgaacccggtgaaggcatggcccctaggcccccagtccactctctcccctctacgcaagcgatttctctatgtggaccaacaatgtcacacgtcatgtatgtgcattgtggatggccttttagtcatgtggtcacatacatatgttggccctatgttacgaaaaagtttatgtaagagtatttgcttcactgtttccatctcggagattctactctagtacgagatgtcctggtatttttttttctaacatactccctccatctacttttgatagtcatatttccaaatctaaaaaatttatttatgataggcatatttcaatccaacaacttatcatcttaatgactttcttggatttaatgcgtgactctccattcttccacacaagattggctacatggacatcgagaaatgtaaatattaatgaatcgcttgtttacgaggaatgactagtagcatgtttaaatggatgataagtagaatcacttatcattgatctgtgtgccaagataaaatatgactatcaaaagtagatggagggagtagtatggatggagatactcaggtatacgtgcaacgttcatcatcttgtaaacacacacagttacactaagtacttttgaagactgtgccaacatatcttaggattgatgaagtcatcatcgatgcctttgtcgatggatacatcatcttctattgaaacattttagcgcgcttataagttaaacacatgcctaatacaacaaaatgaaacaatttacggtaggatttttgcacttttactctcaattctagtgataagggagatgttaaaatagacacttcaatcttggattgcccgttacctaagtggaaagaggacaaaaatcagttagcggagtcaatattgatcaaattataggtaaatacctttttagtagacaaacatataaatgattttgtaggatcgaaacacaataattaagccaaccaaaggaggggtgaatagttggtatacccaaaaaccaaaatttttagcggaaataaaagttaccctcaaattcgatggatcgcggtctgaccgaagtgtacaagccggtttgaccacctgaagatcgtcggtctgaccgagattaaacttcggttgaaccgtcgagattgcctgctgtcgactgtcgccgccgccggtctgaccgccgcgatgctgccggttagaccgccgaaacccggtgaaacataaatcgaagaactcttaaagtggatgacgactttattgattctctctgtgcttacaaagtgcacaaacaacactccttacaaaaatctcgactaaactcgaaaccctaactcaactatcaattcaattgctctcaaaagcgataccaggaagccccactctccctctctatttatacccgaggtaggcaacctaaagccatgaaccaaactcatactagaagtcctaatcaccctaggaaaccttctcgtacaagaaacaaactttacataaccactcataacaaatttggactccttccaatttcgactccgcatcccatacgcacacaatacctccatcgtatgccatatggaaacttcaccaaccacgtgcattgaactctagccttagtatcccgcatgatctctgaccaccctggacgtcgtcttatccccaagccaactcccgatccatcaccgcaaatactctcccggcatctcaagtcacctatacatagaacaaacaaagaaaccatattccgagaccaagctatccccaacttgactcattagtagcaaacgacagtattacatacgcatagtatccatctaaaagccataatcatgaaacaatcacatatatccaaataaacaacccaaaaccgaaaccgacacagagtcggccggtcagaccgcgggctgcactggtctgaccgtgcaatacacgccggtctgaccggcagccactacccggtctgaccggcagccactacccggtctgaccggacccaatccagcacagtacctttagatcacctgtgaaatccaatcatctccaaaaccactttgcaaaaataaattccaaatatcaaaaccaataatctccaatgccaattattcatcacagaataacaatcaaaaacacctttaattttacagatttcacgatctcgcagcgaaattggacggctgatctaacagcttctagcacaaaatggcaaaagtctattaaactagggatacaagttaagtgcacaactagaataaaaagtaaaagattgtttcttgtgtatggtactgtgttccttcaattgaaccacccatacccggtgtaaaagggtgatctttaaataaacataaagtcggatgaattagcactcaaaaaatctctgattcaaacaagaaaatatctcacaacttcaaagaaattagagagaagatagcatgtttcatacttgaagaaatcatatcttccaaaggaagctttagattaatgtcattgctcgtctccatttatgtctgtcggtgacatgggatcaggagtatcatgactagaggtttgaggcagacacaatcgcacacgtggcctggtacccctgagggatgtcgggcccgagggtgatgcgttcgccctcctcttagtccccccgagggggtcgggccgcaccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgtgggttaggtggcgacaggcgatctgacgcacgccttgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaaggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatgtcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggtgagatggggagcgtcgcctcctcgtctacggcgacggcagcacgcccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagacgaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcctctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatgatgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcatccaagcccaagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacgcggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggggagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagatggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgagaacaaggcgttgtgcttcttgccgatatccatgaaggcgaatgcggagcccactccgcctcgcgcaccttggttggtaaagcttttcgccagggtttctattggccgacagctcttaatgatgcagtcgacctggtccggcgatgtagagcgtgtcaattccacaccaagcaaatccatcagccggcccaggccctgcagaccataccactttcgtggccatttgctgtctggggactcgatatcctgggaccatttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggtgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaaacccttattcaagctaagacacaaaaggaccacggcacagatcatcctcatctcatactcacagcaagatgaaattaacacaaaaatttcttcatttttgattacagattaagttgatatatacaaaaaagaggcccgaaggccttagaagaaagaaaagaagaaaaaactaaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcaacgatatggtcggcggcatcccggacctacgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagatggcgtcccaaagcatgccaggccctacctcgcctgccaagcggagggcttcgacctccccggcggacgagtccagcgcgccctgcagatcggcgatggtgcgttcggtagctgtgaggcgggcggctaagtcgctttcgcccgtggccgccccgccgctgcgcgccctcgcgtccagctccttcgcccgtgcctcgagctcagcggcccgttggttcagtacggccctctcggcgcgggcaccttccagattgcggcgcgcctgctcctcctgcgctgcctcgcggagtgacaggttgaccgccagctgttgcgccgcggcctcggccccctcgagagctcgctcccgttcggtgagcgcgtcctcgcggaggcggagcgtgaactcttcttcggcgcaggcagcctcgtgcgccaccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgtgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcacccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctgctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaaaattaagagcgagcgcgtgtggcgaaggtagggcacaggaaagaaggagttagggcgcaagcggcgaagacaaggggaataatggcgaaaggaaggaaacagatcccttcctcagtgcctttatacttttgccaacgctgtgcccggctcctcgcttctcgcgcccactatttcgccccctcatttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatctccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgtgggttaggtggcgacaggcgatctgacgcacgccttgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaaggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaatgtcaatgcttgtcaacatgagattatgtaacattatgtattatatgtaatactatgtgatgtgatgtctctgtatacatttgcaatgctaattacatataaatttgttcaaatttataactcggttttgtaggttttgatgcttagctcttgaagacgctgatacaaatgaatttgacgttgtgaatgtacatatatgctgttgtgaatgtatggctttatagatggcatgtgatggatttgtgaaaaatgttgggatgtgggtttgctgggatgaaggaaatatataaacatgtgtttctttcttattttgcagtgaacatagctagtaaaggactgaggctagcgaaaaaaacaatatttatttttttggtaaattactcattggtgacgggttataaaaaaacccgatactaattaataccaaaggcaacgagtgtaccttagaatccgttaccgatcagtcatccgtgatggtcaccatactatactgacaaaggtgacataatcatctttgccggtttcaagtgcgcgcacgtcacggatgactcatcaatgacgggccctagtttgactcctctgctaggtcgaactcatcggtgacggggtttaacattggcctgataaagataactgtaatccgtgacagcaaggggcccgatacagatgacctttcacatcagtgaccttttgttcgtgacggtaccctatcccgacacagatgtggcttcccgcccgttacagatgagccatcccgtgctagtgtaaactcgaacactagttgatatgaataaaaaaccaccagacatggcatggatcaagtggtagctgacaacgaggacccccttgcaatgaaatgtaacacaccaggtgtcaagtgaaaaattggatctagcctcttatctgttgttggataacttcgttctatatgtatattctcatattggaacacactcttttggttatttgtttcaataaaaaaaatgccgtttttcttcttccttgtcgcagtatgcctatgttggtttattaaatgagttaataaaatttaataaatttataacaatacttttcatgattaatctaccttttttatgttttcaaactaagtatttataaagatctattaatattcactagtgcggatctgtatcaggcgtgaatcctcatctgtggtggcggacggtctggtcacggatgcggacggtctggtcacggattagtgatcagttatgtgaaaactcatctttatcgggagagctaccgtcaccgataaggcttgatcacctttctcggggtaccgtcacagataactaatcggtgacggtttcttgtttagaaacgacaaagttgttcgccgtcgtgactcgtgacatgattttttttctaacctgacaccgatgagtttatttataaaaaaaaatagatccattttattggctagtgttaggcatttgctagccatgcttgctgcaattaacagaaacatagatatatactagaaaggagagcgcggcgcacgccgcgcgatagcaaatagttctgcataaaatggttagatagtagataatattttgataaatacggtctacatttgtttaataaacagagtacaataaagtataagtagtccttgtgaatccattaggtggcttaatagaagacaacacaccaacaaagatgaacaataaaaaagtgaattgggctataattttcatcaacaaaaaggacaaacactttcaaatgggtcatttagtggatgctatgattggcattcttctccaccataaaggactacaagtggaaagagctcattacaaaccacaattctgtctgcaaacatcttcaaaccagttcagcgcagctgcaagatgcaaatggttcgctattcaagcgtgtaaacatgttttatctttcagaaggtcactgaaacatagggcatacgtgagttagaacaaaacagatgattgcttaataccttaggaggcataatatatccatttcaacttttctttcgattacctgcatgctcagtattcaacatgtcttcccaagcacttttacattttgtctgcaggattatccaagaatatgaattagaaatgaagattgctttataatcgatgaacagtttcagataacaatggtcgatagcatttgttctgaaatcacaacattgtaccaagaaatcaccagtttcggctgaccatttctgccaccagtagttgtgacaattatgtggccggtttctgctcccttgccgttaatattagtcacttgaacttcctgtatttaccatttagcttaacatgttacaatgaagtcaaattcacatggcacatagaagaaattgcacttctcgtcataataaaacttacattgtcatcccttatcttcagatcatgcatctgatcaggcaacttctcagcacccattgtggtgaagctgctgttctttaacccagatagcgcagcccctattgaagccatctgttataaaagctaaacaatgttgagtcagctttgcatccacacagaattccgcaatgcatctatcagtcgacctgcgagatcgtcaacaacaaaacatcagttaaaagtgaaaccgcaaggtttacaatgcaagcagcaaacgagaaggattactccttcacactgctagcaactcggtgcatctaacacgcattgttaatacgagtatatgaccaccagcatgaaacactcatgggagagctatatgtgcattggctacagagaccatactgcttgcagcagtcaactgacttggtgtttgtaagtttcatgagcagaagagttggatcagagactcggagtattattcctgcatggttcaggaaatgatcaaatggaatctttttattatgtcaaaatggcaatacatatacaacacaacaatttgctaagtacatataattaatgaatagaacgaaataatcggaaagattaactttttttccctaaggagaaaaacagagagcaagtgacatgaacgatccccactacctatttaccttatcttgtactcctatttggttgtcattatgatgctggcagctccattcatgaagatccacgagctgagtatagtgggttgcccctcccaacattaacatgagtaatgaagggaatctattccttgaatattgagctaggatcttcggcctaacaagaacgactaagacgacattagccacaaatcataagcatctcagatgaaagaactttttttttgctaactcctcttcaggggaaaactaaatatttaccgttaaaacataaacagctacttgcacagagcctgtaaaactgcaattgccttaaattgtgccatatttgttattcatgtatacaaagagaagaacacagggagactatagtagcagttcgtaatggcattgcatatatacactcacgtgtcatataaatttaatacatatagaattatagacagcatcacagaatgaacacatctaaaattcctcatgattctgtgttgacaaaacagaacgaaactaacctgctgtagatatatatgttgtaccgatccatgaatacctcttgttataggtaatttgggaatgctaggattgattttgatagatcaactatctagtaaaccatagaacaatacatcaactccatagaacatagaaatagaaagaaagataattcttgtacgcaacatgccatgttaattctggaaggcaacaatggtgagaaagcctaattttgtagggaattttttttacatgataagatagaagcaaggaaatattaactattatgcaattactggattgagtagctgatgtatacacatgtcaattacaaacaatggcaatatatagcggaccgtttgcaaggttacacaaaaatatagttgaatttcagaaccatctgtagccatcagacatgcaaagaaccttagggaaaatggcagatcctagaaaatgcaaatagtcgaagccaaatgcttaatggtggggtaaaaagagaaattcctgcagcttacctttttccgttgactttgcctggatgtcttattctgaatggctacataagagcatgaatcagagattgagggaagtagctcaagaagctcctgcgatggccgatggaggcctagtcgacagcgttgacctctagcagctacaggagtggctgttgatgaaggccagacagctagaagccggaggggccagagacgctgagggtctgacatgctggagtggacgcaagcgggatggtggggggactcacctagcatgctgagtcgaggaggtgtcagatccggcaggaggaggctgcagtggaggttgatctggtgaggagaaatcgctaggcgcatccgcacctatccgagcacggatgtcatccgttggtcatggcgtggaggtgggggttgtgaagaagtagaacgaagggacggggaggaaggaggcggcgtgagacgaagagaggaagctggggctggcggccgagcgtaccggccggcttagaggaggaggtatggcgccgtcggtgaggaggagggagcgggctagggggtggagcgagcctgctatggcggcggcggcggtggggggacgacgatccgcgtcagatctggaagggagggccgccgccgcatccaccctccgcgccgcctccacccttcacctccgcctccaccggatctgggaggaaggaggggagccgccgctggctccacccctcgcgcagccaccgcctgaagccgccgccgccaccgccagtaactgccgccgccatggcagctcgagccggaatctgagctgagagaggagagatgggagagaaggggaggggaggagaggagagggagagaatgaggggagggtttcaggattggggtgttagtctaggacgttttgcggaaaaccccctatagttttcatgtttacagcgttacccctagaaggggaattttctcttcttcgttcgtattgtattttcctggaatacgagagattatacattaaaaaatacaatgggacgtaaggcatatatgatattccgtgcaaacacgaggacttttttgcaaaatagcctactaatgcaaccggctctaacccgccgtcaagaccggcgcgtgcacacgccccacagcgccaaaaaaaacgttggaccggtgaccgcttacgagcagtcacgcaggcacgcgcgaggagccgggaggaggaggaacgacgtgtaaagtaacgagatagcccaaaaataattcaaaaatcggagaaaaacggtggggttaggggagttattgattgatgattcccagcatccccataatcccagatcccatacatttcacaacaacatatacataaatacattcatatgcattttacaatcacgtttccattcacatccatttcacagttacatttccattcacatccatttcacattgttgtagtaatttaaaatttgtcaaaaaattcagagaacttacacaaaaccatcgatgcatcttgaagagttaaccatcaaacctatcaccgagttacaatttgcaagaaataatgtacttagcaatacaaacatatacacaagcatcgaagattgtactacatatagcatgtataacaagcttcgttggggctcgatggaggccggcggtggagaggacggcagcctcgtcagtgcttggaggaggctagcagtggagaggacggtggcctcaacggggctcgatggaggccgacaagggagcaaaggacacccatagtagatctgaactggttgaagagtgaagagtgtacagtgaatttaaaccctagaccgtgatcttaactagaccattaggcgcgctttgcagcgccctatcatgagtaaaggtgttattatttagtcatatgaagtaagcattgaaatataaagcaatagaatgataggaaaagcacattatcactatgctatgaacagttcaaacgaacagaacaaatcattacgcatagagatatgtaactaatctagcacatttgcaaagcttatcataagtagtgtagcgattaatacattaagtgatgctccaaagcagtagttagatagcatagcatggtacataggaagccattgtccagattcgtagtcctagaatgggtctaatcccatcctaggttgtaatatattgggatggagggagtaacacatatcgaaaataatcgaggcaatgagaatctattatgtttatttaaatggcgttgtattgcagtttacctttatcctcctttaacaagttcacggtcagttcccttagaatcaatggttccttgtacccattgaaagtccatggtcagttacctcgaaatcaatggttggcttgtacccattgaaagcttttgatggtcggctttcttggcactacaataagtacaataagtatataggaaacgaaacatgtaacaatatcatggcatcgaaaatagtatatcagtgagcaccatgtgtagctaaaccaacaaaaatacctacatgaaaatcaaacaaattgaaataagttttaggagcacatataaggcaaaaatattcctttccatttcctctttagaatcaatcttcatagtcagcagaactgcatccctttgatcatcgtctatcacctgagacagttttaaagtaagaattttatataaattacaacacatttagctaaatgagttgcctgtgactacgggagttaccacagtagataatccactgaaatgagtctctggagatttaaatgaattcttactttgactttagatttttcagcatgtgcttggataaggacaatctgcaataacaacacataaatcagttagaagaaattctatagcacatcagcacctcactatttagaattgtaggtgtttcggttcatggcaagaggattttatgccactattttagctgacatgggacagtctcaatgggatgtgaacatggaggaggatatagctgctagcaaccatgagatacaataaatggacagtccctaaagcttgcatgtctgctctcgttgtaacaataagtcatttacagtgagcgtctaaacatatggtccttttaccagtgtagaaccctttatggtagagatgtattttaataatcgtcataaacaaaatcagtatgtcaggaaacacaaagaacatacaaatcgacatatttcacattttctcaaataaaaaaaatgctaagatgcaaatgtcacgtcaaagacatcttatccaatagttcggcgtgaggcatagctaattccaaaccaaaccaaatctagaacctcgggtactgtcacaaacaaattcagtatgtaattgctagggaatctaccttgatgctgagggaaaaaacaaaacatacacacaaacaagaaggaatgaaaataatctctctttttacagaacagcacaaggcatatatcacattgtcagggattacatcttataccgtcataaatacaacaatctttagttaacaaaaaaatcagtactccttgtaatgatacagaaataaagggaaagaactcacatgtctgtgattgtgactcggtgtggcattgtcctgctcgttgagcaatcagtgcctgttgtatacattgaggtgtgagcagttcggggcagcacggttgggcagcggctgcaaccatggcctgaggcccgagcgatggattcaagggagatcatattgtaaggaggaggcaaagcatgcagatagctgcaccacagcgctgtcacaaatagacttcaataccagcaggatgaatgagctacttgtacttccggtcgcaaaataaggtcaattgggtctgcatctaagtgctcgattaatcactgcagtgactcgttcctccaggttgcaacatcgattccttccagtgtgctcgtatcagttgaaccaccaaattattattatgaatcgaagccatcaaacctggatacgcaaaccagggagaggagtgcgtaccggcagtggcttaggcctggagtagtctacatcagggtagtcaatctccgccgtagcaacaagatcccacccagcgcatcagaggaggccggcgagtgagcgggtgaagccggtggagcgatgcggagcgcgtgccagaggacggagtcgaagacgccatcggaaaggagtgggccgagggcgtcgtcgccgcccacacaaggttcgacgcgtgggcgcgatctagcctcgccccgagccgcgtgttgccgtcgtcgagcgccgtgtggtccctcaacagggacgccgccgcggcgtccgtggcgtcaagcgcagcctagaggcggttcaccacggcatcgaacgatcgtagcagcgcctgggcgaaggaggacgcgcaaaggagtttgtggggaggagggcgaaggacggctggcggcgtcgctgaggaggaggaggaggcggcttcggtgcggctagggtttttggaacgcagagcgcaatggacggcggaaaacgcccgacgggtctaatgaacgagcgagcagtgaaacggcgaacctgctagcttgctgtcccttggttgggccccaccctaacagcccatttagagatacccaagcccgcagcagcttcatcacaagcgccggaggcgcggccgcgcgggaagaggcgctccccgagcgcgggaaacggcaggaaccgggcccatagccgcaccagccttgcgcgtgcggagggagcgggatgacgtggatatcagcggaagcgagcacgtcgccccgaaaaggtccggagcgctgtggggaggcgaactcaccctcatctttaatttacaccgatttggtcaacccatacccgtaaagggcaatataattaacgtcgccacagatgatagctatcagtgataggctagaaagggacaccgtcatggagagtcatccttgacggattggaaagaagcattgttgcagatggcatccgtgatggctattcataaaggcccattagagatgtcatctcaaatggttattactaaaagctcgtcatagatgactttttattttttttaaaaaagtaacatgttagtttttttggttccttttggttccttgaggatagaccactgttgacttatttttcttttctaacttagagatgtcacatatttaataaggtacgccgaagatgagatgactaagatgaacaaaatgttttattgaaactccagattacatggcaatagtagaaactgatgatggcatacaatgtttctattataaggataggccttcggcatgatctcaacatacatgcaccacctcctcttcggtgccattgtctaggtctatgtgcagactgacatgaaggttttggttctaatcgtcctcatcgacgacattgtcaaccctaacaattcttctgccatccctaacgacgtgcaacttcttgtttgtcgggtaatgtatgtagaaaattttcataacctattttgcaagtacaaatggttcatccatgtatccaaccttgcttagatctatagttgtgaaaccttccttatctacttttactccagtgcgtaaattgacccaatggcaacgaaacaacagtactttgaatttggtactgttcagttcccaggtctgctctatacgactgtagtatgagctagacccaagttgatcaataaaagcatctatatggacctcgctgttttgtactgtactcttgtcatcttgtttgacggtataaaacaatcccatgattgtcattcccacgatctaaaacaactatggcatttcagatccatgctgaatagaccgaaagaacttttatatctttcaagcaggataacatttggattttctcattcttcgataaggtgtggcaagttgaagggaggtacactcttcctgtgtccggattagttgctggtgcgaattcacttcgaatatttatctcctgtaaatctagacacatgtttaatccgtccttttgtctttctaggaatattcagcagtagcccgatcaaactcttactcacattcttttctacgtgcattagatcaatgcaatgacggaactcaatgtccttcaagtatggtagtcactagaatatatactttttcttccgcatactgttgatggtcgttaagtgcaaactttaaccgtaaactcatgcataaaagatatcaaatatactaccaaaacttagaagtaggagtttacctctaaccacttgcattgttttggtaaatatatatatgtaggtcactaaaggagaaaatacacccgacatgcaacgaaaataagcctccgaccaatcatgcgcgagtagagagcccacaagtcagttgaaacatacttaaaatggggccaaactgtaacaccccaggtagccacgtacctagaatgccacaccaaaatacactcaaaaaccactaactccaaaaattattagaaatttcggcagagtctcccctaaaaatacggatatccacgacaggcaattataagataactcaataacaatataatccacgcaatccaaaccatcctagctccacaaattctacgtgaaagtaaggaccataactttaaatgacagttacaagttctacggaaaacttatgctaagcaaaaacatagtctaaaactaaatttcaatagtgtgcaataatagtgtgtagttcaagggtgctactcccgtcccatgccgatcaataccattaggtacctaaaaaccaaattaaatacaagaatgagtaaagaatactaagcaagtacaatattgaactagtaaaacatacataggtttaatgcaataagaaaccaatatgaaacatttgactttctttaatttaaaacgaaggaggcaaaaagtagtagttccctcccgggcagatgtgaatatcctcttagcattaccgataagccgagcaagcgtgatcagcgcttctcaaggattatgaataaagatccaaattgcactcccatgactacacatggtacttgaataatgtaaacaaaaacttccagaagaatgaaacatgaataacgttgtgaacttgaacatgaagtgaaatatgaatatgtagcataataccaaaaccacacaattgataataggaagcttcgaataataattgggtaaatgaaaccaacaaagcaatacagtttatccatcacacaagtccatcttgtacttgccttaacttcttcgatactccgactcaactccaacgttggaaccctccacacctgtggagcaaaactatgcataaaccactatatccaaccaatgatagttacaagggataattactaaaatcgataacctagaacatataaactttttaccgatttgtattaaataacctatagcggttccattactgttttatacgtaacttgcaaaccgtctaccagaatctagcaaataatacaacttcggacatctatacaaaattgtctacaactttcatgttgggcacaaaatcagattatgcctatgaaaatcccagattaaggaaaacgaattgctgtcctgatttccggacccggtcagcagtactgtttttgttgtttctcccaaactgtttatcagaatcgaacgaaactagcagtgttagaaagatatcgacgataactacaaactttatttaggacaactaacctgaatcccgatggtttaataccagaattgaaaatacggtttcagcctagcgttctataaaaataaattcaagctaccagaaacggaacgtcttatatataaattagaaacaactagggaataaaacggattacctagaagtactaattttgtaagaaaaacaaagaatttggaaatatccaccaaactccccaaatttcccttcttctaactttttttcccttctcttcctccttcctgttcttctgcagcaacaagcagtagcagccaatagcagcagtagcagcagcaacgcacaagcagcagcaacggcagatcggcagcagccgcagcagcacatgcagcaatcctagcggcagcagcagcaacacgagacaaaaatcagatcgacagcagcaactcaccaaggagacgatggctgtggtaaccggcgtcgtacgcacagcggcggcggcgccgaggtgaagaggcggacgtcggcggctagggctagctgctagcgatgccttcttttttttccccttctattggttaaaaagggagaggctaatgaagatcaaacagcccacattaaatcgataaccggaaataactcgggactccgattaccacaaacttatagtctatttcgccctactcgacgagctctacgcatccacggttcctgatcgcctattcaaacaatagtttaaaagttaaacttttgcacgttcgctctaatattccccgaaatatattaattcaaaacccggggcattacattcttccccccttcaatcgaattcgccctcgaattcgtccagccatactataggcctaaccgccataacggcccaccagtcagtctcctagccaaaggagaggccaggaggtggagcccagggttcggccaaaccgcctctggcgcctcccatcctggccttccacgtgaatgtcccagattactccctaatgatgtttaaggggtgttaccgatatttccaactgtcaacaactgtcattactcactataaaaggaggagcttatacacacttcaacacacaaaacgtagagctcaagtagagtacatctcacttgtacattcatatttcttcatgctatattcacgaatgccttgtttgatgttgttattattgtttaaatgggttctatcctagtggtttgattattattttttcattatacacaattgctcatatgtggtgttctgctgtatggtttgatgtttgatgcaccatcatgttctttttatctgtattggagtggttttgttttagatatattttagatcctaatgtggtccttaggatgacaaaagttaggagcctctagagtgagcaccgactagtgatgcagatgggctaaatgaagggctgtcacaatttttttttcttcattgctgagtgacgctgcccaagtgttaggttgatgactcaagtgtccttatttgaagcaaatagtgtgtgatagatcaattggccacaatgttgtgcatctctcgatgcaaagaaagggtggattattgtgtgtttctccacataggttggggcgttaactttcaccatgaccctagaaaatcttagtatagaacaggtttttttttcccaaaaggattgggccaatattatcgccactagtgagttatgatggcatagaacctatgtagaatcttgtgaggtccccatggctggatgcatctttgttgttggggacatttttggcatgttgctttgggacctagtgtctaagttggattgttgctttttccacattgtttttggttgctgaaagctttccttggatgttgagacgctctgttacttttgtgaacatgtggaatgtttgtgtggcccaaaggcatgtttttatctacattggttatttgttatcctggttaagtgtttgatacgctcttgaagttgtgttaaatcgacgtagtcggtgggttcatagtagggtttcttgtgattgcttggctagttgtcctctctagcatgccatcaagttttaaaaatagtatttttctcgatctagctctccattgtgtttgttgattatgcagacctcaagttgtggcccatggtgtcttgtttgtgtgtgtgattgtttgtgtattggttgtcgagcctattggtttagtcctttgagtgaatcctatggtagaaaaaacgtcacggttattctacctaggtggctaatggtgtttctcatatgaatgttcacctttgagtaaaatgttagcttgtgatgttgcaatatgttgtgtgtttgagcatgttttgccttaggttttgttgcatcagccaaacgaaatattttcgtgtagtttcggtgtcacaataggtgtttattccagcagtacatgcatgcatgagtgtacaaagggataatgccccatgtttggctatgtcttattttagaagagccatatagttttctctggtctttgcctcttttgggaagtgggaaggaggttggatggcctagcaatgttcttttggtagtaagaaaaatagttttgacaagggacccaagaagttcaattgtaatagaaagtggagtgttttgtggggctttgatggttatgggtgtgggtacgagaaaagtttgaccttcctaaaatagaattagttgtcgaagggagtgggagctagagcttcatacaaccttattgaagtttaggagaactagagtttgggatcgagcatcaaccaaatgggacagagcaggacctcgaagttgattgtgcctaaggcataacttcggtttctaaatgtgtctctttctaaagaatttctctaatgtatttctttatatgtgaatcattggcataagtagcaagtgttttttttccttgatgggattttttttccctttcatcacctagaggtaagtgtgtgtgatgcttaaggtgtctatctctttggactgttttgttttgaaggtagaattcggggacgaattccttaaaggaggggagaatgtaatgccctagaaaaaatagaatactgtagaggatatattggaagtccgtaaggttttggtgtttgaaattagaagaaaaacaataggtatatgctagctgggctagcttttggccagcccaaggcctagctgtcccctccacatcccaaaaccctaggaggtcccccccacctccccctagccgtcatttggtaccctgggggcgcccacctccccctctagtcgacctcccccatgcctgccctactgcagacctgggaagaagggaagaagaagaaagggaaagaaggaagcggagggaattgaggtgaagaaggaaatgaggggttttggttgccgctgcccatggaggcctaggtatctaatacatgatcttttccccctgttttggttttctattagggtttagatcaagtgttggaagcgagtaagtttgggatcaaccgatttattcctcagccaggtttttgctgatctgtcccctgcacagttctggtttggatgccttttcggccatcataatgggatttcctgcgaaacgtctctatacaaaagttgtagataacgtgtagatctatcttctgaccaaatggcatgagtttatatcaagtggtttaggagatatcaatttctgaagttgactgtctgaatatcgatgcattttttctgtagtcgaggttcagagggattttagaggatcttaatgatggaatcagagaatcttgtttttacagaagttgtagcatatgttgtgatctacctcctacataaaaattgttagcttttatcttgtagtttgttgtcagtgctctcttgaatggttgttgcacagttttctgggcagatgcacttctctgttttgtgccatgttttaggccagctaaatggaagaattcaattttgttatctaaatgaaagttgtaattcttgttctgtagatgtcagaaatgacatatttttctgtgttatgtgatgtagaattggaggtatcaaattgttaatctatgctgcttttataggaagattatcagtgatttgctttatgttgtttggggtgggatcccagcgtaggaagcgtatgtgtgattcttgaatgattatgcatgttgtttgagtctgagccggtgtttatttaggtgatgccacttcggaatgcaactagagttcatctcatcatcggtgaaggcaagtaaacgtagcggtggtttgctacagccttgacttgttatttgattctacctccacgttgaaattatatatcatcaaccaagattattatatattacaccgaggatttacctatctgaatcatacttattgattttacactgtttatggttatactttatgctcttggttataataaccttatactgatctccatcgaaggaatgtggttccgatgttatactctggaattcatactgcatttgcatcacttgcattgcatttgaagttatgtcgtgaacctatggttgcgaccgtaccggtacagcatcgtatattgccgtaatacgatgcagcttcacaccttgttgggtgtgaaggcaggagtacatatcattgcattgtatatgcacatattgcaggacgttatgaaaattattgatcgaagatgtctttgagaagtgttttcttctctaggatttgtgagtatatggatttgattggtgacgctatgatgttttagttccttggattttgaacttgtctttatgtgaatcataacttggtatttaaattagttatataataaacatgtggtttaaatagcttgttaaagccatttgcttgctgagatttattctcacccccttatagtcttttcaggtacttgctgtgacatgtttgcatgaagggataggattagctacacagtcgcacgacatgatctcacttagtcatgattattgtaatatcttgataagaatacttgtgtttagacataatgggttaattaaatactagagttgttgaccattgattagccactttttcaagcctatccctacatgtcagtcaattgttgtatcataaccttaatctatatgttgatgcttccgcgatgttttcttgtctaagatagttgttgccgaaatttgcttgttttggcacttatgtgtggttgtttagtggcatcccaggcttatgtggttttctggggtgttacattctctctggtcagcaacaaatttaaggtattttttattaatatttctccattaaaatgaatctgcagggttcttaagcataccattaacccttcgatccgtggcatgctgttcatgtgaaaacacggcggcctaggggatcttcttaactccagtgcaagtccaaggctagcctcaagtgtatcaagggcgtgccaactgatttgatcctgcaatcagcaagaaagagaaaagcagagttagtcagccgatagccgatcggccgatagcgtatcgttggtggtctctaccgatggagttagaccaaatcggctatagactggatatattaaagaatattaaaccctaaatatgcctcattggttgtaacattgtctatcaagattgataaagaagcttaagataatattattaaaatagccgatgtaacaatatttagtgtaagaaagataatatactggctaatactctagtacagatctatataggcaaatcaatctatagtaatataccaaatagaggtcaatagtcaatgttgatagcccagccgatatgacctctacttgatatattactataaagtgatctgtctatatagatggcaaatatacatgaaacagataaagaagcatgtatattaggtaagagcggctgaaaccctgatgttatccctgttagaaatcaagaagcagggtagagatcaacacgacttagtaggtcgaatgtactaatgcaacactaagtatgaaaagaaacacaatgtctagacaatcaagccgttgattgattttcaaggtggtatatgtctaagctaatctaatctagcaagacgatttagccgataacggcagaaaccctaaagcgagaagcagccgatagagctaaatcgatttgttaaaactagattaacatagacatatgatatcgatggtcatgatacaaggactaagatatctaaaacgacataatagccccaatagcataggccatcgagatgagttacctcttgcgaagcgaactcgtcgaaaagtaaaaacgaaagggtcgcgatgcgccgaagttgtattggattgtccctcgtattacaatgctaagggattcatatttataccccgaatacagacttagtccattatggacacgactcaaacctttctaaatataagatacaaacaagaccatatatgacggtctcttgccaaatctaacacaaaccgacgtaaccaaactatttaatagatacaattgccttacctgagctctatctctaattggcaatgacgattatcccaatacaggcccatgcgagcccaagtcataccatatcggctgtatcggccatcggctccatcaaccttgatcaactcacactttatttccagctgatatggtatccagccgatacgcagtccgactccaaattcaactagattccacactaaatctgcttcgatcttcttccttcttcgaatctgatgcaaaattccgttgttaacacatgccaacgtaataactctgttgcctagggattggcaaagattctcctaagatgataggcaagtactacacaaccttcgtcacaatttctctttggtttgtatcaagaagccttacacacaggacaagactctaagtcggtgtattccttttagtacaatatgcagtcatttggacaatcatgaattctacgaaccactaaccccacacaaaaaatgtttgcttcatgtgtcgctttgggctgtgtgttctctcttctagaagcagatccttcaatatatccaacagttctgtaaaactcttgtttgtccatccacgacatgcttttagcttcattagatctagggtagcaactaactttgtatgttttgccttgcatccatcgtatagaggtgtctctgaatcactaaccaacctggtgaactcatggtatcttgcattgtaagttgtctcctcaacatcatgcaacattgcttgcaatcttgcattgtaagttgtctcctcaacatcatgcaacattgcttgcagaagattgtgattgacatcaaccatttcactgcccaacggataagaaacaaacatgtcaacttcattttcttcctaattttatctaccactcccttcatctataatatcgattgattcattttctccatgctttgtccaacatgtatagcccttcatgaatcctcgatatatcaaatgagagtgtatatctactcttctggtaaacatcttttcatttttacaatcaacacatggacaagttatataatcattgttccttcttttcctctccttcctcgctatgtttataaaatttgaaatgccacttttatactctttgctatgtcgatcatgaaagttcaagtaccattaatttggttttggtaattaattataaatccaattatgtgagactaatgtttttataaccatttctttgcctagtctcatgtggatatgaaagtgtagtgtgtgagaggtgattcctgaacttcatattagttgagatagaaacattcattgatggtggacctaaatcacaatgataaaatgcatggagatcaatctatatatatcactatttctcaccatgtacatattgacatgttcatatataatatttccacgtgaataacaatatacatgtgagactaatgttttgtttgagccttttcttttgtttagtctctttacattaagaacatgaagatgatgaaggtatacatttattttaatgcctatatttgataaatgccttctattcttgtataggataagttcctaatgtttcattcattttatgcatactcttgcttcacacaaatattttgtatgcatgcatttagggggagcaaatcctataccttatttatgcatgtaattgatgcaagttgttcactttcatttaattgggatcttaacatttaagcatatatttgagtatatgacacttgtactgttgattaatacttatcatttattcatatctttttatacatgcgattggttggtcaacaagtaaaggttgacaaccagattattgaggctaataattttattgtgttgaatgagagaaataggtcccaaggattgcaaaggtgttgatgctcaagtgatattattacacctaaagatatcaaggatggcagaatgaatatattgtagatgtggaatacaaagtggctactatggcaagacagtgaagggcaagcaatgctaggccgcgatggaccatgtggtggtgaagggcaagcaaggggcttggtgctgaagaaccaaatccaatggtgaaggacgagtgacgactttgtcatgatggaccatgcggagccatttgaagctacaagtaaccacatcaatcatttcaagaatatatggtgaaacggtttcgacgttggcattccttaagacaaagaaaagatggaaagaaggcattcctattggtataattctcttcctatttacatttgagtataggaatgctgtactattaagagggatgcaacgtcgatatgtttgcgtatgtctcggtgctcagagtgacctatcatagtgctaccataggagaaacccaagctttaacctatcctttgagtagttttagactttgtttttggttaagttggtgctaacaatggaattttacaccaaactcagagaaaaaggaagcagatcgaagcggatttgatgcaagatcgagttagatttgaagtcggactgcgcatcggctggacatcgtgtcagctggaatgaagcttgatttagccgatatggcaagtggcctatatgatatggcttcggctcggtatgagcctagattgagataaccgccattgccaattagacatagagctcgattaaggcaattatatctattaattaggatatttatgttggtttttgttagagatatggtaagagacctccgtatggtcttgtttgtattttatctttaggaaagtttgagtcatgtttataatggactaagtttgtacttgaggtataaatataaaccccagatcatctatactaatataaaaaggaggagttgtgcctatccaatcctatggtgaaatcattagaggaaactaggcccacatgcgaatgcaccaaatcctcgtccccaccaccataaattcctccacgcgctaacctagcgtagcaaattcctcaccccactcctttcgtcaccgcatcgtagttttcccctcatcggtcatcatgccgccgatagcgtcctcctctccttagctctccctccacaaaatcgctcagcctagacatgattcgccatccacaaaatcgctcaatctcttcctccacttgacttgctggtcatctccttcaccacaactgcacacagcctcgccggagatctgcctgacggtggggtttgaggcggcgcgacggagatccgccgtgagcgaagaccagtccctgctcccgcaagcacggcctcaacatcacttcctccttcccacctgaccccgactgtgctcccgtgggcgacgagagagtgggggcgttgttcgccctcgcttagattggcactgttgccagccactcactcgccgtcaccaagatcagtgcacccactgccaccatcatcgttattgtccaccccaagttgctaccgatgcctgcggacatcaagccgctgccctccacccctctcctttcatggccgtgactagaccaccgctagacgtgcaccctaggtcaccgactaccgcgcgactccagcggccccgcttgcgcgtccccttggctgccggtgcttgctgttagagtatatggtagttagagtcatattaggataggattgatttatgtggactacttccatatctgtaatccttccttatctcctccccatgtactcctatatataccggcccccgaggctcaatataatgtgtccaatattcgcagtatcctctctcctcctatactatccaacacttgcgcccactccgccgacacccgacctccaagacaaccgccattcccatgggtgcagaagcagtagaagaagcagcgcaagcaggaggagaagaagaagcagcggggaaggaggcacctgatcaggctgaaccggccaccaccgaggagtaagtgcgagtaggccttttcccttgatcttgttcatgtactatttcttcatttagttcagcaagcaaatatgtgattcatggatgacttatgttgctgtgtcttagaaaatatacgtattgaattaattgtgaatttatggtttgcaaatcttatatatagataattgatttatgtttgtgatctaaattgatgttagatgcttctttgttgggaatggtccgctctcccgcaggcgtggctgctccgcctccatcacactttgcttggggttgccctccagccgtgcccacgcgtgtcgtgctgtccctgatggacaaaaccctcctaacccacgaccggctctccactccatctcgcagtcttcgagatcatttccaccccgcccatgcctccagcctccctggggcagactgtgcttgtctcatgcccaaacaactgaggcagggatggatcagagaatcggagatggaggccaaactggtgatggcaacccgggacgaactaccatctctgagctctatccagaccccatttgtggctcacctgcttcaattttgatcatgtactgggtggatatatcattttgatatgcagttctgaaccggtagagacctttgatatgtcagtttggttctaaatattgaataagcagtgtttaggtggcaaatcacaaaagcagtgtcagtgcatttctgttttttctcttactattgaaagtaaggaatatattctacaatttattatttgattggagataagcttttgtttgttagtctgctaatggaaacaatatatagtttttagatccatcctctcttgctccactggtcggtggtgtcagctccactgaaggagatgcagcaggatacaagtttcatttcatgtatacatgttggaggttgatttcctataagtatgttaattacatggttgatggaatcttcatggcatcacgttctactttgcaaatttacaaattatcttttcctttatagttctgcccctatggactgacaggtattttgtatctgaaaatgcaattggggcttgatgtggccatgcggattcttgggtgaaatatgcagcaagttccatgggtgctttaaatttgaatataccatggcatccacaaaagggcttcaggaattacgaggaagccaattaggataagggcctcctgacctgatgttgtgtattgcaagtacttctttgtatctcaatttggacaattgttgtatcaaaaaattttgttaatgaagctgatatctcaattgttgtgacttcttcctatgaatacatgtgcttcagcattaaagaaacaaatgtctttaggtatgcactttcaggaattatgggagaagatatgggcctccctctgctatctatggagcaacatgcacaatttagacaatatgtcagagtgcctggggagacaagttgaattattataccatttctacatctcggtaaagtttgtacttgatgatgttttatggccattgtagttgtaggttagttattcactgctatctctcctttctttagagaatgggctacatggtgcaatggttgcagttgttggttttgagaaaacttttagtatttttgcagttcattgtacttattcagctataatagccctcaagacaagcatatatcctaaggtaactcactgtctactaaagttgaaaaaataatttagttcatacttacggtacttattatgttataatagccctcaagacaagcatatgttctaaggtaactcactgtctactgaagttgaaatattaatttagttcatacttgaactagtttatcataaataaggttttgttatgtatatataacatgtccagtggcgcaaaaggtgcgtgattgttcaaaggtctttttgcttaggcttatgcttattagccaaaatttgaattttcaaccttaaatttgaagtagattttgggggtttttcatcgaagtttatttttcagccttttacttttagatagcttatgcttatgcttttcttttctttttgttcgacagtggagttaccttcaatcccactgaaagacaaatcttttttattccagcttttcaagtgttcgtcaagcaattttctctaacgttgcactattttcatggcaagtgtgtaacagggacctataaaaataggccatatcattattgctgatattattcttaaaatttgaagtgttgatatatttattgcgacaaatgctgttaaactacgtgcattgcacgtgcacaattactagttgtaaaaaaaaggacgacaaaatccaatacaacttcggcgcatcaccacccttttgttcttctcttcggcgagttctctcgacaagaggtaacttgattcgatgacttgtactatcggggctattatgtccctttagatgtttagcccttttatcatgaccatctgctattatatgtcttagttaatctagtcttagtatctcgatttagccctattggccagttctccctttagggttctcgccgatatcagctaaattgttttgctagattatattagctaaggcatgtaccatcctaaaaaatggttaattacttgattgtttatacttttaagtttctttacataatttgcgatacatcatccctagtcatgtcttgaaccctaaaaactaacttggaattaatcataattaaggatagtatcaaagttttagccgatcttacctaatatacatgcttctttactggatttatgtatatttgccacttatatagatagatcaccctatataaatatatcaagtctagatcagtatcagtcgggttatcaaacttggtaacttatcagtatttgatatatttctatagattgatttgtttatataagtttgtactagagtattattatctttatttatctatcttgctctgaatattgttccatcggttatttctatagtattgtctaaaatagatttgataaaccaaatagatgatatcacggccgatgaggcatatttagggtttgtgcttaatttatatatcaatccatagccgatttggtctaactatatcggctaggatcgccaacgatacgtcatcggcctatcggctgatcggctatctgttgacttactctgtttgttgtttttcttgttggttgaatcaaaccagttggcacgcccttaacacactcgaggctagccttggacctgcactagagttaagcagatgttctaggccgccatgtttcctgtcaacagttcggtaatcctctgagtgagctttccatagagtcctagatcatcaaaaacggactcctgagtaaaaagttatggtcattttactctgtgcctttcagcaattctaaaaaaaatatcagatattcttccccattttcctaccattatggtgcctgtttgtgagtgggatttgagaaggggaaagagttggattgagagattaaaaagttgagagctactgagattcacttcatactttgagcactcaagttcatagcaagcaaatcttcgattgtgtttgttactcttggggactaaggtctcctagacggctaggcatcgtcgatgagcacccaaggttgtggcgtgccacggaaagtttgtgaaggcttcaatttcgtctccgcaaggaaagaaaacaagagtgaaaccgaggagtgtatttgtgcaacctcaagaggaaagggttgaaatagacccggcctttgtggcccctcgacggagacgtaggatccgtggatccaaactttaggaaacaaatcacgcgtctcctctcttggtttgtccatttttgccttctctcatattgtgcttgagcttgattttacccgatctacttgtatgcttagtagatatatttggtgaccttatatattgcttagataccttgtttgtgaccttttgattcatatacattttgtttgttcaagctacaagttcatagctagcgttttattcctttaggaggagcccttggaggtcgtcgccgactgcctcctccaccttggcggtgttcgtctccacgcccttcccaaccccatttagaaccccaccatgcagaccttggctgcgcgcacaaatcaggcctcaaaatccaatcaatcaccaagaaaagaagtgtagaagagaagaggtgggatgtgtaattacctttgcactgctgctggaggaagaccagaggaggagctgttgccgtggtgctgctgccggaagaaggccggaggaggagctgctgctgcacgtggtggccggatccggcgtgacgcaaaggaggaggggcgctgctgccgcgcgtggtggctggatctggcggccccgacctccaagcggccggatccggtgtgacgcggaggaggagaagcaggagtggtggcgggggttgagggaggagaggaggagcagtgcggctcggattggcgccgccgggtagagaagaagtggtggtggggagagagggaggagggaaaaaaggaggaggcggagtagtgcatgtgcttggcaatcgaaaagataaagagtagtgcgctcggtcaatcaatctgacgtccggacagttttgttaataggtgttggttttttcaaagaaccgacacccaagttcatattttagaggtcggttcttttaaaaatctggtacctacagtattggtaccggttcttttctttacgacgaacatctctaatataagtatatgtgcatgttcttttaaaaaaccggtacctatattattagtaccggttttcctctagaatcggcacctataatatttaaatgtgccggttctgtatattttcatcgtgcggagttggttaaatgattataggtgccggtttatttgtaagccggtccttatgtggtgtttgtagtactctatgagtgcttatgtgtcggggattattacggccggtcaaaggtgaggcttacgtgatgggctacacgctcccatcacacagactggtcgggttgtgtaccagtgagttaaaaattttagaagtttgaaaagaactattactttgtatattctttactggagagagtagtatttgtaagtatacgagaccaggtttttgtttagtacggaggcctgaaattatgggtgcatctagcacggcactggtgtggttaggccttaaaattgtactgcgtacaacaaagaaaagttaacaagaatgcctccatacatttcattccagtacagacctatgcgtggggacttctatggatgcatgattgcattttactaccaccgatcacagtacacatgtactactatatgagtagtacttccgaaagggttacatacgcgttatcactttcgtggcaacagttaattacatcttccaaatttcaaattaacaactcccaataattcattgactattacagagagtctgtatgtatggaacgtcttattgcatatatgttgtagaatgtatagcaggcttaatttgtccttctctacttttcttacgactagcaaagtactcgtgccttgcaatggatttcaaaagatatatatgaaattcttgacttgaaaattgtatttgtcaaacataagttacaagcaaaaatgtagcaaaagactaagccacacacacaatgatatacttatttagccttacaaggtaccaccaactcttaagtaatggcatattatatgtctatatgtattccccattaagtgtaaggagtgctatttctctaagtcacatcatctcaattatttgtagcttttgaatcatttgtcaagggtgcaaattgcatcccttctcctgaaaactttataaaaatcatataactcaattatttataacctttggataattgaaaaagtatatacttcccccgtttcatattataagactttctagcattacccacattatatatatatatatagtagctctattatacacccctcccttaaaataactattctacaccccccctctatcctaccctatccggcccacctccccttctcccctcccgtgcgcttctccctctcccctttgcgcccgcgcgccccgcctccttccactcctctcgatctccctcccccgtcccggcgcccccacccctcctctcgatcttctctttttttttctcttttttttctttttcttcggtttttctctccatcccttctctttattttttcccattcttctctttttctagaaaaaataaaaataatttggtaaattaaagactagaacccatgacctcatggcttataacaaactctcttaaccaatttaccttatgacactttgtaatttgagatcattgtttgtttttttatatctgttcaaattttgtgaatacaaactcattatattactgtaggaatcataccttgttattataattcggtagtaacattatcataaaagtgcagtaacatgatacgttactgcgagatttatagttggttactgcgaaatttataggtctttactgaaattttgcagtaactacatgacaaaactttccagtaacagagaacatgcatagtaacagtggcactatagtagtaatgttttttagagataaaatattttaaatctcaatctttagagagtagtaacgtacacgtcatgttttatttttctaacccatttgcatcatggcgttcgtgaaaaaaagttcttaacaaaactagaaccatcataactattttttaacgtcattactgaggaaagcagtcatgttactacacattggccgtcgtgttactacgctgttccagtgagacgagaactaaaaagaggtaaatctcaatctttagagagcaatatctctcacatcatatcttgtttttctaatccgtttacaccatgatgttcataaaaaaacggttaacgaaactagatccattatgactactttttgacgttgttactgcaagaaagttgtcttgttactgcatgatgaccatcctgttactgcacaattcctacaagacgagaacagcaaagtggtgggcgggggagggagtggtgggcgggtttgaccggcgggaggacgctttgaccaaggtgggaggggggttttgggccctagggagggtgggggaggtgggtttgacccatgggaggaggggtgtagaatagattcaaaatatatatatatatatatatatatatatatatatatatatatatatatatatatatatatatatatatatgtaaattaactggtgctacatggagtatgggctccaagattcaaattgcgtatatacccaatttgaatgtttaaatgttttttttaaatgtttagatatgaatattaacttctttactaacaagttcaaacaagtttgaactgagtttgaacttttttttttagattttggttctagatatataacatctaaacatataattcgttatgtatgtaataatgaattgtgaaatgaagttgagtttgagttgttttgttgttaggtatttgtatgaattaaattcatatacctagatatctacttacaatttgtaaatttttaaaaatttgagagaatttgtgttttttataccttagagcccggacaccataaagtcccctatggatatcatatatatatatatatatatatatatatatatatatatatatatatataacacgatcatgctacgtagcgcgacacacagacgtagcacgctaggaaactacgtagcgcctctcacaggagcgatctcctcctgtttttccgtttctccttcctccctttctgtttctgggtttttcgtatttttcctcccaccaagagtgttttccgtttttttcctgcacaactgccacccggtctccacgtgccctcctcaagccccttttctcactccatcagttcacacggtgagtaaaaatattcttgagagaaatcaggttcccataatcagtaaaaaaattccttaacaaaatcaaaccctctttctatgggcaataaaatttttactcctagagtctccataatcagtaaaaaaattccttagcgaaatcaaacactctttagaccgacagtaaaattttaactccccaaatcccaataatcagtaaaaccctctttggacgggcagtaaaatttttactccccacaagttcagatactcatcaagatcacactctttcgaccgatattaaaatttttactcccaaatccccataataactagtaaaagaagcgaaatcaaaccctctttagactggcagtaaaatttttactcccacaagttcggggctggataatactcatcaagaccaaggttagtgaaatttttactccagcatatttcttacatcattggcgttcatagtaatatttttatcacatatattttggtaattcttttactcaatctgttcgtatggagaagagaaagagaatttttttcaggcattaacatatgagaaccattatcatttttacgggacatattaacacatacaatcaaaattagggagtattacattcaatcatgcatatgaaattatcaatcacacaaaatcttctgtgcgtaaaaaactacagaaacaacaggaggaaaaaataacatctccatccaagggaggagaggagacacagcagagatgttgatggcatgaggtgctgacgtgctgcagcagttggcggcgactactcgagacagatagactagcagctccaatcccatcccagccaccagcagctgttggcatcgaagcaggagcaaggcgacagggctccagtttagccccgcacaaagcatggtcggggttggactcgggttcatctgccagccagactacgccgctgtggcctagagcaccgccgcgcgacgtccaccatctccccgtcacctactccttcgccgttcctgtcgggataggacaaggcgctggatcccacaccggggaggagtttggcctgcaaatccggcgcagccaaagctcaccagcaccttcatcggcctcctcaccatcctcatcgacagcggcctagtccgcctgtaagctggtcaccggggctgacgtccattggcgcaacattttcctcctcttctggcttgaacgcagcctacgcacggtgagcaagaagaaggcgacctaacaccaaggtcctccctgacgattgatccagtgccctgcttcaggaccaccaccacagatcaaggagcgcgtcctcctgatccgccctcctccacgctgcagacggctgctcatcgtttgaagagctgttggagtagttcgtcgtctcctcacccgccgcccgtcgaccggtggcctaagccacacagagggcgagcaccgcccgtcaccctctagcacggacagaaccactgggcaacctcgtcggtgcgcgtgctggtcaccgaccgccgtcaccgaattgctgccatggccagccacgcgctcagatccgaaatacccggagagagtaagaaaaaataggatcggatatgtgattggttacaaggtgagaaaacaacatacatatatatgctgaaaattgggtaacattaagttaaaagtttactcggattataagcgtgggggaggaggcgcaggggtaagttaaattttaactacatactgtggactgggaggagggaggttgcaccagggtggtggcgctgtgtcgctccacctagttaggcagcgcccatagcgctataatatatatatatatatatatatatatatatatatatatatatatatatatacacatatatatatatatgtatgtatgttaatgaatctaaacatatatgtgcgcctagatttatgaacatctatatgaatatggacaatgctagaaagtcttataacctgaaacgaaggtagtagtaagtaagaaagaaaatcttacaacttgtgtatactattttatcacacaattttctcgcggcaacacgcgggatatccatcttgatcctttagtttactagtggtcaaagattttttagccacataaattatgtcatgtcatatgtttgttataaaagtttaatacactctctgtcatggtcatggatatcacatacctaatagtagttgactaaacttggcagggcccaccacatacgatatcttatacgaaaacaaatcccgtatatataaggagttccggataagaaaggataaatagagttctatatagaaacgataaggactactcggattgtatccatatttatctccctagttttacttggacaaggaggcatctatgggtataaatacaagccctctaaggaggagaggagatacatcataaagccacaagacacacccaccataggcgcacaatacacaagccaatatacgccaagacaagtcgtcgcatatcaacatcagagataagcctagacatatcccatccggtgcctacggaagccgacaagagggatcaagtgccatctctgatctcgacgtgttcgtacttcaggaggaagactaccctgtcgtcgactacgagatggttatctagccgccaaatcgacgacaactagataggttatcccaaatactgtatttgtgtgatccagatgaataaagagcaacaccggcttcggctaacaggatgtagggctattacttgtcagataaggggcccgaacatgtataaaaatccttgtctctatctcttttacctcaatctcgcacataccctagtaccaacgatctccataccatcaaataacgtagtcgcggtaccaaccgttgacagcggtgcgccaggtaggggaatttttggtgcttcaaggtttcaacgacatgggttcaagagatggattctccaatgacaaattactcgacgacttcggctgtagggaaatctaacccgaccggagtatgtcccccgacgagatcgggaccatcgccaaatattcgatccgtcgagatcgaccaatatttaagatttcgtcacagcggaaaaccaacagtatcgacgacatgagagattgatccaatatgtgtcggtcttattcctaacagggtgtcctcggacacgttggcccgattcgtaccgagatcaaacgtcgcgctgctagctggtgcaaggcattggcccgctgagtccaagctggacatgacatccactatcatcgaccgagtacgccgacggacatgaggatacaaaccaagagcatgcatgcatgcgtggaccagccaacatgcatccacacagtgcatgtgaaaattgcttcgttaagacatgtctatactactcggacacgtgcacacaaggtaattagtgagattgattttttttaaaaattaatctactaaattcgtagatatatccagcatatatctacaaagatacgcaatattttatatacaatttaccgtacctatttttcagatatatatacaatattatcagatcaataatttattatgtttacctagaccgtgttttttatacaatatttattgtgcgagtgtttccaatattaagccaaccacggtttaatactggggctcgccctacttttttcaagtataaatcatgcttgtttacggtttacataatgcccgatatttaatttgcttgttatatcctgataatactataactctagaagattcatgcagttttttgagtaaatactcgatattgtctactatattgtcttctagaaaatatttttcaggaacaattgagcactcgagtacgatgtggtcgagtacaccgcattatcgagaacgttctcgaaaaatgctgagttgtcgcacccaacctaccaacaaagaccgacgacttatctcatatatagcgttggctacggctagactatttgagaaaatattgttaacagataattcccccgcgaacgttgtcggcttgatcatccgacatgattgcgaacagacatccggatatgctataagttgggtatgtgagtcatgctggccacatgagatgcacatgtaataaccaactctagcgcccctataggtgattaagagatgcctaatcctagttatcgaccagacagttgtagcgacatctcatcgcctatcaatttaaattcacttgtggaccgttgaactccatctatcgttgtccaagactccatgcctctacggtcttacaccaggatcgaccaagtgagtacggcaaatattgataaaggggggtcgtggataacaagagaagtttcatcttcaggtgatcgagatacgcctacacctggtcctcgaccagtacatcgtagtgatctctcaccacctaaaaattcatcttcaggtgatcgagatacgcctacacctggtcctcgaccagtagatcttagcgatcttcaggtgaccagtagattgttgaccagttggttacaacaatctctcgacatctaacgcgacaatcaacattgccgtgatagcgacaaccaagaccgactagatcgccgttgtcaccaggacgacaacgtccaggactaatgacatcggaacgacaacggacaaggttaacgacatcacgacatcacacgacgacgacaaaacttgagatccccatacttctagagggctcgaggatgaggtagtaggtccaggaacggaacctccgactacggtaattcctcattgccttcgtcgtcatcaggaggcagttctcgcaggtcacgagaatgtcatccatctattactctggattcccttcaagtggtcgaggtactactacaactggttctctactagcaacgtagcgatcctcgtaccatgacttctaatggtcgaggtgcgactatgactggtcttccaccagtagcgtagtggtcctcgtaccatgtcttccaaaggtcgagttacgattacaactggtcctcaattagcagtgtagcggtcctcgcacctcaatttcaaacggttgagagactcctactcctggttctcgaaccagtaggtcatagcgatctctcatacctccacttcaagtggtcgagttatgactacaactggtcttcgaccaacggtgtagcgattctcccactacttttgtgatttgttgagtacaactatacacctggcctttgcccagtgtggtggtcgtctcatcatctacatcaacttctgtaagtgtttatatgtgcaatatttgtccgatgatcctcttttcttatatctcctcgtcttcgaagtcggtcctatcgtccctttacactattctgacaagcctccgagaaacctaagggaattttggctagggacgcccagagtagataaggtcttgttggattatgagagccgaacgaccatgtcaaacctggtcatgtaagagtgctcaatggacgcgtattaacaaggccgtgtaatcggaaattgatttttccaacttcacagctgggggctaggatttgtcagcttcagcatggtttgttataagatttaagttgtctctgtggaaaatggctttttcataaaaacaactaggggctaggaatggtaccaaactccgattgctaagggtgactctagcgagagtactcttttatcgtcacatgcagattcaatttattttcgatttttctatacatattatatcatgttacccttgagtgttcgctcgagggctatttctatttaatattctattttgagtattgattttaggaaagttctattcaatattgtcgaagactccgtgtctctacggttctacaccgggattgactaagcgagtatggcaaatgttctgagtattgatttcaggaaaattagacatcaaaataatcaagtcagatttcaaggctctatcgtagattctatgcctactcgattactcgagaacggttgattgggctcgacaaggaatatggaatgaagcgatggtctacccaccgagatggaatttcttgacttcaatccaaattctcgattacagcaagacaagaaacttagtcgcatgctctgtatcttctcggtcgacatcggagattaacctagacaaacctaatatagtgcctacaaaggccgataagaggaatctagctagccttatttctgatcacaccgagaacggtcaagcgatcacgacaatagttgttccaaagtcttcgattgagaaccttaactcgttcatttgcaatgaagtcgggggttactgtcatggttatggataccacatacctaataatagttgactaaactcggcagggtccaccacataccatgtcttatacggaaacaaacctcgtatatagaaggagttccggataaggaagtataaatagagttctatatggaaacgacaaggactactcggattgtatccatatttatctccctagttttacttggataatggggcatctatgggtataaatacaagacccctaggaggagaggggatacaccacaaagccacaagacacacctaccatagacgcacaatacataagccaatatacgccaagacaagtcgccggatatcaacatcagagataagcctagacataccacatcccgtgcctacggaagccggcaagagggatcaagtgccatctctgagctcgatgagttcgtatttcagaaggaagactaccctgtcgtcgactacgagatggttatctagctgccaaatcgacgacaattagataggttatcccaaatattgtatttgtgtgatccagatgaataaagagcaacaccgacttcggccaacaggatgtagggctattacctgtcagataaggagctcgaacctgtataaaaatccttgtctccatctcttttacctcaatctcgcacataccctggtaccaacgatccccaaaccatcaaatactgtagtcgcggtatcaactgtcgatactctccataaaaatatatagtagcaatatagtatcagataaaatatgtcatagtactactaatttatatggacctcatctaaattgatagtgttaagatgtgccttattcaggacgaaggaagtcaagtaaaacaacgatcaaacaaacccttaaaaacgcacgcaacagactaacagggaagaagcaccttgactcgataaaataatataaataaattaaatagttattttgtttagagatgactggattcgaggcatacgtgatcaacaacacaacaccgtctttgaaagcagaaaagaagctggtacttgtttcttcccccaaggtcgcttgagcttatcgggatgcccgaatcggacactcctactggaactccttttcttttttctttttaataacgctcgaagatgagttggattattctcctctccgttcaaaaggccgtagtttcgttcgaattagctgtttggctcagcttattagcgccatgcgaatcagcagagtactaataaattattacgtactattataagtctgaaaacatttattttttcaagggaaaagcctgaattaccctgaattattaggtgactaagaattaccctaaacttgaaaactaaatatctttcactctcaactagtaatatcagataaaaacccctctgagcactgttttggatagttttaacttgaaattgcacacgtaacgccaacgtggcaatccagttagtaaaaaaaatataagagaaatccatggacacacttgtcatctctccctcaagccatcctctcatgtgctctctctctctctgcaatagctgcaatggaggtggcattgtccacggccttggttcgtcgtcgcctcgacggcaccaggggcgcagcggaggtcgagctagctctgggatggcctcaggtgcggttggtctcggcgacggcaaccagctcacaaagcggcggatctattgttcctagccccgggacgaatctgccgttcccagcctcaggtgcggcaggtctcggcggtggtagatctggtgccctcggccctaggaggggtggatccgctgccccaactttgggtgcgacagttctcaatagcggcgacgacgacgttgagtggcatggaaccggcaaggtggcgaagtcggatgcctactcctagctttccgcctctatcgccatcgtcaccaccttgtcaagttgctttctccctccgactcttggtttgcaagtggccgacgatgaccgagatgcgacggaaagtatggagacgacgacctccgccggagtgcgcatgtgatggctaagagagctactgcccgcaacatcctcttcacgcgtcacaactgtcgtcggagtgtgcctccgtctcccaccatgtgccggagtgcgccggcggaggccgaggagaagttatgcggtcgtagaggaggcgcatgccggcggaggctgaggaggacccgcctcccccgctagtcgcccccagctgccttcgccgctctagctcatccgccctgctgttgtgtagtgtcgtcccctgccgatggacagactaggagggaagggtgaagagagagggggtgagagggagagaatatgacatgagggtcccaccatttttataaaaaaaaagtgctgactagattaccacatatagagctaaaaccaactaccacatatagagctaaaaccactccgtattgagttaaaagggttctgcatctagtattaatacttgacggtgaaaattgtctagttttcgtgtttagaaggtaattcgtacttacccaatagttcaggggtaattcagacttttccttttttaaaaaatgaacttctatatacatatatttttaaaaatacatttaaaaatacattgtttagcagtatgagaaatatgcttatgataaacgagaaaataggtgagaaaataatctgtttagaattcagcctcagagaaaaaaaatcatttggtcaggagatcttatttcatgattgataaatgtttttaatgaaataaacacctgtatatatgaatattcgtggatataaagttgatgctttagatttgtcctaccttatgttcttatgttttcttgttgctatgtcatgtgtatcttttaaacgaagttttcaactttcttgtgttcttaatttctatagaaatttaatgagtatgacactttattcttgtgttttttgtttttacaatcttgtgcttcaaaggagctgtatacgagattaggtgtagaaaaaaaatgatgcaacactataaattgtactacgtagcaactactaatatggcatttctacacaaacatgccagcaaactcacgataaaagcatgtgcctactcttcaccagattccgccattaaatttagcgtaaatattatacgaacccacttacatgacgcgcgagtgtgcaagcaatagttcaaaaggaaaaagaaaacttcaaaagttttaaaacatactgtaggagtattaatcattctaaaagcatttcaaatcaaacaacaaacaaaatatttttcatccttatcaagagaacgcaaggacaaataaattagattcctctcatattgccaaattgtccaaaatctggaccatgcatgatgcgaccaccaccccatcagcccatctgatagcgagcgacaagcaggacagatccgcgcggaaaatcccaaactcgcccgcccgcatgggatccaacccccaacctgtgatctcctctactctcttctactccgttctataaaaaattcaatctacataaaaacttattaggatttattattgtacgaagtattccatcatgttattaaccttttatgggtctaatagaaaccaatctagataaagactcatttaaacaattacatttattgtgttagaaagtattttatcatattattgattttctatagatggaggaagtactcccatccagggtttcccaaaccgtcgaggccagggttaccgtgtaaaatttatcaaaaattcaaattattttttaaatttatttaaatttcaggaggttattatggtatttatattaccgtactctatgataaacccgataactatggtaaccgcgcggcagtaaaggaaacctgctcccatctactccacggcctcactcactgctctgctctctctccccgcggttaaacttaaagctactatcgctagcgctttgccttggctaccgtgcctcttgacaaaaaccaaagcccaactactccccagtccccactgctgcaatgtctgctcgtgttctgcggctgttacggtagtttaagagcaagtttaatattatagcctattactggcttcaatttatctatagctaatctaatagctaattgatataatagttgtttactatactattaatatatggtcccacctattatacacactgtgttttgaaatccgtgctgcagctggctacagatctctagcccatttctcttctctctcatcttttatctaattaaaatatatttatagctgactaatagtctgctattatacctgctctaataactttgttttactgctaattataatcaccagtagagagaggggggaggaaactgtgatctctggtctccatcttttagcaatagtacgcataatttataagtaaatattttatatgtatgttatgatttaaatatcaatattgaaaattaaatttatataaattcctttttaaaattcaaaatttgacagcagctgattctaaacgaagcaaatcattggggcctctgaacagagtgacaatagtgtgcaactgttgacgtactagtagaaggagagtagtaccactaccgtggtagcagctgcttaactttgcccaccggccaccgttcaggggccattaatggcgtgcagggccgctgctgctgctgcttgctcttgctcttgctgctgggtggagtgagcgagagatcccatgtggcattggagcgctgtctcctgctgctgcacagtctactctcacctgctccgcctctcccctcgttaattcttggcggctgtgtggcgaggaagaagaagcggtgatggcatgctgatgggctgcgggttcttggatgcatttgggtggatatgcggacatggtggtgagttcgctgcctctcgcgcttctctgagcctgtattgattttagaaatttcttgtatttcgttctaactctagatggcattgatgctctgcttgcttggttcttgttatcttcttgtactctgtgtatgtgtgtgtgtgagagagatatttgaactgaagattctgcagtttcagattttctttggcctgtttctctctctcccccgagcggtagccattctctctttcttgttcttctgccaatttccagctgtttccagtagctggaaacttcgaattgcttaaagttcagttgtttgcttgctatgacttcgtttccccttcaagtttcactgcatttcctttccagtttttccttcaaagctcggatttgtttcttgcctcttcagcattcttttttccggcctcgattttgtataaagccgtttgtttgtgtcaaaatgttcaccaatatgcctttctcatgagcctcatctgttcggtttactgtacatatgctcttaatggtctgtcaatagtctgtccagaatgtcattttctatgtcgggaccgtacagatttttaaggctgcagcttccatattttttaatttgaacaaatgacaactactgccttgttttttctgttcaatctggagtaaaacttgttcgcgatgttcttgcatccggtctccaaattgtttttttttttttggtttttggaaataagtatgattcagtcccgtggcattcacatcttgcttctccttagtttcttcattgatttgggctgtaaatttaatctttttcctttgcaggaagctgtaatttgagagcgatgggagcatcttcttagggatcctcttccactggctagcctacagctgtttttctccttcattggtactccaatcttggctggaattttgaatcttttgtccgggaagtgataaaatttagaaagacaacacaaccattggcacttcttacagttgtgagcgctaagctgagcctccaatggcgtggcattttactgcggctttcatgatcgcaacctgtttgatgttattcccaagaagcgagcagtcctcgcagggtgaggtgctgcagcagctaaggaagcagctggagtacccaaggcagctggatgtatggaataacccaaacagtgacccctgctacacccagcctacttcggtggtcaccgtggcatgcgaggggaacgccattacagagcttaagattatcggtgacaggatcaccaagccaccaaagttcagtggctatcctgtctccaatatcaccctctctgaagcctttgttctcgattcgtttgttactacattggcaaggttacctgccttgcacgttgttatcctagtatccttggggctatggggtcctcttcctgacaagattcaccggctgtcatctcttcaagtgcttgatttgagctccaatttcctttatggatcgattcctccgaagctgtcagccatgccaaagttgcacaccttgacattggatgggaacttcttcaatggtaccatgccggactggttcaacttgtactcgaacctcacggttcttcgcttgcagcgtaaccggttgaaggggcccataccagcatcaattggtaaagctaccatgcttagtgagcttgctcttgctggcaacagcatcgctggcgaggttccacaattaggcagcttgaataagcttgagatgctggacttgagggacaatgagttggatggggagctcccagagctgcctacagcattggtaacaatcctactcagcaaaaactcactcaagggcgaaatccctgagcagtttggtcagttgaaccgacttcagcacctcgatctctcattcaactttctcgtggggaagcctcctgaaaagctcttcgctcttccaagcatcagctatctcaacctagctgcgaatatgctcagtggatcattttctactagtttaacatgcagcagtacccttggctttgtggatttgtctacaaaccaactcacaggtgacctgcctgtctgtcttaatgttaatgtcaataacagggtagttaagtttgatggtaattgcttcagtgacgaccctgaacaccagcatgaaactaagtattgtcaacaacctcacaaggggagaggatcaaacaaggatgttggacttgtggtcactgttgttggggtggtgtttattgtgcttgtgctttctcttatattaatggcttcaaacagaagaagctgtcagagagttttagcagaacaacagttacttcaaaagcaaatgcaagataattcgacatcaggaatgtcaactgaactgctagtaaatgcaagtaagtcttcttctgaagaaattttgctagtaaatgcctagtttcttatgatatatggaatgatgtgctagatgtggatcatgtgtgcatcactgcatcccatgttttgagatccatccagccgattgtttgtcatagtcacagatagatacatcatacatgtagactatcctaatggtagatgatggtattggaatgaactccaaaatttatttccctgaataataaacaagagataattgtatttcctcctattgaaattctcctctccctcacttcattgcagggtacatatctcaagctgtaaaattagggacacaaataatgcccatgtatcgagcattttctttggaagagctcaaggaagcaacaaaaagctttgagaggtcggcatttttaggcgaggggtcaattggaaaggtctgttgccatcttcaacatctgtctgatactccgatttagttaggaatttaccgtatacatgagataataattgtactgcttttaacctgttaacagtattataattactccattttattagctctgcaagctagatagtttctgacaatttttcctcatactattttaatgtggcattttccttactcctttcctttgttttcagctgtacaagggaaaactagagaatggaaccctgattgccataagatgtttggcattgcaccaacgatactcaataaggaatctaaaacttcgattagatctactggcgaagcttcgtcacccaaatttggtttgcctcttggggcactgtattgatggcgaagttgatgaatcaagtgtgaaaagggttttccttgtctatgaatatgtacctagtggaacgtttccttcatatctttctggtaaggaactaaaaataaaatgaggaattaaagtcgtacgaagtgatagcaatcgaatttgtaacttgtggttcgtgaatgcctttgctgtggtaggctctagtccagagaagactctgaactggtgtgagaggctccaagtgctgatgaacattgctaaggctgtgcatttcttacatactggaataattcctggttccttatataaccggttaaagccttctagtattttacttgatgaacaccttgtggcaaaactgagtgactatgggctatccataattacggaggagatatacaaacatgaggttggtttgccatatcatagaatgatcctactcctcttcccctgtatttaaaggagtctcaattatagaccattctttattttaatgcccttattcctattggtttacactttacaggcagcaggagaagggcagagatgtgtagaagacaatggtggagaattgtaagtacctgcagaacttgtagcaaagtatttcttacacaaagttgcatacaactaataaatgatcagacatgctgaaagtctaatataatttatgtttttagggaaaatttggaggatgatgtgctttcttttggaggtattttacttgaagtacttatggggccaaaacgtcataggaaagatctctctgtgctaagtgagctggtatgttccattttgtcttttgcgtaaagataattaatcaaatatccagatgatagttataataatgatacttcgatcaatatcacggtgatacatagctcgagcgctgtctggactgggctaatttcatgttgtattaagctatctatcaactcaatacagatattttgttggttgggtatgaccgtataactttcgtcctcattgtgctctgcaatccatgatatcataagctgaattatgacaccacacactaataagttctgagtatgaaatgtatgtttcaagcacttctgcttccctgcattagcccaacaaagagcattacatgcacaaatattaggagcaatgttgcttgcagagtaagaactacaaattttaatatccggattaatttggcatgataaaacttcaactgataggatccttagctctctaaaaccctacatgactcatatgctctgatcataccagaacaatcaaaattttacctgtatctgcaggttctgtcaatatcaaaacaggaagagcgcgagcaagttcttgatccggttgtgctgagcacctcttcgcaagattctttgtcgatggtgatttccattactgtcaaatgtttatcagttgaatcttcagccaggccttcgatcgaagaggttctctggaatctgcagtacgctgcacaagtccaggcaatatctgatggggaccagagatcagaagtttcctcgcagacctgttaggctaactgaacataaaacaccttggaggttattgtccatatctgggaaaagacggcgccgcacgtgcaagctaatttgatcttggtgtgcagaagagaatgaccaaactgactgatctcttcctgggagtaatcctgcatttgctgctacttcaacagcatttctgacacatcaacaagttaattaacatgtcaaatgctgtatgctaaacacagatatggtcacgttacgtcctgtaaagagttttttttttctcgattctagcttcccattgctgtgaaagcatccctatgagcagttcttgatttccaaacttccaatcgttgtattagggcattctcatataattaagtagtaggacgagtgatgtgatagcaaaattgatgagttgatagagaagggtatcccatgttagtgtagtaatgagaagatgtaattcatttgccacatgactcgtgctagtgcagaccaaagtgaatatgctccaaaactaaatttgggtaataaaatatggcctaaattctaatttactttaggattcaatgatgcaataatattaattccatttgttataaaactggtccgaaatcactatcgaaaaccaaacacgaaagaaacgtcataggtaattcaaacacgatgatcgcattgaagtacgatatttgttaacgagatttaaccgaagcctacatccctggagtgcttcttcccatccagcatttacagcgtattagagttataacaactatcgatcgaacgccgttggcagccgctccctctcactatgcgaactctaacaaactcctccttagcgaatatgccacgccaacatgaatttgttatttgctcgaacctccgtgtgccagaacttgagttggttcttccaccgctcatgctgagttggcccgacaagccttcaccaggatcaccacaacaagagactcccgctatccctgtaacttcttcctcttgattgcacctgcaacagtgttccaccctctcttatatcaccacaatcgtcttgctaagtgaaattgaatttctttctacctgttacatcatagactcctcaaaaatcatgttcaactacatctactgttttaaatttgacttgttctaatccatggccagataacacgcattgttaccaaatagaaaaatcaaactcactagacatgaagagaaccttttcttctttgatgtcttacgaaccgagctaattaacaaatccaatatccacgcttctacatagaaagtctcatgtaatatgttgccagaagttgtttctattgaaatctggagtcactgactccaaatcaacaaaacatcttatgttgaatcccatatgagtactaagatcctttcgtgtgagatagtattccgtcccgaagaatcggaacgtaataccttcccacacgtatcgcaacatacagagaaatcgtacggtaagaaaacgtgaaccagagtcatctactagcgcgaaatcatcccaacatattgctttccacacagtagcagaatcaacattcatacctattttagcaagcagctccgggtcgtatgctcgcgtatgagcgaacacttgatccctgagaaggttgtaggcctgcatcaactgatctttttacaagtacagctcggagtcgggacaaaacgtcaagccttgatcctcatgcattgacacttggccataagattctgcatgtccttcactcggcacatcctctttggacgagcacgcactcgagctgtaggaatggtggtgtgagctcgatactgataggaactataaaatggaaggtggactgctgaagtataaaggaaggatatatgcaggtaaaacatcttaaaccaactactaagggcataccactcctcctttggggccattatggaatgagggccacttgccatagaatcaaaatgtttttttactagcctggtctcaagagggatgctgacaaaatggttagggaatatcgtatgccaagcgactaaagaagaacacaagttcatattccaggactcctcaatccttttgatatagttgacatggcttggtcacacattaccatgaatttcattataggctaccaaaatccagaggaaaggatgtgatatcggtggtggttaacagattgactaagtatgctcactttttggccttgtttcatcattattcagtggagcaggtggtggatatctttatatggatatataacatccacaaactacatgggatgccaatgggtatcataattgatggtgacaagatattcactagctgtatatttcaggaagtatttcaaatcaatgaatatgcagctgagattcaacgaaaaaaatttggaaaaatattcttctttttaaaaatttgtgtttatatacctgtatgggagggtttagcacaaatatacctaatttgcagattggaaacgcgggaccacaaagcaagcgcgacatggacatgcgggaacggcggatgcttcggtgccgcggagtgaaaacgcggaatagcctcggtcccgtggagcagaagagcggaaccacattgctccggcggccctgtcctgcggcagcgtggtagagagcggcgtcgtgcgggatagcctcgctcccgcggaaccgtggtgcgccaccgacgcggttcagcgtcccgaatgcgcgccatctttccggtcccgctgctccgcacctcggaagagcagcgccgctttggccggcatcgttaattagctcacaaattttttttcattgcttgttggagataaatccggaaacaaaatattaaactaagcttaggctctgtttgtttcaacttaagattattgtaatccagattattaaatcagattactctaagctggattataataagctgatatagaataagttgcgagttgtttgtttctctagattactagagacatctaagggtagtgggtctttagccactcaataatctagaaaaagctcctccataggagattattagattatactaatctggcttatagattataataatctactggtttgtttcggcttactcataataatccagattataataattttaagctgaatcaaacagggttaatcacatcaacaaattaagttaccaacggaggttcattagccagtataatattttcttattagttgttggagattaatccggaagcagaagagtaaaaaaaaaagcctaatcacatcaacaaagtaagttgcttttttttacggttgtgacctctaatccagaacgcaatgccgctcgtgctggtgcgttcccgcactactatgccgcgggaccgacgacctgccggccaattgcgtagagattgattcacggtcccgcatgatggttatgcgggaaagggagcggtgcctcacgacgggaccagatcggtgccgcatatccgggatgcagaaccgcgtcggtagcgcaccacggttccgtgggagcaaatcggtcccactctccgccacgttgccacaggatagggccgcgggaacgatacggtcccgctcttctgctctgcaggatcgggcctattccgcgtttccgctgcgcggcaccgaagcagccgccgttcctgcatgtccacgccgcacttgctttgcggtcccgtgtttccgaaccgcggattagatatatttctgctaaactctccaatgtagatatataaacacaaattattaaaaaaagagtgtatttccaaaatttttttcgagattcaatacaggtcacctccatgaaacaaattgttagacagaaagagtgaatcaatgtctttgagtcctatatgagaaatatgaccttccaagagccccaacattggtatttatggtcggcgttggctgagtggtaatataccacatatcatacaactatcgagatgaccctattcaaagcattatataggtacacccattcaattgggtgggtttaatatattttaatgagtctagtgtcttgcatcaaattacgatatttttagagtgtcctcaagaaaatttctttgtggtgtcccacagctaattacgcatttgagtgtcttggagcaaatttggtgtaatatataatatccacccaactgatgagagataaatcacataaaatggcagttttgcccttatcttcttctcccttctcatagtcttcttccgacgctcactcgcagtgagctccattggcttgtccattgtgaacaaccgctcggtgcagtcgatggcgcggttgcacatcatgccacaggcgccagtgagattgggcatcgccaagccggcgtgcatggtgaggtggtgcgctatggtgctgccgtccgagtcaccggtgacgaacacgcggccgaagtcagcagcctcggtgagccagccatcagcattgtccaaggtgtgttccctaatccagtggaggaaacccgtcgcatcgtcaactgcggtgggaggcggtgcttgagggcgaggcggtacctgatggagaacacgacggcactggcatccctcacgtggtcgtctggccggggcacggccaccacggtggtgcgagtgcaagtggctccggcagctgcgccgcctccgcggtcgcctatggtgttcggcgtccggtagcggtggcctcgacatgttgcatgaccatgctgagcaactatctaccatgggcaagccggtggagctcactgcgagtgagagtcagaagaagaccgagagaagggagaagataaagggaaatttgtcattttatatggtttctctctcatcaaattggtggatactatattttaatgcgtccactatactacagaaaattaccacacttttagagtgtccttggcaaattgatgtctttgtgatgtcccatagctaattgcaatttttttaaatgttttataccaaattttgcctacctaaaattgcagccctacaggcgtacatcatttggtatcaggggctctcttaagctgagattaaaattttatggccctttcacaattactaggaagattggacaggctgcttagagactccaacttcaaagggctccaatatacatcctatttttcatgtcagccaactgaaaaaacacttgggagctcatgcagttccaatggccaatctgctatctgttagaccagacggctggatcaaaactgaaccagttgttgtattgcaaaggaggatggtgctagaaggggagaagctgtgactcaatggttgaatctttggtaaatttatcaccggctgaaccaccctgggaagataccactgtgatccgaagtatgtttctacctttcaatccttgaggacaaggattgtctcgaggggaaggtaatgtcggaatctggagatgagaaatggactgaatatgttctgaatttatgaatctctgaggatgcttaagccaattgaagagaagaggataaggaaacaattcaggagcggattatgaagatcggacgactggtaatagacgaggcatattagttttgcatctgggagcttgctcgttgtcaggaaccactgtttacatttcattttgtcgcttctctgttttcctctgcttttaagctagctctcgtgtggaaccaagggtagatactgaatgtactataaattgagatgccttatggccaaggaatggatatgaacaaacttatgattatcttttatttcaaagtaacttagcttttgagccttttgtgtcttgcgtcatacactaaatttcatgcagtgggggatggcaagcagcagcggacggacgtgggtgacaacgagccatggtggacaattggagctggatctgaactgagggttgctagacgttgagccggcggcggctagctaggatttttaggattttactcccttgctcttgctccggtacaatatcaatatacagggaggagaaattgggaatttaacttttcctggagtttaatcctaaatggcatatcaattatatacactagtgatagaaagttactttaatacttttcatacaaactatctcatatatacccttaacatacacaatgctagacaactgcagtcttgtttctacgtgtggattgaatagaagccgtgatgcccaaaatatatgaaaccctaaaccatttgcaattttgatcatcatatacatctttgcaacattttctgcaaaacgtttatataaataaataaataaataaataaatgcaatagaacaaatcaattcctgatgttcccattcaacaagaaaatataaagccgtgatggtcagaacatgtgcaaaatcttacaaagagggaaagttaaacttgatacaaaactgagagcacacatgcatgcccagaaaggtgagtcgaccatgagtgtgtatataatcccttttgttcgcatcaatggcgcgataggtgaaagcgaggacggttcgtgaacttccgtccgttagctttgacataacgcgtgatgccaaagcaaaaaccagaccatagtagtgacagcaccaaatggaaaacatcattacgtgctgcaaggaaatgaatcaagttagtatgacaaagcatgaagaaggatcaaattaaacttgttggagtgaatttggcctagtgacttggttatgtatttgtttccacatagtaatatgttggctgcaaacaactcgtcaagtttacaacagttgagtgcctctaatctgcataaattaacttaaatcattgccatttcggtaggatgaaatagtacctcttctcagtgacattatcaagaatatcacggcagccaaaagcagagcaaaagcaaggcggaaggactgcaaatgaaaactcaagtaagttctccactaaaatatcctaatttaaatatggaaaaatattgtaggatcgtaaagggcctttcccaccccaaaagctagccattgaggtgaggggctcccccacttatatcttaagtccctcagcctttcaccgtgtatagaccccacagaacaggcccacggtccattaggtatacgggccccgcaggcacccacggtccatcaaaccttcacatactgtgtccatcgggccagagatgttaacctagccaggctctgataccaattgtaagaccgtaaagggcctttcccaccccaaaagctagccattgaggtgaggggctcccccacttatatcttaggtccttccacaaccaatgtgggactattcaacaaatatctccactaagatatgcataacgacattcaaatgcccatgtaactctatcaacacgaaagaactaaattgagggaatacatcaggggtggaaatcttcgcaggtaattacactgctggttaccggccaggagctccaaaccagttactggtatttccggtcagaacattatgagctgtatattttttgcagcattaagtgtgataaatactaagtcattaaaaaaaagcacgcattatccatgccataagttttaatacaaaattttccatcaaaaactggttcatggtcggttacggctggtaaatggtttgtgaattaaaaaaaatggatatagtggttttccagaaagactggtattcaaaaccttggtatggatcatagcatcaccgctgtcaacttatcctagtaagtagatggaaacatcaaaattatgcatagaaattcattgtaaattgcaatccttttaagcatgagaattcagaaccaagagtaagaacaataaatgcaattcacggtatgcaacttaaggattattcatctgtaaaaaaaaatctcaagtaatagaaagaaaataaccaaccgcgtgattctctataagtcctttggttggagttggcatatcccgactaactgaggatatgtgatgtccttgaagaagatccatggcatcctatacaagacaataaacaaataatgagttatcactatgccttgatccatcattaccaacgtaagggatcttttcttcactcgtccatgatgtcttggataaaatagcaaacctaaaatagcaaaatccaactcactccagcccatcaatggtgagaccaagtaagcaacatacctgtttagtaccatctgcaaagttgttcaggtaatatctagccattgcattccacagatcatttaaaattccctgtgtagttcgctttccgtacctaataaataaataagatatagttaggttaagaacaacaaataactaattaatcattatttgtttctaaagatccaacaaccaaaagaagaaatagatcatagacagcggattaatagaggaaaaagtgaaaacatgtggcaatgccattggcagaacgatagtattattttgcaccttatgtgatcatgtagtttgtcagtaatttaattataatactgcactctcatgcattagaactgtgtcaacatcttaggtgtcagctcagtcctgatactgggaagtaagcaactaaacataatccaacaagtaatttttctgatggtgacgagaagataacttttcacagcgagcaagaaataaatcagtttaaaagttgccattataaaggtttaactattgaggagattcacaacatgaaactagagaaaatgtttagcaggctaggtgttaaaggatcttacaagttacaaaacctttgcttcataaggaaacattagcaactcagcttaaacgtgcttatggttgcaatcaaatcattacttctttttctgaaattagtaggtccaaattgtgcaaaggaaaaggggctaaataagagaattcacaaaaacttgaaaacacaaattaccgcacaaagtctcccttcaaggcaggagttccagagtactgagtgcttattgcatcgccatggttggcccacactgaaaaagaagtcagcaattgtttaggaccagcaacattgtgagacaaatgtgggggacatactaacaaacatgtttagtgaatatcatatgcaacacttacaaactttgtaatctgcatcaaatgccggataatcgctgattgtattgttgtcaccaagaacactgattttttgcagttggctttccaatatttttctcccgatcatgctctgttttgtgtattaaggagactattgtagttacatacacattaaaaaaatggagaaggccaaagaaacaaagtaattgctcgagaaagacataaggatccccacacaactacaaatactttgaatgtaatattctagcccagtagttgctacttgctagtgatgtaacccatggtgtggtttggtgagattagttccacatggagcattgttgacgcccgtaaaatgctaaaagtgatattttgtactccttaaatacttatgaataaatgaggtattgataaatgctgtatttattttggcactaaccttaatgtatccacgagttttggtgtgtcaacaagtttttggcggtaagccggtaataagtgcatcaacatattcaagcaaaatcaggaagttcaaaaaaaatgcaagaacaatgccaggcaacgtatgcaacggcccaaccagcctagccaaccaagggatgcagtccggccggtcccaaaccaa

SEQ ID NO: 75103 - DNA, 23732 bp, Oryza sativa
  unsure (1)..(23732): unsure at all n locations
ttccatgggttgattgggcctggctgaattggcccatgtgcagcccacccgaggctctaacatgaagctcgatcaaatatgtatgttgacttgcttcagtctcgctggagacaaacaagcccaggcgaccaacgcgacccgagcaaagggtagtgtcactttcaccaccaacgatttacacttgtgcggtgtcatactgtcatggactcatggttttattagggccgtatctaagaatttgaagcctcggtgtataacttcgtaaggaccgtatttaagaacttggtaccctgaattgaacgattttgctatatatagcactcgcaacatgtttttttgttagccatcactccatttcttcaccatatgatcttcatcaagatttcgtgctacttgttatgaaaatagatacacaacggagacacaaatttttacgtgaaaaaaccacgggcgtcgaccggcaatgatcactatagagaagttggatacaagcgcaggggatacattgggctatcgcactctccccgtgcgagttacaagcaatatatataggagaaatctaggagtcctaacaggaaactaatcctataatacaaagtcctattagataactaatccgaatatattgtgggcccaaaatacggatcatatatttaacaatctccatcttgatacgaatttcccttatagcataaatatcttcaatctccaaacaacctcgtgatgataaaatcaatgtgcgccaaatagtcacttggaatataatccataacacccttgatacagaagaggtagatcatacttcaaactcgccattgggaacaaatcctgaatctgctagtataaaccggtgtgaacctagcagagacgtgaaaccgatacacaaacttcaaactcgccatgggaataaaatcttgaatctgctggcataaatttctgaaatatattataaagtactccctctgtttcatattataagtcactttaatttttttaagtcgatatatttaaagtttgattaagtttataaaaaaaatataacaatatatatagcattaaattagttctattgtatctaacattgaatatattttaatatttttatgttgaaaatattattccctccgtcctaaaatataacaacttttagcccttaggatttgtcccaaaatattacaacttctctaccaacattctcttcccaaccaattacaactacctactccctccgtcccaaaaaaaggcaaaccatgggttcccatgccaacatttgactgtccgtcttatatgaattttttttataattagtattttaattgttgttagatgataaaacatgattaatactttatgcgtgacttatctttttaatttttttcataattttttcaaataagacgaacggtcaaacgttggacacggaaaccagggtttgtcttttttttgggacggagggagtacttgcttaataaccatatccaaccctaaaacttcttatattttgggacagagggattattatatttttctataaacttgataaagttataaaaaataacttaggaaaaagtaaaagtggcttataatataaaataaaggtagcagtaatttatttttgttaaaaatgattttttaatgcctaggacacaagttcatatcttcatcgtgagctacagatttttaaggtgtccataattactactccctccattccaaaatataacaacttttagccttcagggtttatcctaaatataataatttctccaccaatattcacttctcaaccaatcacaaccatccaccattcacttttcccacccacctccactactcatccaatcacaaccctccattattcacttctatctactttcttaataatcgtgtccaactctaaaactttttatattctggatgtgggacggagggagtattgaacacttgttggaggctaagaaaataatgccattctaaacaaatcaataaataaaaggaaaacttcttttaaaaatagagcaaaaagcctttaaacgtgtacgtctcctatagtatcatgtggttaattatcgtgtcctttccaacatcgatccacaacgcatgtacgtctacatacctgcgacgcttacctatatatatccatcgttcctaaagtatatcatcattttaacatttaaaattcattttaagattactcaaccaatcgtaactttctccatttaattttaacacttactacattctcttctcacccaaccacaacttaacattccctcatttactgctatcaacttcattaacccatggtcaaacctaaaacttaaattttataacgaggtaacactattatatatgtaaattatacaaaatactattaaaataggaactgcaggacctggcagtcaacactgcagctgttataccattataacaatccgacgaaaagctaccaccaacattcagcttaagcaatccgactggcaatttggaccatttcataagttttaaatagaagaatacagctgctatcccagtggcattgaagctggcacatactgccatatatacttagtcaaaatggaatccatgaatagaacaaaaaggatgcatatgccgctttatgacttatgatcgagtagacaaatagcatttgttctactgaatcccggccaataaatgataagtatattcagcagagatttggtcagagattaaaattagagtgtactactagctaatatgtacattgcaaggacacgtactgttcgcctctgtatataaaaaatagtggagaattggaccatcgtgtcagcttagctttgacctgtcatgtgttacctgtatcccgttaattactattacctccatcacatattacttggcactttaagtttttttaaaaaaaatttaatcattcgtcttatttgaccggtgtttcagctgcagcctgcttatatgtttccatgcatgcaactagctaactgtactttgatttgcatacagcaattgctttcacatgcaaggtagtacgtgaagtcaaaagtgttaggtgatcgtccgatcctcctcgagattcgagaggcatgaaggttcgagaagatggtaaaccccatgtcgatcaccgattcaccagcctctctctataaagttggtgcagtacgtagtgggctaaacctccctcgtcttcctcctcttgcacctagctaaacacgaacagagtatagctaagctagccagctgatcatcagtaagccgtagccgccatggcgagtggattcttccaccagctggaggtgatcatcatcatcctttgcttcttccctacttttccatccttcgcctccgggaggtactcgccacacgacggcgcgacggcgacgtgggcggggcatcatcatcagctgcaggtggcgcgcgaccaccctcgtggctgcggcggcggcggcggcctcgccgaatactgttgggttgcgcggccgcaggcgagcgtggcctccgttgcaacctttgtctctactgccggcgcggcgtcaccccatcaggtatgtaagcatgatctcatcatcacgtgttgtttggttgaagaaaaaaaaatcttttgacttgtccatgatttcaactgcagcagatccatttccctttcgagggaaaactgggattatgggcggtgggtgttaagggctggggttgcttcatttgacaccaaattaaccgtataaaattaattagtagtgccaaaatttgataatatttgacaaggtaggggtgggtatgattacgtatacgtaaaatctaaatcgagaggcttctcgctttagtcgtatcacgcgacacgcctcacagcagttcgatcatgcctgtcgtcccgacgtacatccgcgtggccgcgctctaatggctcaatgagaaggatcaacgtagtgactgcctgcctttttttaatagatatgtatgtctttttcctcttcaaataaagttttctcttaaattacttatccgatctataatccaattacaccattatgttcgttacaattaaatcttcataacaagatcttacatgattatattacgatgaaaaaatatttatatttgtaaattatttttattatatacgtaagttacttttatcatatatataagttacttttagatttgactaaattacttcttagacatataaaagtaaattcaataaagtctaaaagtaatttacatatatattataaaagtaacttaaaataaaacggaagtaactttgtcacgatattagaagtaaattcattgtagggataaaaatataattttatctataaattaaatttaatcagtatagatcaacacaagtaagtttgacattttttaaaagtaacttcaatgttaattggaagtaacttttgcatggtcgagaagtaactctctgtaaatccgtttaatcaccgattgtttttgtttttttcctttcatttttgcttttcatgtagaatgagaaaagaagataaaacctttcatggattgtaaataacattgatggaataacttttaggctttattgaattactttttatgtccaagaagtaatttagtgaaatttaaaagtaatttagatatattataaaagtaatttataattttcatcaaaatataatcatgtgagatcttgttataaagatttaattgttacgaacacaacggtgtaatcggatcgtagatcggatgagtagtttaagagaaaagtttatttgaagtataggtagatagtagccacgtctttaggtatggtatgtttactgatacgtttgcatttttttaaaatgtaaggaagttttgtaaattatcaatgtttggatcgtcagtgtgtcaccttgccatattttggttttattaaagtttgatacggtttgttttctaaacagatcagatacactcccttacctcttaagtttagtgagcttcatatacatatacgtgggaaaggacaattaaagagtcaaactctttcgccttttaatgcctagatatatataggagtaaaaattgagggggaatttgtctactgtgatgatttagacaagttctaccctttcatgcattctatatactattttaaaagcctataatgatggtggtgatgatgatgtatctgtcactactacttttcaagtttttacatatattgtctcgtaatatttttttaatattgtagaatagtccaacatttaatttaaacaaataaataacatataagcaaataagcaaacaaatgacattaagatattggttaaaaaatatattattttgtgacatattataatatttgtttaattctcctatagcaaagcatatggcattctgctagtctattttaaattctcatctccatcttaaagtctttgaaattcccatcaatattagaccgaaaaatatttatatcttcgaaacttatgttagtccttttaaaattgttgttaaacaggctgttagcaactgtcgcacatgggggccggtaaggtatccactagctatacatcacgtagcctatgatcaactgatcaccagttcaccacacgtcctagcttgtacagtagtttaattgtttaaagacttgtcaagaaacacaatactagtagtacctgtcatcccgctcgtgcgacggagtccgcgattctaggctagcgtacggtgtagtaccacctacccaggtttttctttgttttttgaaagatccagctaaaaagctggcttaggttgacgacagtgagctatagtacgactagcagtgagtatcaaattgcaacgagggctaaaacaaagacaaaaagggtcggatctgccgacggtcatagggcagctacaacttgttaaaaaggctattgaagtgtattttaaattttgagatttgatttacaagaatgtgtacatatccacttcctccgtttcaatatgtagcatcagagagagggagtagcacatgaagcgtatattatagtgggaaatatatattaatcccatcctaaatatatattacggcggagggtgtatcttagaaagcatatattatagtgggaaatgagcactaagcattaacacacaagtaggcgaattgagaaaaaaaaagtattttctccgttctaaaatgtaattttttttttggacatacacatgtgtatgaaggaggtaagtagaaatgattggaggaatgttataattgattgagaagataaataataaataattaaattaaatagagaatgattatgattgtttgagatgaggtggtaggtgtagaaataaatttattttaggacaagtaattgtgtttgaaatagttatatattttatcaataacagatgtggtatatttcgttttttgtgagtaagagtataataaaagggaatgtgcacgtggattacctaggatccagcgctatagatggccatattatcctaggcccagcgacccggcccatggcacggtactttggccccacccaggtatggcacgacccggttggtgacggccctgttgtggcccaacctgacaattggggccgtgggccgttgcgttggcatggtggggtggcacggtatgaatatgaggaatgcaaaatagacttattttcagccatatataagacacagtccaaagcagaagaaaaataaatagacttattacagccatacagcccaaagagaagggaggcaaaatagacttttgttagccatatctgagatgggcttctgtgcctgggctataggtggagcccgtggatgggcacggcctggcccggccgttgagcaggccataccttagccgtgcctgggctgagccgggttgggcggcttatttcgccatctctatcccgcgccccccaccccaaagttaccatgtttacatcaatttaaatattattactactatttgtttgatgatgtaccagatcgattaccaatatgttgtggcttatttggatgtatttaattactatgccagttgcttagttatacatgagtgacgttaactaattggcaggcatctttgcagcccggtgatttcaactgctccgtgctgtccgggttcgtgacacgtcctggttgctctccgctgccggcgttcgccgcggcggccggcaagtcgtcgtcccaccgcactgtcaccggcggcctaccggagctcgactccgagctggcgctactggccatgatcatcgtgctagctgatcgagcgacggaccggaggaagaagaagagcggaagggcgagatactccgtggcggcgataggcgcccttctggtcatgctgctgcggcaggttccgcatctgcagcaccggtggcagatgcaacacgctcaaactgcaccaatgatcccaacatgcccaagcattttcggtgcaacccccatcgtaattaagccccgtgctgcacagtgatcaggctctcttcaatacagatgttcactatggaagagatgcttataagttatctgatactagagtatagaaatactcaaaacatgtacgtgaggattagtggatgctatgatacattaatatcttgttcatgctattacctatcaatggaatatctttgtcacgtttaaatatggcacttggttgagagcattcagctgctttccctcaaaaaagaacattcagctgcatttcagttcattctcaactagccacgtatctacgccgttacataaggtgaatgacaattaaatgcacggtggtatatcataagtgtttgcacaacccacctccccctccttaccaagactcaaaacccaccttccacctcggtcaaaggcccctcccaccggtcaaacccgcttactaactccccccaccactcacctcttctcagctctcgtcctaggacggtgcagtaacacgacgacctctgtgcagtaacactatgtcttacgtgcagtaacagcgttaaaatatagttgaaatatagtcatgacggatctacttttgataagctctttttttctagcatcatggtgcaaacggttttaaaaaacagaaataaaatgaaataaaaaaagagagagatcggtagagagagagaagggagggggtatagaataactattttataccctgggtatagaatagtctcactctatatatatatatatatatatatatatatatatatatatatatataaacacacgatacattgtaatgtgtgtgccctaaaaaaatttattttggccataaatgtagtaaaataaccacgaaataaaaggtaagcagcttgctgttattcacctgccagcacaaaaaggacaggttttttatgagaaaatctcaaattagcacggatatatatactccgattagaattatcaattatgtatgttgattttaggcaagcagccactggagacaatataaatgtaaaaaacagttgcagtagggtgtgtttagttcacgccaaaattggaagtttggttgaaattggaacgatgtgacggaaaagttggaagtttgtgtgtgtagaaaagttttgatgtgatgaaaaagttataagtttgaagaaaaagtttagaactaaacaaggcctatcttctctcaaatttgtaacagagattacagagatgcaatactatgtaggtatttccagtaatttgtaacagacgatcgtctctgcaataattgaaagggcaaagcagggcattgaaagatcagaaattgatcgattgatcgatcaaattaatcgatcggtcactgcaataattaatactaccttatattttaaatgtataaactttttatccaacatttgatcattcgtcttattcaaaaaatttatgtaaatactcccaccatctaaaaaagacaaacactatgtttccgtgtctaacgtttgactgtctgtcttatatgaaatttttttataattaatattttcattgttgttagatgataaaacatgattaatattttatgcgtgaattgtctttttaatttttttcataattttttcaaataagacggacggtcaaatgttggacacgaagacctatggtttgtctttttttggacggagggagtatgacttagcggtaaaaacataatatgtttgtaaaaagagggagtaattgccttgcataataatgctagataaaaaagttgcaatatactttttttatgctggttagttcaaaatatttatataaggttgcaagaaatctttataggttttctctttcggttcttcttatctgactactactgcacgcgctgaaatggtgtttgtcgccttgtcgtaagaagagtacaataatacttcgtcctttgtcccagaaaacgagttgttctacatctccgataatatcccagaaaaagtgtcgttacaatgccaaacttgattagagaagtgggctatctgtctattctatcatgttattttccaataagtgttcaaagaatactcgttaattaattgtatgtagggattctttgtaacatgttgagtgtataatgacttaatgaaatgacaacccaattaaacaaataggggtaatttggtcattttaacataaaactaatttgattgacataccttaaatcgtcaattatgcagctttttaccaattatagatagagattcacaaatagactttaataatgtattctcctgatcttgtattggtttaatttacatttgtgtggtcatttcattctatcatttttgaactacactcattttagagtgctagaatgtaataataggctgtagatctttttagcaaaggccgagatgcttattccattataataaaaaaaaagtacttgggtttattgtcggtaatcagatttttggaataaaactgaactgaaattgggtaaggaagaggttacagcatgtaaagtttctccaccggttctgtttccaccatcctgcgattgaactgatgaaatcgcagtcttgcgcgtgtgtttatcttgtcatggtcagatttgcattggtttcttctgaccattctgcaactggaactggtggtcgcaatctcaatctttctgggttttatcttgtcaatgtcagagtagccgaataaattaactaaataaagttggtgaagaaaaagtttaaaatgagcgcagcgggcaaggtggtcgtcgtttctgacgtgccagtcatgcacgacctgatcgacatatgatggagcgcgcaaagctgccgtcgcacacgcaagtgagaaatgctttcatttcaattggttctcaattagtggagtagttcaggctgagtttaattctaaattttttcttcaaactttcaatttttccatcacatcgaaactcttctacacacataaacttccaatattttcgtcacatcgttctaatttcaaccaaacttttaatttcaactaaacataccctcagactccattaattgtgtctgtgtatatataccgtcatcgtacgtgtccatctcaattgcgtaactacgtatgtcttgcacttgaatttgtacgtttagacgtgtagtccaactccgacgcgccaatgccgcacacgccgcgtacgtaagcacgggcacgggcacggcatggcgtggcgcaccccatgcttttatttgcgtctctcgagccagctggtgttaggacctgtttagttccaaagtttttttttaaaacttctaacttttcattcatcaaatctttcatacacacaacttttcagtcacattgtttcaattttaactaaacttttaaatttagtgtgaactaaacacagcctcgatgaaatcgtgcacggtaacaaaaccagttttgtttatctgttaatcatcacgtgagtgctgatcttaattcgccgcctgttctgaattttaatttggctgttgacggggggtgccttttggaatattgtccttgttggcttcgtcggcggtgttctgattccacgacttcagcaatgttttttccaaaatctttgaaactgagcatggagcacactgaatcaatcttggaacaactttttttaattttagtctagaataatattggataggatcaggatcagccgtagttgtagctttggatgcaaggcagttaatttgacaggtgcaccggttaaacaactcatcttttatacccgttggaaacactattaatcctggttataaaaaacgtgaccagcaaatcgaggttaaagaccatgatctaccaagcaaaaaaatatgttgaatgtgggtttcgaccttaagatctctcatcttagtcctcatgtgcgattacatgtgttgtcaagtaaaaattaaggtgcttttccaaggagaaaaaacgccgggtgaggtgtgcaaaacttgggaacgggaattttattcgcaaatggtaaccggcaggacgatgagtttccaaccaattgaacctaaaaacgtctacacattctgcatatattgctgtcaaaaacgccatagtggtagccgcctgtcatattgttggctccaatacatgcatgttactccccccgtcaaactctcctaaaaaaaagataaaaaatagataattttcgcaggcccgcctgcgaaaatcaattttacaggcggacgacatcttcgcaggtggtagattcacccacctgcaaagcacatttcagcgaataaaaaaaaagacgcctcactgccgccaccggcctcttcctctggccgacgacagctttcctcctccgtccgctgctgtccccacaggggttggcgccgtcgttatgtcgtcgcatcgtggttgtcgtcgaggaggaagccggtggcctggcgccgtcgtcgcgacgtcgttgtcttcgtgttgttggcaccgtcgtcgtcgaggaggaagtcggtggcgaggagggagccggcggtggaggcggagccgacggcgaggaggggaactggcggcggaggcagggaggaggggagccggtggatccgtcgcttcacggtgctgcgaaggtcgtcgtcgtcgtggccaaggggagccgacagctcgcggaggcggcgtcgcggtcgtcgtcgtcgtcgttgaggagggagccggcggcggaggcgaggatgagggcaaccagcggcggaggcgggaaggaggggagccggtggatccgccgcttcacggcgccacaaaggtcgtcgtcgtcgcggccgaggggagccgacggctcgtggaggcggcatcacggtcgttgtcgtcgtcgaggaggggagccggtggatccgaagcttcacggcgccacgaaggtcgtcgtcttgcggccgaggggagccgacggcgagcggaggcagcgtcgcggtcatcgctgtcgaggagggagtcggcggcggaggcagggaggagtggagccggaggaggattttttttttgctaactttgtgagagagaaggagagagagagagagaggagggggagggaaatgagtggtggagaggagaggataaggataattgactttttttttggaggcataatttttgcaggcggaccacaatacgttccgcctgcaaagatcatatttttccaggcggacaacttaagaggtccgcctgcgaaaataaatgtatttttgcaggcggacctcttaagtggtccgtctggaaaaaatgattttcgcaggcggacggtgagctccaccccgatttatatttttctaggcggtcatttagctccgagggtcatacccgcctggaaaaataaaaggccaaagttgctaaaaatcatttttctagtactccctccgtcccaaaatagtgcagttttgcactattcatgttcaacatttgactattcgtcttatttgaaaattttttatgattagcatttttattgctattagatgataaaacatgaatagtactttatgtgtgactaaatatttttaattttttcacaaatttttcaaataagacggatggtcaaacgttgggcacggatatccacggttgcacttattttgggacggaggtagtagtgaataacagtggcaaagcattaacagcagactacatcatatctagattcagacttccatcaacagcagtagggatgaaaacggatcgaatacggtcgaaaacttctctatcatattcattttcaattttttttctcggaatcgaaatcggattctgaaacccggatacgaaaacggagtcgaatattatcgaatacagatacagagcgaatacgaatagaaacaaatatggtaacaaataattatcgaaatatcaagacccctcaaagttagcttcttaaatcgaggaagagatatagccattagttttcaaaagcaaaacatcaacattttcaaattttaattctatttgtaagggcaagggagagatagaaaatgttgtgtttactttgtatgttatcatgaaacaaataaattaattaatgtgtatcactgaaagagagaaggtacttgagacttcctagggttatccttgttgttgttgggctgggctgcctcttgggtagggctggcttataggctatggcagccttatgtgtaagttggatatccgatagaaaataccggatattattcgaccgttatccgattccgacagatatcacctatatcatattcgttttcatttccgaaaaatatatccgaattcaaaatttttcggatatatcggaccgaaactatcggattccgaaaaaaagtccggtcggatggaaactctccgaatcactttcaaccctaaacagcagcattacatcaacacaagcatcaacagtcaccacaagcatcgcggtcaaggtcatcgctgttgtcaccaagctgcagtcggcatcgccatcactgagtcagccgcaaaccctagacatagtcaccactgagggtcaacatggtcaagcttgcgtgtggagccgttgtgccgccgccatcaagggtcgtcgtcgaagttgaccgtcgccactgccagatctagcggtccaagaaccgccgtcaaatctagcgatcccaactcgactctcgccaccggccatcttcttactccctctcatcatcgtcctattcgccacccgctccagccagccagatccaccagcggagaggctagggtctcctagatccgatggccctgaccttcttattggctaatctagcatcagtacggaatgttgacagcttcctagagaggcgacagtagcggcacgccttggcggtggtggagagagggccaacgggagcaggtagaaggacgagggaaggagggagcgaggggcaagagagtctggaggtaggagggagaaaggaaggagatcgagaggcggggacaggtggtgaggtgggctgtgggtgttttaataagttgacattaattntgtgagcggtactctttggctaccaccagcgaaaaaaggttgctaagaggtccgactgaagaaatggcgaccaccagcgaaaatctattttttgctgatgtcctttggccggaattcctccgagacattttttttcaagtttttttttattcggcagtaaggataaaagggtgacaccataaaaagtcgttttgtatttaagaaaaacaaaacttttaaaaattaatctatgttcaaattcatttagtttttaaatatatgttcaaattaattcatttagttttgtctagaacggagtgaggacggagcacttgtctccttacaaacgccttggtattattctgttttgtctcgttgcaaatccccttaatttgtatgattctgtctgttctacttgctagtggtaatatttcttttgttcgcataaggagcttgtgcgtatgtatgcggccgttcacacacgatcactttttcttgcatgaatatacatagtatgtggatgcatgcttagctggcctaaaacaggatatgacatctatccaactttttacatctatgcatggtgttgatgcaccattaccatgcatggatggactcaattgtttaactccagaattacgtatcagccttctcattctgttttactattcatcaatttatttttaattttgtactactataatgaatttgggttaccggcacaatcgagcatgcatggctgcacgaatggcggcagtcatgacatcacgaacgaatgactatgcatatatctcgataactatgtacattaggtagggatcgataaaagaaatgaacttttcacaacctcttatcagaaagaaagcttcggcaagaagaatttccagcgcccctctccctcgggcgctgggctatataagcccttaacgctcgaacgaatattaattaattaccgtcacaaaccacaccgtagaattcacacagctagcgttaggccatgagcccgtccgatcaggtgttgctcttcgtctgcctacggcgtgttctcctgctctacgtcaccatctcggcggtggccgggcagagcatcaccgaggtcgtcgtcggtgatgaggtggtgcacgctgtcaccaagctggtggtgggtggcggcggcgtcgactccgcaaggaacatcaccgatgtggacggtggcgacatatgtcaccgcgaagtgcactccatcaccgaggaggacggcaacgtcgacgacgacgaggtgcagtacgccatcaccaacgagggcgtcggtgccgacgatgacggctccgacggaaaggtaacaccttgctttaagattctcttagcgttggttggggaagtttaagattctaagaagcaggtagttgaaagccaacttcaaaatcggtaaaagctgaattgtctagcttctagtttctagtttattttctgaattctgcaattatagtttctttgaatctagtaaaaaactggattgtttggaaagtttttgattctgagaagttaagcagctagaaactccctcaaacaagcccttaatcttcctctgcagtattttacctttttttccttggaggaaatgcagtattttacgtgaacctttactactgtttagatttcaacttttttcttcaaactttcaacttttcggtcacatcgaactttcctacacacacaaactttcaacttttccgttacatcattataatttcttcaaacttccagttttgacgtggaactaaacatagcctaactcagaaagacaaattccaggtttatagtagtgtactgtcgaatctcattgtgctggaaaaattgaaccagtgatgtttgaccctctgactctcatgatctgctccccctgcagttgtcatcagcgtccgaggttctttatgcggctagtgcgcagccgaacacggcggccgccggaaagtggcaccgccgcatcatgcccaccgccctgcagccagagctcaactccgacgacggccatggccagcagttcgatcggaccttcgaccaaatccaatcaagcatcgccgacagactgatcgccacgacgatcatcgtcatgctcatggtcgtcacgaatggtcgtcgtgcgagcgagaggaagaagaggagcggacgggcgacatggttctcaccggcggcggctctgacgatgctgctgttggtcgtcgctgcgtctgccaactctgcgacggcggcgcggccgttgcccgccgccggcggcggccataacgaagctgctgctgctgcagcagcatctgggacgatgccgctgaaggcggcagcaccaggacactcatcatgtacaacagatcccaatacgcagcagcctgtgcgttgtattccccactagctacatatctgagtatataccatgtgatatatagttactatatattactatataaataaagttatgtagtagtagatgatatgattgaaattatcaatataatcgtgtgggttttgtaatacagtacactatacatttggtttgtaacaaaatcggaataaatgggggcaataaatttggtttgtactcctacatatacatggtgagatttgtacgtgtcacgcacagctcgacctgttaatatttactatttgaacccgtcgtgcatgtacgttgacagcgaccgttcacgtgagctacgattcgacgttaacctaatctgttactcatcccgttttgtttatatgtactctgttttctttactgatttattatttactatctagtctctctttcgtccaagagattaggtcagatacatttgactagttcagtctttctcttatcaaggaaataaactacttactccagctacgcatatatcttaccatttctaattcgatccgggtatttttctttaaaaatcgatactggaatatttatgagaaaattccctatgtaccttcaaacttcacccaattctttctatgcctatgatatttactcattcccttgcatacccctaaatttcattttgaatccttctataccccttgcattagttgaccgttaaatttctatcataaagttcattctgccctttgatataaaaaatataaatttatgaagtatattgatagagtgtataaattcattgtatgcgactattatatgtatgagtttattttgtgagatattatttaacaaatgcaatattttagtttcgcctcgcgaagggaaaacaaaaataatttttatctatgacaaaatttattttagataaaacaaaaaaataatattttttaccattgaaaactgtatatataacatattttgttataatagtacaaaattctttatcagataaatcttgttattacttttgttaaataatatctcacacaataaactcataaatataatagtcggatataataaatttatacactccatcaacatacttcataaatttatattttcttgatatcgatgcgtaaaatggactttatgatatgaatttaacggtcaattaactgatggaaggggtatagaaggatccaaactgaaatttaggggtatggaagagaaaaatgagcatatcgatcttatagggtacagaagggattggacgaactttcagggatagaattttctcaatatttatttattcttcctccgaatagcacatgcaccgaaggaggtacaataagcatcttcgtaaaaaaaattaagtagatcaaagaagtgcggagactgaagttatctcctcttcgtaacaaacttcgcgacaaagaaatgcatacacaaatgtgccaccgatcgatcagtgttcatatcctcatctgtagtactcactttaatttgggaactaaattaaattaaatcaacgagtgctgctagctcccatccaaattaaaaacctaagaatcgttcaaaaggagaatctcgtgcatgaccaaagcggctggtttccagtgtccagtcagagttcgtactgtatatagctagctgctgtggactgcgccagatcatctccaccagctaccacatccatatcagagaatcgggcatgcatccacagattccgtggagaaatagtttagattcctaattataaattccaacactaaaaggtgctcattaccttctctgtcaagccatgcattacgtacccactttctcctagttatagtgaatgaacaattaaaatttctctattaactattttatttaattaatgtgccagctattagttgccaaattcgaccaaatagttatactcccccatagcaaaaaaccaacatacaatataatgtgacctattttaaaacaataaatctggacaaagacttatccaaagggcaacagtagatgctattaacaggagtagcaataacgtcacttgcaaatcacagatttttgtcatggtcaaaaagccaatctaagtatgggattatatttctctgcccttttgactgagtactactgtaaagtaacttggtattccatgtatggtacgtaggagtagttttttaagtggaccatgcatgtggatatgtgttcctttttctttccgaggatatggataggtatatatatgtgacttgacgttggctgacatcgtgttctgtacagcatcgatcttccgacgaccaaaccaaagcagccgtcatcacctactgtctgatcctttaattcctccggaatcggaatgttcgccgctagcaagccgaaccacattgccaacagctagccggagttcagctctgatcttgcccgtgggaggctgaaaagttaatcaggggtgtgtttagttcacgtcaaaattggaagtttggttgaaattggaacgatgtaatgaaaaagttgaaagtttgtgtgtataggaaagttttgatgtgatgaaaaagttgaaactttaaagaaaaagtttggaactaaactcggcctaggcttggtcgcctcgatagaaacaaagaagagcccaagacagtcgctacggcgcttctgattctcctagtacactccgtggaccgagtgatctaatcaagatatggattattagtactattttgaaggagagatctctttgtcatcatcgtcaatatcatctactagtacactccaaccgcgaaactagctagcaagatttcaaacctgttggatcaaaagcagcacaaagtgtgcatctgattaaacgccacatttttcatgttgcaatcaaattataagtcacaattagaaatgaatattataggtacatgctagctagtacgttcaaaatgaatatatctagccatagtacatctcataataaacaagtggatcgatctagcaattctggaacctaattttgtttactaaagcatatgaaattctcgggacacatacctatttcatatatgtatttcagattcgaaactcgcgactgcatgccctaagatgcagatagcctcaagatgctaccactctcaaccagacatgaatcttgacatttgtgtcatcatcggtacaaaattggtatttctttttcccattcttccatatcctcttttgaacatattgtcttttcttaggatgctaatctttaaagagtaatcatccaaatattttgatttccagaggaatttggtatttccgcagctttttgaaagggtagctaggcagctgcctgtatttctacagaaaaatatttcatagtgaatgatccatgtcttggttaaattccacaaaagttgcctttgtgacattcaggacaatgccctgacattttcttctgagttagtgaagaacaactagtagtccaacttgcattttcaattagtaactcagaagaacaacttgcattttcaaaacaagaaaaaaaaaaggctaccaaagaggaagctggatgcatggaaacggcattactttcggtagacaacaacagtagtatacattattcgacacggctaagaaatttctccgtgttttttcaggagccacgtgagaggatcggtcgggagcgtactgatgacatatatacatgcgacgagctgatgtgacgcctgatcgatcaagacggcagcacgaatccgttgtctcatctcgtctagctagccccttgtgcttgaggtttcttagaaggcaaaatttaaacagtgcatacgcactatttgatctcaacagtgcatgcatactttgctaggtgagaaagtgttacttattatccataaggatggcaagctaaatatctacttagctaggtcatgcatgtcattttttccatgcggttaaaacaattttcgcatgcgagtggtgatccgcacgcatgcacccaggtctttgcgaaaattagatttttgcatgcgggtagagcaaccgcgtgcacgcgaaaatccaattttcccatgtaggtggttaagtcattcgcacgcaaaaaatggaaacttatcaaaagaaaaatcggaaattcaaaaccatagcccagaaccctagcccaccgctaggaaggaggagaggagagaggagtggagtgggagagaggagagggatttgggaggggaggagtagccgagtgggggagaggagtggtggagaggaggggaagagagagaaaggaggggaggaataaaaagaatgtgaagagaaaggggtattttcgcatgtgagccacttaagaggccgcgtgcgaaaataggcctgccaataaaaattgatttttgtatgtggatttcttaagaagccgtatgtaaaaatgtaggtctatttttacagacgcatcgagttactatccgcctgcaaattataggggttcttgtacagaaaaatcgtttgtataatagtgttaaattacttatctgatttataatccgattacactgttatactcgtttcattcaaatctttacaacaagatcttaaattattacgttctaacaaaaaaatatatattgtaaattactttatcatatatctaatttactttagatttgcttaaattacttcctaggcatttatggaagtaacttcaataaatcctaaaagtaatttcgataaatgagaagtgattaataggacaattagtactctattgtgacaactattttgggacaaataagaatcctagagatataattataacttaatacaaaataagttacttaggacgatgaatgcgacacattgttgccacgcatggagaaggagatcctcctgtcgtcccatcactcagcggacaccatgtgagctgcatattcccttcaagaacttatcaataaaggtaagctcgtagtttatagattttagacttgtccattccgcaagttgctgcttatatatgttgattactaatagataacctctcaccacgtgaaggtggcgtcgggcatggccatccaacagacccttcagggacttaccactgcaggccgattccagcaggatactccaaggtcgaagtcgagttggtggaagccgcgtacgaggacctcgagttggactaccctggaggagacggtgagacgcatctacgagacacaagccacaccattatattatggcgcaagcggtacatcatcctccctgggcgacaagcggcgtctcgtgcaccatctcctccggcttcgccatctcctcctcaggctcctacaccgtctcctcctcatgctccagcatcgtctccacctcaggctcctgcattgactcctccttaggctcctacaccgattcctcctcaagctcctcatctggcaccttccaagtcaagggcccctcaagctccaccgcctgcctctacaagggcaacgaagaaggcgaaagttgacgccgccaaaaacaaggacccagggtacgattgcacccaagaggagcttgacgcttatgtggcatcaaaagacaggagacaattgaagcctcgaagtccagaaaagaagattcctatagacccgagtgttaggaacttcttcaggggtatgtctgcacctgccaaggaggctataaagctgtcggactatgagcgaacacttaagaaagcatcttctggaaagtccaaaccagtccctcagcttggagagcaaccaaaccaggagatcgagccgttggtgaccggtgaagaatttggaatacaagattttattaatgacaccgggctaactacatatcaattgctacgaggcgcaccaatcgaaaaggcgggagtgaaatacatgtacgaactcggtaaaccacttgtcaagcctgagcagctgcagtccctaccgacacaaatgtacaaattccatcaactgtacatggagatgagcgccaccggtagagagatgatcggagcaaggatcagggacacggacttcttgcaaggagaagatattctctggatcaatttcaagggtatctacgaactataccagctggacgccctcgacgtctctattatgagttgttggactttgtaagtatcgttcagttagatttcttattacgtttcctttaattaattaggtccttgtatataagtacaccatatataatatatacttccgtttatcgttgtagaatggagattcaaaggtcccgacggcggggggttttcgatactggattcatcgacccttggaaagtaaacgttgaaatgatcaccaagtatccgcaagccacagaggacaatctcgtccatctcctaaaggcgcagcattacaagacgttcatactattgccgtacaacacagagttagtttttactgtcttcctaccaaatttcattctcgtacgaacatgctaagtgtttcatatgtaatgcatctgacgcacattggagattccactgggtccttttactcttcgacttggaggcctacgtagtcaatgtatatgactcaatggataaaaaagagtctacgtttgacatggtttttgaacttatagacaggtacgactgtcataagttccaatgttaattacgaatcatgttataattaattgctactacgaatcatagctttaaactccatgtagggcttggtatcagttccgtcatttagtccgcggcaaatggagagaaagacttaggcagaagtttaaatttcatgtgagtacacatgctctacatttatattgaatctccaattcaaaaacatgtgtatattaattagatctctcgccgtttgtcatgtatatatagtgtgcaaagcaagcccagggaactaaattgtgcggctactacgtgtgtgagtattgccactgctttgcagaccaaatcatcaacacaagagagctcgatgtacgtacaaataaatatcattgcgtacgtatcgatttgttgtttactaattaattttatacattcataggttatttgcatgagggataacctcacacataagaaatttatcgcggcggttcaagaacaactcatgggattcatcaacgaataaatccttgatcccgagggtgaattct

SEQ ID NO: 75104 - DNA, 46266 bp, Oryza sativa
tgattggagcatgatcagagttatttctagctaggacagaagcctaggtgttagggaaaagactgatatagttcgaagaagtaaagacccaatccagttgttcaagaagaggatcatcttgcatattgctccacgtaaaggaccttccttttatggggatctcaagtacccccaggtgactaatgatatcattgaaaatgaaaatatcattcatgttacctccaggtttatttctgttatccaccaatctataaaaaataaaatctcccaagatcatccaaaaatcatttgccacatccaaatcgtataatcacttaacaacttcatccctttctggtccatgagagggaccatagacattaatcatgatccagttaacactatccaatttagaagtgaaactgactacgagagcatgttgggtttgctacagaagtctagcagaaaacatagagctacaccagccaataaaaactccacctgatgcaccaacaaaagggagagaaaaggaaaccatcaaactgtttggtagccagggttttgacaaattttgcatcaaaaagccctttttttggcttcttgtaaatagaagatcgaacaagcactttcatctatcttttgcttgactgcctgacatctgcctgacaagatttcttcatttgaagaggtgaggaactagagcttgagttcacatgtgaaagatccaaacctagcatatacgcactcctgaccaaaaagatgccatttttatctagataccaagcaacacagtcctcctctacatgagaggaaatacgaatattccagcaatgatattagcgtcaactggccagaaatgtcagtttaacctattaaggtcccaggcaccattctcagtggtaaaatttgaaacccattttagtctgcaattgcctctcttcgtaattggcttcctagagtaatctctaggaatctagtagtcacgccaaacctagattgatctcccattccaacctctccaaatgatacccttcttcaataactccaaaccgtactcaatcgctcgccacctaggggatgcattgcctccaaaacatgtatcaattagggaaccagtaggatagtaccttgctttgagtactcttgctcacaaactatgaggattcataaggagacgccaagcctatcttgcaagtagggcttgattaaagattttaaaatctctaaatcctagccccccaaagctcttcggttttgttagacagtcgtcccaagatttccaatgagttttccttttgttattttcagctccccaccaaaaattccgagttaaccttgttaaatcctcagataccgactcaggtaacttaaaaagacccatgacataaaccggaattgtttggataacaacctcgataagtatctccttacctccactagataagaaattatctgcctattgtatcaatcttttccagatcctggcctgcatactttggaacctgcctttttttagcctgccttcagaagtcggaaacccaagcctcaaaactagggtgtgcaacctgcaaaatacttctgatagattcacaaactgcagtaggggatgaaggcccaaacatcattgaacatttcactggattaatcaactggctagtactctgagcatagttttcaagaacttccttaatcaccaaatcttgctggttatttgccttgaagaacaatagggtatcttcagcaaacaacaaatgggagatactcggggcttgtctgcagatgtgcataggggaaagatcaccgttatgaacctttttgtctagcaataaggagagaccatcggctacaaacaagaagaggaagggagacagtgggtcaccctgccatagactgcgtgtaggagcaaaggtagacagaagagttccattgaatttaactgagtatctcactgtggttatgtaattcatgaaccagctaacccaacaatgagagaaccctagtctgaccattgattgctccaaaaaacaccaatcaactcgatcgtacgccttggacaaatcaagcttgtaagcacaagcaaccttctgtggttgtttatttttctggataaaatggaagcattcaaaagctatgagggtgttgtcggttatcaagcggccaggaacaaaggcactttggctttggggtatgaggtcatccagtataggtctcaacctattcaccaagcacttagaaacattcttataaattatattgcacaaactaataggtcaaaaatccttcaactccactggattctctattttcaggataaggacaatcgttttgtcattgattccttcaggaagaacacttcttctgaaaaaaagacagcaccgcccttaccacatctttcaaaataccccaattacaatggtagaaatatcccgggaaaccgtctggacccggcactttcagaggcccaatctgaaacatggcagtagcaatttccgaagtcaattgtttgttcaaaaccatcattttgctataacattagctgggtgtaacgacaataatggcaaatgattttatcaaaatgatacaaccatatcctctatgcatttatcataggtgggcccaacttatacccgcataaatgttgcaggttgtcagtgtgttctcggtgttatagataaggtattcccaatacttttgggttaggctcggtgtggctcaccatataccaagttttatcactactacagatttcatttttgcatatggcccaaatcgatctttgcacacaaacgggcggcccgcatgcactcaaaggtctgcaaaaattaggatttttgcatgcagttagcgtaaccgcatgcaaaaaatccgattttcgcatgcgggtccttaagccgaccgcatgaaaaaacaaaaatcgtgaataaataaataaaattcccaaaaagaaaataacccagccccaccgccgccggtcgcccaatcccaaaccctagcccaaaggctggccgctcatcaccgctcacaaggtccgcccgctcccaccgccaccgctgtcatcgccggtcgtcgtcgtcgccgaggtcgccatcatcgtcgcaggatatggcagccgctgctagatctgtgcaaggggagagccaccgccgccaaatccaggtgggggaggggccgctgcccccagatccgtgcggtggatggcctccgccagtcgtcgtgggaaagggccccgtcgctcccggccaccacgtgaccgaggtcatattcgtcgcggggagggtgccgccactggatccgtgtgggggaagggtggccgtccccggatccacgcgggggagggccgccgtccccagatccacgtgggggaaggccgccatcgccgggcgcctcctccgctggactcctcgcgaggatggtcgccgccgctggcctccgcaaggggcacaaccaccgccaccgcccaccatcgcgccgcactgcccacccaccagttgatatcaagaagagaggaggtgaggaggtgagagagagatatatatagagagaggagaagataaggttgagttagaaatttttgaactgttgagtgggaattagaaggtaagttagacttctagacagctccttaagaggtcccggctgcgaaaatcgatttttgcatgcgggcctcttaatgagccgtatgcgaaaatggaggtcgatttttgcagacgtggtcagttatgatccgtctacaacataacaagggtctcgtccagaaaaatcatttttgtagtattgtatatggaatcatgcctcatatattgaaggtgttccatatttactttttgtttaaatttttaatcttgattctaatgccacgtcaacgccacgtgggacgaggaccaaatcaaataatctacgtaggcgccacgtcaactaaaaccactgttcaaacctccttggggtcttatttgagatggtttttagagtcgagggacgtgttatatgtggtattttggtttaagggcgaataccaaatttgacgacaaattaagggagctaaagtgaacttactccctgtttgaagcagtgacgcaatggtgtataatttgggccttttggctatctgcccataggcccatggagactctttatgggctggatcggatggtgcctcggccataattaaggaggcacagtgtttcgaacgatttttcttcctataagcacatgcgcatgcgcccacctacatgtgagcatgtgtattgtcctgaatttatgtagtatttctaatcaaactagcaggcacaaattaagcaaatgatccatcatcatgtatttgctagtattacagttacagattatgatccaccctgttaatcttcctcctctgcttgctgatgccgcgttctatgtaaaacaaatcaaagattacagactagtatgattttgacgatccaataagcagatggattatatttgaactgaccgctgcagttccaatttacaaaacagaatgtaccacaaatgataataatgttttcattttcgacagcaaacagtcaattaggcctaaacaagttgctacgagctagtgatttgtcctaatgatcagtagcctattaatcgaagtccgatgaaatgacccctgcacacacctgagcttcttgattcgaaatataattacagccgttacgtgctcacatttaaaattagagggttgcatgtgcattcctagatacgaaaattaattggaattttggatttggatgggaggaaatatcagttgcaccatcgccgaagagattaattccaccaaaaccatatgtgtacgactctgcacgtttctttcccctaacaaatacatgtacacacaacaaactcttttggaaactactccatatatataaataggctatgttcattctaatgcccaagtgatggaagagagtatgacgaagcccacgacgatggccatttttctttctatagtgctactatccatggcacagcttccctctctcgtcgccggcaccggccggccaagggtcataatcatcggcgccggcatatccggtacgcacacaagtacttttaccgtcggtgatatctacgtcactcagtattctaagtttaccgtctacgtcactcatagtattctaagtgttactaatagaaatgatgttagctgtaatttatgaatttatatcacacatgttacatgttgttactcccttcgtcttagataagggagtgtgtattttatggctggtgcccaatatgcaagatgtaattttagtttgattcactatcttcctagattaccctttcataatgtgtatgcatgcaaactgccacaacctatacacgcagaaagcatgtgggcatgcaaaccaaccaggcataacactaactcactccttaactaaagccttagaacgctagcatacccaactgatacccacaaatctatctctaaaattatatttttgggatttataatttaattttaaggtgtaaatagatttttatctctaacatatatcttgaataaactcataataataaaaagtagacaaactcctaattaccaacatatacataaacaaaaatcgctctgcatatcatctccccacgcgcaatctctctctatgtgccaccctctccttttgttgtgcggaaatttggagtgagagtgtctctcaacctgtgaagagcaaaaaaggacaaggtgattctaatttttcggataaatatttaacactaccacataaatgattttcccatatggccaaaactcattattgttggcgggtggagcacctacctggagccaggtatctgcaaagaaaggcacttccccatgtggttgcaacaactgcatgcaaaaatgcattcttgcagtcaggcgtcttaaggaggccgcatgtaaagacctgatttttgcatgcaatcaagtaaggatgtctgactacaacgattttcaataataataataataataaagaaaaaaaaaatccaaaaccctagatcaggcactgccgccacaggcgtgagtccgccactaccaaggctgcgccgttggatccgtgaggaagaggaccactgtcgtcgtcatcgatgcagtccgctgcctgccgttgtcaacatcgcgaccccaccgcacccaaagccagcggcggtggatccaagagggagagggccaccgccgctagatccgttagagagagggccctaccgtcgtcgccattgataccccgccgcaccagaggccacctgtccgcctgtcctgaggccgttgccgccggatccgtgagggaggagggcccccgccgtaggatccggctaggagagggcccccactgttgtcgtcatcgataccccaccgcaccaaaggctggtggcggatccgccctcccgaggctactaccgccggatctgcaagggggatggcccctactaccggatccacgcagggcagggtcgctaccatcggatccatcgaggaggctacgccgctgccgccgttgacgtgcttccccgccgtcatcatcattgatatcctgcagcaccagaggccaccgctggtagatgcacccctctcgaggcttccgccaccagatccgtaaggaggagggccgccgccgaatccgccgaggaggctacgccaccgctgctgtccacgcacgcctctcctccaccggcttcagttttagaattaggtttatttaaggatattgttggtcatgctcttaattcactctctccttgatattaggaaaaaaaattaggaaaaaaaagtgcaccctctaattaacgacgaagggagtaatttatgcagaagctataagaacaattatagtcccatagatgtgtgctggtaacccaggtgcttgctttaaatcctgatcttcatacataaactaagacgacatatagttctatatagatgtacatctatgttgtgttgtgcaggtatttcagcggggaagcggctgtcggaggctgggataacggacatattgatcttagaggcaacagaccacattggcgggcggatgcacaaacagaggtttgccggcgtcaatgtggagatcggcgccaattgggtggagggcgtcaatggtgagaagatgaaccccatttggcccatcgtcaactccaccctcaagcttaggaacttcctctccgacttcgacagtcttgcccaaaacgtctacaaggagtacgtacattccatgagtgggtggatcgattgaaataattaaaactcgacacatgattaattatacagatttctctaaaaacatattttgcacatatttacgtgtgcgcatcatagtaatagacaagcactaatcatctgccaattccaatctgtcaccgctgttggtttgggaaaaaaagagagtaattaatgcccagttgtcagaagtactccacctattcacctttcatttatcaacaagagagagactaataaaaaaaaactttttgcggcccatgaaatggaatagtatacttctaaataaattaaaatatatatgcaacttctaactagaaatttgaaatgttaatgaaaatttcaaaaagagactgaaaaactttcaaaatgcaaagtttctgttgagattaaaactttcatatcattaaatattaaaatggccataggtaactgttttggacatccatatttgtcatttaaacagtatagttttgaacattaacttctactcggctgctagctgcgagaaagttatataaaaagaaattacgttatatatatagaattttacttcacatggtttggccaaataacatataaataaaacctccaattatagaaatataaataatgtagccatataagaaaaaaataaataatagatcgatgatctaaacatgaaaaataatttgaggaaatcctccaatgctaaaattatagacaatgtagcttccgtaagagagaagagataatagatcgggtccaaatgctgaaaataatttgaggtaattgtgatagaaaaagctagaaacaaaagatggtatgcattaattggaacagattcatgcagggtatgcaatttcggtaacaccgaaatttttgtggttgccaaaatttaaaaaaaatcatggatttcagtgtttttttaccgaaattatttaaaaatttaacatcttttgacttaattgaaacaaattttgatcaaattcataaatatttgaaaaaccaaaaattccagaggagatttgtgcttgttggtacggtctgaaattaccaaaatttctaaaatttaaaaccgaaattgcaaaccatggattcattgagaggagatggcaatttgcatcatgcataagtgatctaaaggctagaaacagatgaagtgacgtggcttaattagagaagataggattagcattatcttaatggagattcaactttgttagaataaatcaataaagtcaacgtataacaaacaaaatataaatttaagttttgatctttcgaaaaatagtagtacatatactcagacaaattaacgcatatggatatatacccaagtttcaactagggtacatatatatgttcaaaccgatgaatgtttgtgagtgacatgaatagattttacagcaaaacttaattaattgtgttttcagacaatagaaacaaactatgcatgcaaatatattattgcatccaaaatatatatatcctactagcatacatatgcatgttgcattatattgcctgaagttgaataatttcagcggtggcctctgcgacgcagcatacgtgcagaagagaatcgacctggctgatgaagcggataagagtggggagaatctctccgccacactgcacccaagcggccgggacgacatgtcaatcctttcaatgcaacggctcaacaatcagtacgtgcctttgccgctcaagtctttacttaaaaataaaatttaagcacttagaaaacacttcaaaagctatttgaattgatcattcatgtatttcaaatagtagctccaaaacaaatggaatttgcttaggcttgtgggcctctgaaaagttgtaggcttgtgggtttaggcccaaaatgaaactaataaccagtctagcagatacagagatacttcctcatgcaggaatgaatacgaaaccaatctatctatctattatctattattatttactaaaaatccatgaaacttcctacaaacactcataagccgccacgtggcactcctacaaacgctcctaaaccgtcacatggcacttttaatctaaccgtcgattttcacttaaattggtggacccactgttttagactattagattagatctatttagaaaagtcccagcttcatcgaaattataccagaaaaattaatgtacataccggatataaaccttccgtattgttctcttaaaaaaaccaaacagacgtatacgtacgtacgaagattaaaaaaaaaccaaaaaaccatatgtatgccgtaagaacaatacggtctttcgaatatagtgtagtacgtattgtgtatgcctttctctgttttttatttatcaatgaacagcaagtacatacttaagacttatctatctatccaccgtctttaaaataggatttcctatattataaaataaaatttattactccacaaatatgcactgttaaactagattaatataaagtaccaaatcaactgtctttaaatgttcatcttttaaattatttctcaaatatatatctaacttataatcctttgtctttctttaattaaataaaatactaatcacttataatcacttataatagttatatgttatatggaactgctaaattcattacgacacatggtgccaacatataatacgtaatgtgataattatttttcaaataatttagttaacatataataactaatgtcatgatcatttttaaaataatttcacatgacaaaaatgatcaacttggtgtcaaattcgcttgacaaatatataacactaattcaaatctacatgcagaaaaagtgaaacaacattgtggtttacaatcagatttgattttattttaatttatgtgatattgagattctcttttttttaaaaaaaatagaactatttgatgggaatttccaggcaaagaccttgctatattacgaccccttaatccatcaggagaattacggtcatatattgtttttctttgcgaaattggtttggtaacaaatgaaaaatcatttgcatcaaactattcatcatatattttttatactttagaaattctaatatatcaaacataattgatgatgtatgtcatacaccccactgaagtaactataaatgcactccaacaaattagttactttaaataattttggaaaatatattcttagaattagtaaagatgtcacatgtaattatgaacaatacatgaatgaaaacaaactgaagctaaactatatatcttagtcaaaatataaagaacaatatggtactcctagatgtcacggtcgtatgtctgtttagttatattttttttatcaaccttgctcatctgaaaagagaatattgtatctacacaataaaaaaaaagcattactgattaataccatgcacaattttgtctacacaaaactatgaaaaaattcactagggaaatattttcatcaccaacattccctcttttttttcccataaagggcaccaagcatgctgtgctaccacaagtgtagcaaatgtcatacatatggttgagttgaagccaccccggcaaaggccactattgacaatagtgtataactttgtacttactgatgcaattatctatgagggtgctgatagtgaactagacattaaaattatgcttcatgctggcattgcggggcataactatgtcgactcaagacctatgtttaaaggcagtggagaaataaagcctcgacagatacggttagcttcacccattaaaggggacattcatatatgattttaacggtcatcaaagttaaaaaatcttataaattataagaaaaaaatgatcaacggtttacttaaattatttagaaaaaaaatagaaaaataaagtccccaaaacctcgtcctccccggcacatgcacaaaacattgccggtccccttcaaccttggctcatgctctccgctctccattcctcccccttcctatgaataatactgaaaagaccatatttttaatatatacataacatttctaatctaattattgctctgttaaataattaaaccaacaattcttgatccataatgcctatatttttaatctaaaataagacttgtataaaataaaatagaaaagtagaaaaaaagtcaatagggattgaatcaaatcaattagagagaatatagtaataaatttctgaaaaatagaaaattggaacaaccattgtatgttccattgccataaccatccatctatcgtggtattatgagtttctcatatattattgcatatataagacatactaaggtagctggacgtagtagtacttagttggttaaaaagttatatatatatgctactatcaactttaaatttaggactcatgttgcctagggttttttttaaaagaacaccataaatcacatatataaaagggaaaggacgcgtaaaatatatatatctcctatgtatttattgtctcattctttcaagaaaataaagaagatcattgataattgcttatagtaatgaattaaatattatatagttcaaaccttacaaatgtcttgtaaaaaattatctaagcaatagcgatgaagaaaatttataaagaaatactccctccgtcccaaattataccaactataatcaaactcggtaccttttaactaataatcatactaactatatctaagtattatgcatgttacatcactagatttatattttgaagtactttcatgtgatgctaatttcatatttgttgggatagaatggaataaagtactggtcaaaatatgttattaaaacctgtgtaaaaaaatataggtcttataatttgagacagagggagtagtatttttcaagcatagcaggtattgtccgattgatactccatcatccgattgatattcccagtgtaacctactttacatgcccacgcgaatgcgcgggctaccttcctagttctaccagaaagggtaaatgatagtaccagaaaaccaaatctcttttaactaaaatagcccttaaacctcacgaagtttggtctgactgatgtatatgcgcgtcagtctgactccgtagtcctgctgatctaatcaccgtgtgcgatgaatctgcctgcctactcgtcaccgctggttaaaccgcccgtcgagtagaccgcttgtctgatgctggtctgaccattgagatccaaaaaaaacacgtctcgacaaaactcttaaaagtagatcaaccgtattgtatcaaattgtgtttacaaatcgcatctaaagcactgctctttcacctcatgtactagagtcaaagtctcaaagcaagaactaacttttctcccttaaaagtcgatatactcctaatatcaacccctcgcctatttatacataaaacatagctgtacctagccatgaatcctactggaactaggaatcctaatcacacaaaaaaacccctctcgaaccaggaaaacaacatccctatacaacaccaaacttctcaaacttaggctctaatctaaatttgactctactttccatacacacacaacaccacgtgtatgccataagagaactcatgtatattgttctctagtctgagcatctcgcatgatctcgttgatcatttgtacctcaagtaatgcaaaatttcatatccaagcacaagttcacaccaacttgtctcacatcatcatgcaaatagtatcacatatgtatctaaaccatttagaagtcatgaatatgaaccgattttaaaaatcgacaaaaccaacctgaacatagatgaaaaaccgaaaacattattcgtcgtattttcacatatacttatctttgacaattatttttcaccaagattacatcatcacatgatttcacacctccaaattttaatatatgatgccattggcattgttagatacttttggttgtccatattaattttgttattatttgatttgtcaataaatatttttaagcatgactgatatgttttatgcttaaaatttttaaataagacgaataactaaatgtcaacggcaacgtatattaaaaaccgatagagtttttttggccgggccagtggacggcgtcggccaatgtattaagcatgggaaagaaaaacattttacaaacaaacaacagtcactgctgtcgggaaactagaacatacaccggtagtaggctgggttaggccagagactaaatatataactggcccgcctgacagatagtatacaacatacttctatgtaaaacaacttaattctaaagatgtatctagataacgtgtatgtccaaatacaagctcagaaatggattagaattaaaaaaaattttaaagatagagggagtagtacaatagttgtacaagctgtgattcagtctctctgttcttctgggtggtggtggcgtgcaaatccatgaaatggccagcctgcccaacggcccgtcgtcgccggtggacatggtggtggactacttcacctacgactacgagttcgccgagccgccgcgcgtgaccagcctgcggaacaccgttcccctcccgaccttcaccgacttcggagacgacaactacttcgtcgccgaccaacggggctacgaggccgtcgtctactacctcgccggccaatacctcgaagccgacaagtccggcaacatcgttgacgctcgcctgcagctcaacaaggtggatcgatcacttctgtttctgtaactcatctcgatcagctcctgcgctaatgctacgattgttttcgtaattggtcttttctgtcagaaaagatgaactgattaagcacgcgatcatcatggtggtatatatgatcgatgcaggtggtgcgtgagatctcctactcctcgaccggcgtcaccgtgaagacggaggacaactcgacgtaccaggcagactatgtcatggtttctgcgagcttgggagtcctgcagagcgatctcatacagttcaagccacagctgcctgtcagtttctatgtccaaatgtccttgcatgttcaacatatcctcttccaaatataaattaagatgtgcatatcgagcagtcaaatttactttacgtttcttgcatgtttccatcagtcttggaagattcttgcgatctaccaattcgacatggccgtgtacaccaagatattcgtcaagttccccaagaaattctggcccgaaggggcagggagggagttcttcctctacgcgagcaccaggagaggctactacggagtctggcaggtacaaaatatgcagcaatatatacaatccactcacatcgaattgtagtacattgcgatgatctgaacattcttcaggagtttgagaagcaatacccggatgccaatgtgctcctggtgacggtgaccgacgaggagtcgaggcggatcgagcagcagccggacagccagaccaaggcagagatcatggaggttgtgaggagcatgttccctgacgaggacgtccccgacgccaccgacatcctcgtcccgagatggtggtcggacaggttcttccaaggcagcttctccaactggcccatcggcgtcagtcgctacgaacatgaccagctcagggtacgagctgttactccaaccaaatgctaatcgcaattcactacagatcatgtttttcattgctactttgatgtttctttggtcatgaacaaatgaggtttaaatttgagcttaatttggttttgtgtatgttttgctgtttctgcacacaaggcgccggttgggagagtctatttcaccggtgagcacacgagcgagcgctacaatggctatgtccatggagcttatcttgcaggtatctatgcctaatttgttagcctatgtctctaatgttagagagaccggagatgtaaaccatttttattgtcttaaaaaaatacctgctctagtgattgacgagatttgtaatgctaatatttgtgctttattatgtgctgtgcctttgcttgtttttgtcaggtattgactctgcagaaattctgatcaactgtgtgtgtacagaagaatatgtgcaaatgtaatgtcaggggaaacttgctttcccctgacattacattcttcagttaattaattctgcgtgttgatatgtatttttaggcgcaaacattttcatgatggaatgagaaatgtgagattccacaatttgctcatcgaggtgtgtagggccttttgtggaaaattatggtgtttacattaattgttttcttatgctacttcttgttgctgaataattcagcagttgagctgatgtatatatgttcggatatggtatcttcatatatcttcggatatggtatcttctctacagggaccaattcaatagtttaaactataattttcagataaaataatgtccaatatccccacttcgttttgttgggactctcatgtcataccctacaccttgtggatttctaataactaatggtatccgttctcttaaaaaaacattgtcaaattttcccaacatcgcaattatataattggtttgatcaatataattaatactaaaaagtcattgtctcttattgcaaaaacatactccctctattctataatataaggtgcggttaaagttggcacggtctccaaaactaatctttagcttataatttctcatatactataaggtttgtaacaacaaaattataacaatatgaaagaagatctaaatctcaatctattatactaagtattggtcaaatgttttaaaagttgaatcttgaaatacgtgcgagcattatattatgggatggagggagtatttaataagttattgatttatgataagatgggataattcttcgaaagaatttattattttacaaaatgttggcttaaattttaatttttatagtacattttgctaatcatgtgacatcatatatgggccgcagtggaacgtacgattgaattgattagggatcatttttcagtttataattttgatttgagcaaaggccagtttcccatctctttttctcatcagatgttatatttctgttttttgtgtgctccatataagataggctttggtcgattttgaataacggcgtttagtgtactttacaaaattaagaattcatttataatcttcacttgtcacgggttagtctagtcagctctttaaatgggaaaaaaaatcttggacaatatggaggaatgcatgaggccaacatgtaagacaaagtgccaattggactaaacccgcagacatgatttgtacagtttgggaatcgtgagtggtaggatatacgcgaaattcagctaaaagagatgggagatagagatttttatacaggttcaggccccttaactaatgggtaataaccctactcccgttgaccgaaactggtgttgcctttatatataagtatcacacgagtacaatatatggaatgacctaatctagtcttcgtcggcttggcaacatggagctctcacacttagtcgattgttaacgtagtcagctttctcgaatatgaacttgatgagattggagttgtctctagatctctcatgtcggtatttgtggcttctacattgggtttgtctatatatgtattggtttgtattttgacttagcgtgtctagatctgtctagatgtcttggtgcgttcgttactcctcttctctccccctatgggttcttgtatttatatcgtcgggtacccctttacaagtagaactagggaaacgagtatggatacgatccgagtaatccttatagtgcccgagtagactctgtttctttttccttatctgaaacaccttatgtttagtaagctccgccgagcccaacccaaaactattgggtatacaatatctataacactaacaccaaaggtacacccataagatgctaggcaaaccaaatcctaattcatgtgcaattatttaatttttgctagtgtatggctaatcgatccgaatgcagatatgtttgaggtactactctatatctatataatacggctaaaccatatttaattatttaataagatagatggtcagatgttggacacagaaaaccacaactctacttaaaatgggacagagggagtagctctctcagggttgcatcgctcgttaagattaaactgagagcactatcattctagattgtaccaattaaggaagtttgaaatttctctctataaaacgatttgttacaaatacatccctcgtaatgcaccttggtttgagattctcccaattgtcaattattgtccattcttcgcacacgtacgcgctcatctgaaaaataataggcaaggaaccgtggtcaccactcgtgttaggcatggccagataacatgaccatggtggcttccggcatcccatgcatggtactcagtacgtcattgggcgaaaggggtcacgagtctcctctacaagacattgcggacgacggaagatgagctatatattacgcttgcctcatggggtttcgtgagctgcctgatttattggacagattaagatgaggaagaaaatgtgtttgaaatagtatccatcatgagatgccctaattcatataacacaggtggaaagagaaaaatacaggaggaatctcaaacaaaggggaattaggagatcgaggggcaatttttaaatcttatggaaatttcaaacacagagtaacatttggggttttttttttggttgcaattttccataaaaaaaaggcgctgtggtatatataagtacaccgatggcacaaagcatataattaaatgaaaaaaaaagaatactccctccattttatattataactagctttgtctcttttactagtcaatttcttttagtttgatttaagtttatagaaaagatttaacaacatctacaatgccacattagtttcattaaaactaatatttaatatactttgataatatgttaattttgtgttgaaaatattgctatgtttttctacttgtactataaaacggatgtaggaatcaaacatgaaaaggaaatagctagcaagaaaaaaaagatacatcaactaaaaacatgaagggttcttttttattattatagtccgagtatttcataaaaaactagatgaagaagaaatgcaatcaggttcaatatttagaaaagccattttatatttaacataataaaaaagatataggtttttgacatgcacatattttagtttggttggataaaaaggaaagcaaaataacaattgaagcgagataaatggatatcatcagaaatactagatcgatattaattagagaagatcctctaggatatatatattctcgatcatatttgaacatatgattcagaccatgcgataattattttagacttttttgttagtgttggttgtgcttaatattataggatggagaaagtacagatgaaatagaagaattaatatttagaatgtagatatatatttcaatatttgttatcaagatgtattatggagattatttggatgtgaatccagccaccccggtcccagcctaccagcactgaacccaatcatttaattactcgcatgcgatgcaagttgccatgttgatgaacttctgagcgcaaaaagctaaacacgaacagctaacgaaatttaatcaaacaaaagggaaaaggacctgacaacaaatacctgcaggtcccccttttacaaatgaaaatatggaatacacgggatattttataaaataatcttcattttcaaattttaaaaagtgttccagttgtacgtacgcctcacaagtaaacaaaaaaatattaaatttaccacataaatcaaaatccataatcaattgttcatacattaacaacaaaaatattaatttaccacacaaattaaaagccataataaactgtttataaaatatcaaaatttaatattaaaatactagatataaaaaaaattataactctggcactcgcatttacaacttttttggaatggtaagcgatgtacctgatgatggctaggtgcttggataatttcatcaatcttaaaatttgtcaatccaatctcgcgagaaagttgtatgtgtattcgtttataagggtgggtgcgtacgtgtgtgctaatctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccaaatccaaatccttccaatcaaattcctccgcaaaagtctattttgcctcccccgaggtcgatgggccgaatctcgctcggcccatcttcccctcttccccggccccctctctccccgggcgctctctctctctctctctctctctctctctcgcgcgcgcgctctcccatctctcccccccccccccccgctcggcctcgcccgtacgctgctcgcgcgagcgagagccgccccgagcgcctctctccccactcccctgctcagcctcgcccgcacgccgcacgcgcgtgcgcgtaagccgccgcgccgagcgccccctccctttcccctcgctctaccgcgcctgcagccgcgcagccgctcgtcctcgcgagccagcgtgtgcgcgcccgcgcggacgccgcccgttgcttcccgcgcgcgcgtgccgtggtggccgaccgcccggtcgccgccgccgtcagcctctgcacgcgcctgtcgccagatcaagctccggatctcaagcaaggcaagccacctttgaacatcttgagcctatatttgaaatttaattatattgcttgcgaaatattatgcattgataagatcacacttaatctgttgtcccgtctgcaaggcagattggcagacctacctaatttgttacatttgatccttcctttgttaattgttataccatgtccccttgtaaccacccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccacggaccggggaacgtaccgggtgtacggtttcccgctctcgcacttaaggaccgatttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggttgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtctgactactgcttgtgaaattgctgttgtgaaaaggggttcgatgtttgaaaaatctgcagctgatgggatcagctaggcccgggtggccgtttgaaaagttgttggcccgggtggccgtttgaaaagctattggccgggtgccaaccctgtttcaagatctaaagactgatacattgcacatactccgaccggacgagacgcactgtctcctccgtgttgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgcgcctgtgacgattggtccaagtcctggcttccgctttccttttgtaatgcagttgtgatctcgggatctgtccgcagcccaacatgactgtacttctactctataaaaaagagacctatgttgctgtgatactctgtctccctgtgataccagcactgtttcctgggactggtatcgattaacaggttaatttggagcgtcacgggctagttccggtcgggactagttcggggcgtgacattatcggcatgacggctatgcgtttctactgtgttttaattagggttttaaaattatgatactgatataaaaaaaccttttacgctggtttcaaaatagctaacgcgccaacggcgggccaattagataggaaattaagtgaggagacaagggtgtatcgcgcagcaagagggcatgttgtgcagcaagagggttagtggccaatttgacaagttcctcatcagtctgcacgagctcatccaacttcaccacttcgcccactactacaaaacattcaaataggtatcggtactataggtaccggaagtgctaaaaccggcacctataagccttttcccacctccgcggtccgaaaacacgaaaaaccgacacctttaagcaattataagtgtcggttctgtaaaaaaaacagcacctatattataggtgttggatttcagtaaaaaccgacacttataataaattaaaggtgtcggtttttttttaaaaaaacagcacctttcagatcgagctgtgagccgagccgcctgaggagcggataagggagaccgcgtctttctcacgcgtctttctctctctcggtctcttctcttcctctctcttctccaccgcacacctcctcttctcttctcttcgtcctctctttctcctctcccggcggcaggaagagcggcgggaggagcagcggtgtcggtgtcggtgtcatcagcaacgtgtgtcggcgtcgtcggcgtgcggcaggaggagcggcggctgcccggaggcgccctccctcctccagatccgacaggaggaagggcggcggcggcccgacagcgccgtcccctccgctgtagcagcgtggggcggcggcggcgttcggcgggaggagcagtggccggctggaggcgctctccctccgccagatctggcgggaggaaggacggcggcggcccgagatcaccctcccatctgcggcactggcttgcgacggcgttgtcggtggcggcagtggctgatttttgatttttgatttgttgatattttgatgtgatgatttgttcatatttgttgatgtgatgatttgttgatattggttgatgtgatgatttgtgatttgtttgatctagatgtattcatggatttagggtttttttgggatcggcttgacagcacgatgcatcaagccgatttgttttggctcgttttgaaaccggcacctttaggcttctgtgatctgtgccactctcgtggtgtcggttgggaaaaccgacacctaagggggtttcccaaccggcaccatttaagggttctgtagtagtgtccccaaatccagtgctcaacctctcgtcgtttggtggagtggggaagaagaggatatttcttcgtcaaggtgagaggaggggattgacgtggggacaaacaaggctgagtgacatgcaacatgcggtggggaaaatgatgctatagctcttgctcacttacatgtggcaatgtgggccaccagtccaatgtatgctttggtaacaaaatatggcggcctaaagtgaaagtagatggtccaacttgaaatttaatttgatgataaagattagttcaaagtgtaattcattttttgattttctttttgttataatttgtatttttattaaaggcactttaaatatgacttgttttttatttttaatataatttttcaataaagcgaatggccgtcaatttcatcgtacattaaaaatactggataggtaatgattactcccgatttgctggaaacttgacacacacacgatctggcttccaatcaacacgacccgaaccctgcaattgcagcaccacgttttctctagttatcaacctgattaacctcaccgaaggctaatccttgtgtgcgaatggaagaaaacaagtaagagcaacgtagattgcaactcaatttgtagatgaatgactaagcactcgaatagggttccacaaaccgaaccagtgacgcaactgtaatggcaaaaataatgtaagcaaaactcgagtctaaactatggcggctactgaataaatatgattagggacatcctagggttacccggcaccacccccttggtcttagcgcacgatacaatacaaggcccaaagctcaaatcagaatcagactatgtgaggtatgtgacttgttttgcagattcctaactgctaaggaggaattttgatgtgagaccaaaaccatatgaaagttgcctccataaactttccaacaagtactcatgtgacctaagattccttctagactagagtctagcttcatttgaagcttatgctataaggagacctgaatccgaatccgaaacgtgtacaatttcatcttttgccttttacagaccaaaagtggtgtggtaatgttggagtagactttgggaaggtcttgggttggtccccaataaacttccttgataatccatatatattctttgcgctcggtctctttccttttactcaagcaagtacctcttcaaacgagaacagacactagtactgaaagggtttttacagacggcccgaaaggggttttcgcgtatggtagggctagctgcacacaccaaatgatatgcgaaaatcgctatttttgtgtgcgggtgggcgcacccgcacgcgaaaatcagaggttcgcgtgcaggtgcttattttgtcctcacgcaaaaataaaaaaaaagaaccaaaaatcacgaaaccctaaccctagaagccgccgccaccatccttgttgtcaccatcgttgcttgaagccactgccgctgtcctcgtcatctccgccgtccttgtcctcatcctccacctcctcgtcgggcataggggtggtgggatccgcgtgggagaggaaatggacatcgggtccatccctcacgtcaccgttgccacgcagtagaggccggatcctccgccgccacgcctcccacccaccaccgtcggatctgcctccgctagcaccgccgccgccggatccgcccctctcgagaacagccagctgcggatccatgaggaaggcaacgaggcctctccgctatcaccattgctgacctcgtccaccgccgccaagcctcccacccaccaccactggatccgcctcccctagcaccaccgctgtaggattcgcccctcttgaggccagccaaccgcagatccacgagggaggcagagagacccctctaccgttgttgtcgctgacctcctccgccatcaccgtcacgcatccggcagccaccaccgccgagagagagagagaggactgagagagagagagtcacagtggaggaactagaactcgatccttaggcgtcgaaagtgttggagctcgagcttaggaagggatgtcctcttgttcttccccaccagcaagcaaaaagtgcatggtgaactcttctccactttctcatttttgctatcggcaaggaaccaacgcataacatagtcagtagtacaaaacgtcacattcgtgacgctctcatagatatcgattcactttaaaccaacacctacgagggatttttcatgcaaacaaggctttttaaaaaccgacattcatatatgatacatcagtgccacctatggattgagccgaaccgacagcaccgaagaaaataactctagctagccaggttggtttttaagtgcctgcttaaatgccccccacccccctgtgcacgcacgcgtgcaaattcgcttcccttcttgatccatccgccctcatcctattctcttctccatccacaaggcaaccatatttgtgtggggactttggggggaggggggattgatggcggtcaacacatcggcgggaagattcttgactccatattatcccatggggagcaacagcggtgatggtgtagtattcttccttccagatatgtgttcttgtctactgacttgtgcatgcttgattcaatttttttcttcgatgttcatggaaacctttcaatcttagggtctccatgttgttgttggatggatggtggcatatggtgttgatgaatgtgatgttaatcaatgtgttcttggatatgggtcgctacaatttctttggttccatggaacctcataggtatgggttcctaaattggcacctatatgatttctcctcattggttttgccgaaactagcacatatgtgggttcccaaccgacacctatagggtgttgcaccaatgagtgtggataggaacaacttaagctcgttttgccttgctcatggccacaaccgcaaactcagatttgtatggttgaagaacgagtggatagaaaagagaaacgtgctcaaggtgaaacattgcactactacagtgcaattgcatggacaaccgcacgcaaaaactgattttcacgggtggttagttatggcgctgcctaaaaaaaggtaaaacaataaaaattctaaaatcatgaatccttagttccgaaccatagctccggcggcggctgatctgccgctcccccgatgccgtcgtccctgtagctcccgaggcgagcccgaagcccagagcccactatacatgaagctgccatcgccagtagccaaccaccttcgcccctcgaagggccggcgtcaaaatctgcgcactacggaggcactgcctccgaatcggcccctcccagcagtatggatgcacctgccgcggggccgctggcgccagctcaagtttgctctgctgctctcgtcgccacccctcctttagttgcaggcactcccgtcgcaactgtcgtcactgctcccatcgtcggttggtggaggacacggtgaggaagagaggagaggatgagggaggagatgtctcgagaggagaggggaagtaaaggaggacatagaattttttaagggaggagagaaaataagagggagaagactaggtggccgtcctgttgctaagcgtgcctcttaacaagtttgcatatatgtatttatttgttagctcaaaatcttttaacatacgggtgtttttagcctgtttggagaaaaaattaaagggattgtctacaaaaccatttttagtgtactgtttagcaaacaaatctcgctcaaattgaggagggtagtttaacataccctattccaaattatacaatggtgtaaaaagagatgttccactatgcaatttactcttttttataagtcaaatgatttaattatcgaacacatgtctacaagataacaatgtcatagtttaagctagagaggaaatattaattagttgtttccatatatgacgtgacatgtatatgcatatatatgacttccaggtgcaccgttaccgtttgtttatgacactgaagttaaaccttagatcggaaattcggaaaggaaaacatttgacctgtacgcataaaattctcaagggtccggtgtagttatatttatagcgccgtattttttacttaaaaaataggcaacacgtatttatattgtaagtctctaaattacatatgtaaatttagtgtatttataatataagtttcaaaattacatatgtaagtctcaaaattatatagtttttacatgtgtaaatggtgtgtaagtgggatgtaagtggggtgtaaatttgtattaaggaatagcatgcatgcatgcatataacacgaaattaattaggagccgtttcactcggatttgcatgactttagaggttagctagcatgctttcaggtctcttggcaaggaaaaagtatggaagcacggatcttaaacacagatccaacggccagagaactaattgtaatcaactaaaaaatttgtcgacacaattatagcaaatacgaattctcaatggctacgcgttgaaatggaaggcgacgatcaatttgtttcgctggtcggtcaatttgttcgtcttacaaccttaaaacatgcgtgtacgactcgatctatatatgtgtcacgtttattttcctccaaattaacaatacaatgtacacacaacaacctctttcggaaactatatatatatgtaggtacaagttcattctcgtgccaagaagggagatcgagagtacttgaaagacagtatgacgaagcccacgacgatggccatttttcttgtcttagcgctatccatagcacagcttcttccgtccctcgtcgctggcaccggccggccaagggtcatcattgttggcgctggcatatccggtacgtacaatctatctattatattattatagcactagaaaaaagagccttcacgttcgctctgatggcctaaaaatttttacattaatcggagaaaaagaaaaggcagagtccatatagaaatacatttagaaatagctgaaattcggaattaaaaaataaggaatattagaagaggagactagagtccatatagaaatacaatttagaaatagttgaaattcggaattaaaaaataaggaatattagaagaggagactagactccatatagaaatacaattaggaaataactgaaagtcggaattaaaaataaggaatattagaaatagagtatagagtacttatagaaatacaattagaaaatagctaaaattcgaaattaaaaataaggattattagaagaggagactagagtccatatagaaatacaattaggaaatagctgaaattcggaattaaaaaataaggaatattaaaagaggagactatagtccatatagaaatacaattaggaaataactgaaattcgaaattaaaaaataaggaatattagaagtagagtatagagtccatatagaaatacaattaggaaataatagaaattcggaattaaaaatggggaatattagaagtagagtatagagtccatatagaaatacaattaaaaaaaatagaaattcggaattaaaaaaaaggaatattagaagtagaatatagagtccataggaatttaaaactaactaaaattcagaataaaaaggagcctccatgttcgctctcatgatctagaaattgtcacattaattggagaaaaagaaaaaagcagagtctatatagaaatacaatttagaaatagctgaaattcggaattaaaaaataaggaacattagaagaggagactagactccatatataaatacaatttagaaatagttgaaattcggaattaaaaaataattaatattagaagaggagactagagtccatatagaaatataattaggaaataacagaaatttagaattaaaaataaggaatattagaagtagagtatagagttcatatataaatacaattagtaaataatagaaattcggaattaaaaataaggaatattagaagtagagtatagagtccatatagaaatacaattaagaaaaaaaagaaaattggaattaaaaaataaggaatattagaagtagattatagagtccatataggaatttgaaactaactaaaattcggaataaacatgataaaattaaaagtagagtttagagtccgtataaaaatacaatttacaaataactaaaattcgaaattaagaaaaacatgggaagaagattttaaagtcaatataggaatacaatttagaagtaactgaaatttgaaattaaaaattaaagaatattgaaagatgagtttagagtccacatagaaatacaattagaaataataaaaattcagaattaaaaaaataaatattaaaagacgagtctagagtccatataggaatatatataatttataaataactaaaatttgatatcaaaaataattaataactaacatgtatataaaatacaatatgaatattacacattagtagtttcgtaaagttattgtaaaatttaaaattatgttgtcattgtaatatattttaataatataatgagaaaacatatatgctattatatgagagaaaatataatgatgctagccgcgcaatctgcgcgggccaccatgctagttacttttacagtggtatctaccatcactcgtagtattccctactccctccatccaaaaataaaccaacctcgtagtagggtataacgcatcctatatgttcagatttattgtatcctatatattaagatttgttgtattaggatatgtcgcattctaggttgtcttattttacgacagagagagtataacagttgccggatgaaaatccctcgtaggtgtcggattcccaaccagcattaatttggaggcgcctttgcccgttcgcataggtgccagttataaaatcaacacttatagagattataggtgtcaattctatagacagacccgacacctataatctttggaaaaaagggttgtggaggcgcaagggatcaccgacctggtagcaaagggcgacaaagctccttgtagaagtgcttgaagtgtcctagcaactcgtcgacagcggggaaagataggcggtgggccccgggcgtgcagtccctgtggaacttcaataggtgctcatccaccagggttccgagcgttgaacgaggagtccccctgtgcatgagcacgcatgtgcacacacaatgacacgaccacaccttagacaccaccggaccaaatcgttggagggaggaaggggaggggggagtggacattatacttgtcagctttttaattaattaacgcctatgatatattatatgtgtcattcgttttttcaaaatcggtacttatagaattaatgccagcttttcctatagctgcttaaaggtgcataggtgttggttttaaacgaaccaacacttatgagctgatatctattagggattctacagtagtaactccaatattattactatgttagccacaatgctatgtttttaattatgatgtatgttacatgttagtttatacggacccatagtacaaattatggttcacacattagagataaattggtccggtggtagataccatatataggagtagtacatatcatgagttaaaatctcggtctccacaagctgagaaccgcatgtacattgatttacatctatattgctgtgcaggtatctcagcggggaagcggatatgggaggctgggatagcagacgtattgatcttagaggcgacagaccgcattggcgggcggatgcacaagcagagtttcgccggcgtcaatgtggagatcggtgccaactgggtggagggcgtcaatggcgaaaagaagaaccccatttggcccatcgtcaactccaccctcaagctcagaagcttccgctccgactttgacagccttgcccagaacgtctacaaggagtacgtacattttcacacaaccacaagttggtggataaattggagcagctaacaacttgacacgtgattaatcagacatatttctctaatgacatgttttaattgcatatgttgatgtgtgcgaatcatagtacaataattaacacactcatcatcagttgtcaattccaaaccgtcaccactgttggttaattattgcatgcacagcacagcactcagaactgtatcatttagtattcatgcaccattcacttatcaacaagagtaactaataattggatactttgtgcggcccacgaaatggaataattatacttaatttgaaaaagttgatgaaatttcaacaagagatcaaaaatttcaaaatgcaaagcttttttttagattaaaacattcatataaatattggagaaatttcacacaattttcaggtaattaaaacattcatacacaatgttcaagcacaaaacattcaaatatagatcaagagatatatataagtgacttttctcccaacttttggttttaccttgaaactatctaccgtgtaaacatggaatagtacttggaagaaaactaggtattgttggtcaaactttttctctttcccggccactagctatcagttccccatttcttgagtttttttatttcttttgtgcgaggagttccttagtagtaaactatagatagtatgggttctcattggaagatagataggtaaacatgagagggtaaacttataaatactacctttgtcttagaacccgttctaagcagatacatcaaacggctaattagccgcacatgagaaatgtgattagcatataattaattgtattaattattaaaaactttttgatttttaatagcttgtatataaaagaaattttgtaggtaagacatcgtttagcaatttaaaaacatactaacggaaaatgagaaatagctaagttgaattagcacttcagaataaggtcttaaaattagtagctagaaataaaaaaaaattaggacgaagggagtagataaatactaaaccttctaaaccacttaagggcaatcccaacactcaaagggaaaaatatgaagaaactattatttcttatacaagacactagctttaaaggaacaaaaataaggataaaaagaaagagaagggagatgatttgatgagagtttattttaaataaatcgtctatattgggtatatagtttctgcgtacattgtcgatataacatggtatatatgaaaactagtaatagtttttgggttaagattgttctaatgatcaaccttctatttatttcacgctgaatgccacctcacagttgtacgttcgtaggcaagtggccaacaagataacagtgcccggccccatcatgcttatgggaaaccaatcgcaatagcatacaagttgtatcaaattggccataggtaatgtttacatgtgcacatggctttatgagaaaagatggacaatttgcaccatgcataagtgatcgaaaggttagaaatagttatggtaacgttacttctcatcagaagagaaaattggcattaaaaatatttagtggggattcaattttatggatgacgttctctttcgtggtccaatcttctggtgaggggataactctcggtttgatcgagtgcgacatttgcgatatggctaccaaccagaacaaggacatgacgttgtgcaatcgctacaccacaaacaatgtcataccaaccgtgacacacggttgatgatctttacaatgcaaacgagagaacattgcaagaacaagatataagatgcaatctaaatattgcgaataggtaattaagcacaaattaatagttgtgattaaagtgatatatctaatcgatccgataaatcaacacaccaactattaggggctctgaatctattgtcgccgactaattaatcgagcgaggactatagacaaggtgaatggcacttggcaaaatccaactaaaccaaaacacaattgttctagagggtatacatatacatttatagaggaaaatggatctagagttaagtgctaattcatggaggtggagggagacacttttgagatgggactagccatgtcttgttttaaagattcttgttgactcggaatgaatttggatgagaccggatgcgtttgaaagatagcgagataatctttccatcaagtccaggatcacctaaatcggagttggcatggagacgctacgtccgtttgaagtaagtactatctccggaggctgaactgaacttggacttgaaattatcattagaacgtgtgaagttacgtgcgtatccgatgaagtaatgccctcatcgtttattggaacaaatacataatgtcaacataacaaacataatataaattgaaattttgatctttcggaaaaaacaaacgtataaattctcgacaaattaacgcatatggatactgcaagtttctacctgggtccaggaacttatatttgttcaaaccgataaatgtttgtgacatgagtagattctacaccgaacttaattatttttttaaaaaaaataatggaaacttaattaattagtatcatgtatatttttttcctccaatatatatatgctaccatacatatatgcatgttgcctgatgttgtataacttcagcggaggcctctgtgacgaagcatacgtgcagaagagaatggatcgggcagatgaagtggacaagagtggggagaatctctccgccacactgcacccaagcggccgggacgacatgtcaatcctttcaatgcaacggctcaacgatcagtacgtgcctctgcccctcaagtctttacttgaaaaaaaaaacgttaagcacataaaagaacacttcaaaagttatttgattttttttgcgacaaaaagttattcgaattgatttgtcttactgtaagagtatagatagatatagaaaatcgtttgaaatttgtgtaaggactgaactaatcgtatattgggcctcgaaagatgtaggactatcaactaggcccaaaaagacactaaggcctccttcaagatttatagttggaattttgatagatcaatgaacaagttgattttgtgatagctatttgagggtatatacacaaattaattaattaactactacttacaaatttaaaaagttggttcagcaaaacagtatatagaaaactttacacaaaatatccatttagaagcttagaaaacgcgcaaatgaaaaatccaaaatccagtacaagctagctggcctgaataactggcctgacaagcagtacaacatagcactacaagctgtgaatttactttctgctgtttcgggtgcgtgcaaatgcatgcaattggcagcctacccaacggcccgtcgtcgccggtggacatggcggtggactacttcacctacgactacgagttcgccgagccgccgcgcgtgaccagcctgcagaacaccgttcccctccccaccttcaccgacttcggagacgacacctacttcgtcgccgaccaacgtggctacgagtccgtcgtccaccacctcgccggccagtacctcaacgccgacaagtccggcaacatcgccgacgcccgcctgaagctcaacaaggttgatcatatcacttctgatgccatgatcttttctgtcagaaaagatgaactgattaagcacgcgatcatcatggtggtatatatgatcgatgcaggtggtgcgtgagatctcctactcctcgaccggcgtcaccgtgaagacggaggacaactcgacgtaccaggcagactatgtcatggtttctgcgagcttgggagtcctgcagagcgatctcatacagttcaagccacagctgcctgtcagtttctatgtccaaatgtccttgcatgttcaacatatcctcttccaaatataaattaagatgtgcatatcgagcagtcaaatttactttacgtttcttgcatgtttccatcagtcttggaagattcttgcgatctaccaattcgacatggccgtgtacaccaagatattcgtcaagttccccaagaaattctggcccgaaggggcagggagggagttcttcctctacgcgagcaccaggagaggctactacggagtctggcaggtacaaaatatgcagcaatatatacaatccactcacatcgaattgtagtacattgcgatgatctgaacattcttcaggagtttgagaagcaatacccggatgccaatgtgctcctggtgacggtgaccgacgaggagtcgaggcggatcgagcagcagccggacagccagaccaaggcagagatcatggaggttgtgaggtgcatgttccctgacgaggatgtccccgacgccaccgacatcctcgtcccgagatggtggtccgacaggttcttccggggcagcttctccaactggcccatcggcgtcagtcgctacgagtatgaccagctcagggtacgaactactactccaaccaaatgctaatcacaattcacaaattgatgcggtttggatttgagattaattttggttgtgtgtattttttgctgtttctgtgcacaaggcgccggttgggagagtgtacttcaccggtgagcacacgagcgagcgctacaatggctatgtccatggagcttatcttgcaggtatccatatgtcagataggccggacatttaaaccatttttattgttctaaaagagaactaccctagggtagggatcgacgagatttgtaatgctaacatttgtgctcaagtgtgcgttgtgcctttgcttgtttttgtcaggtattgactctgcagagattctgatcaactgtgcacagaagaagatgtgcaaatataatgtcgggggcaagcacggctagtttgtggaggcaagtcaaactaccttgtcaattggctgtgagaacattccaagctatatcttcagttaattaatcctgcgtgttgatttgtatttctaggcgcaagcattttcatgatgggatgagaaatgtgagattccacaatttgttcatcgaggtgtaaagcaatttgaggaaaaagtgtttacactaattgtttacttatgctatttcttgttgctgaatatatatttcagcagttcagctgatgtatatatgtgctattgtttcgaaatgaataaaatcttgcgtagatttgtaaatctgtaatttctgatgactacaagatactccgttcattcaccaattcacgcttgggattccgatggaccaatggagaaggatgaaacggagagcaatctcttcggattagccatttcattttctacttatatgaatcagaaaaccgatatttttctctaaaaacaagcaatatctatagcttcgattatgactttgctgaatatctaaccagaactcaatgtcaaaaaaaaaaaaacaaaactcaatatagcagtgtatatatataaaacttgtgtggctaacactaaatccgaccttagctcagttggtagagcggaggactgtagtttgatgcagagaaatccttaggtcgctggttcgaatccggcaggtcggacaatttttgtttttcaggcattcaaaatgcaaactctttttcgttcttttagaacttgtttttcgaccaagtttacaggcattcaaaatgcaaactccaagcagctcgtgctcggttggactaatacacaacatttaacgtcagcatataaacattgaaaccatagaattttgccaaaaaaatatatatactgtaataaagaaaagccacatacatgtggaaaataattaatccctccatccctaaatttactttttttaaacatgtttgaccgctcgtcttattaaaaaagtttaagtaattattaattatgttcctatcatttgattcattgttaaatatacttttatatatacatatagttttatatattttataaatgtttataaataagacgaatagtcaaacataattaaaaaaagtcaacggcgtcaaatatttagagatgaagggactaaatatttggagggagtactaagttagatacaagaacaaaccatggggtgctccctgcaggcagggcaccgcttctcttgcagggcttgtttcatctcgcggttctccggtcgccggaggccaatctgctcgagcgtcgtgcggactgcggcggcgctgtctgttggcttcctcgatcgatcggaaagaacgggctcttgggcctgctggcctttcagaatgcctcttttgacgcctgcaacctgttccaggcccacggtccgcagccggcccatgcctcccacaaagccttttatccctttttttctttttttgcctatccatttatcaagtgataaaatcactcagagttttcctacattaagatttacatccaacgaactacgaaaaaaaataaaaatatatatttacttacatattatttttatcaaaattatagtgtacttacatgtcatatcaactgaatttataaatgcaattttagttatatagaattgtaattttatattttaaagaaaataataaatacatatttacttacccaatatttttattaatattataatacacttacatgtcatatcaattgaatttacatttgtagatatatcaaaggatcgagaaaaaaacataaccacgaagtcgccatgaaaaatagaacatcaaattatcaaaccaaactaacttatatggttgcatccgttcatattccttatttgtttatagtgtttgttgtgtgctcgatagaaatactactaggcggtctgtatagcgtgtatggtaggagacgcatcgcagccgttaaattaaattatgcgtgatccaatggaagcaaattcgagtgatttctagggaaaaaaaactgtcgtatgatgtttagcaaaatcgttttgattttaagtaaaattatgcccacggtaaaatgaggcgcattttacgttggcattccaaagtcctggcaccaaatatgtgctcttagttcgatatggtatttgttcttgaatttcacatatttcaaccaataacatgattgggaagagaatccaagcaattcaaagttcaaattttgaccactaaaatgtctaaaagaaaatgttttcctctacccttgttgttttttttacttcaagatctaaaaatagtactagtattttgaaacagatgccggcgtacttggcacatggcagaaagaatcgaataattacaagaaacatgacatattagagtatatggtagtcagagatatattaggataggattgatttgtttggattatcactctccctgtactatccaacatgacagagtaccattaatttctccagcttacagcaaaagccaaagtacatgcaaatgtggttgtggctactgaagatcaaaaacggcagcaacaacacgagctctctcggcctgaccgttcacttcaggggtggcgcccgtacgtacgcagcacgtcgaccctgcctgccactagccgccgcctcctccctttcgccggcagagctttccactgcgttaaattgcagttgccggtcgatcggttgatcgatatatccgactggccaacaagcagccagcttgccgcctcttggcactgcacaagagtcaagaggcaggggcactgtatctgtatgtgtaattccagtgaacctgaactgaaacatgaagagcactgcagctgcgccaagttgaggttcgtgcgtgtgtcctcagcttgcattgacgggtcggcaagctgccgtgtcgtggtcatggcggttcagccatccgggctcctgcgggtagactgacgtacggtggttttctccttttctgtccattcttgcagctcaaatatagggtgtgtttagttcacgctaaaattagaagtttgattgaaattggaacgatgtgacggaaaagatggaagtttatgtgtgtaggaaagttttgatgtgatggaaaagttggaagtttgaagaaaaagttaggaactaaaccaggccatagtgcagataggtaagttgctccatttggtttaatttagtcgtagataggcaagcgagcaaaaagtatagtcacaaagttttcaggtcgatataggatcgaggaacgtgataccctactcacgagagatttttacaaggtgggaacgaaaatgatccgcgttcgcgggacagggacagtgtttccgggtcgagggacggatcctgtgactaggagcaaaaccttcttaccgacaaagataaatcaatggttgtgatttaattcaacattgttatcgatttttgtcgctgcaaatgatcatgataatgatttgttatcaattatgtatggtactgatcatgaggaatgcacaatatctgattatgacgccccctttgaaacaaaatactcgtggagaaattttgtaggactcaaattctataggaatttttcctatttaatcatttgaaatatatgattgaagctttttgaatcctatgaaatttctaaaaaatggctcactaaaagtagattttgaataaaagttagcaagaggctcaacctcttggaaaattctttttaatctatctcactcattcatttcttgcatttttcctgaaacctattcaaatagttatttctgtattttttatgcgttttgcgattctctgttttgtatttacaattctgtcaaagttccatatatatattttctacattcatctgttttctcaatgtatcatttgaaaggactatgcatatgcacacttgaagggattgtttgctgttgacacatcatgagggacgctcaactctgcaatgatatcctggtctgattgatggactgatgctaattatatgtaacactagtatcatatcctacgcagcatatgacatcagtcatttttttttattctgaagcaaacgtcaagctttgaaagccttttcctttcattatacagagccatatgttgctttcgctgatctggcgacacatacttatcagaatcatcagtagtagttaaccaggttctttgctccctgacacccatgcatcatctgctgctgagcattgcacctagatcacatccctttacaatattgttctgtaaattttggccacaagcagctcaaacttgcatcactctctctacatatattttactgaaaagttcattccaaactgcagtgcttgccacttgtatatggtcccaaataccaatcgttcacttcacttgaaccaaaaaaacgccaaagatatatgctacttgcaagtgtcatttcagagtgcaagcctactggctaccagtaaccaggacccaaaagatggcgaaaatgattttaattttgggctggaaaacaacaacctagctacctgattggtgctgactcggacaagcccacacttggtagatgctgccaaaattaaaggttccttaaaactcctgtgtagcaaatcaagcaggtatatatgaaatagagaacattatctgaaaaattatgtattacacataatctaagatagttagaaattagcaattaagtgtttttcctaggatattagcaattaagatatatatgtatcacttttctcttggagccatctcaagttagtgatttcggtcagagtatctatcagttcaacagcacctgaaatttttgtggaaaagtcattgaaagcactgtttaattagctaggctacatacactattatacttctttatcaatacgctaataactatgtttatagctagaaaaggaacctatcaagtgagatttctttctccaacaaggagcaaggcccctccactactccatgtacttttttcttgtagggacagcactgagatcaccaaatagttcccagattaagttaggatggcaatgtcataataatttttaagatcttgttttggcaagtgattgcaactgcactagaaggggagactagtcagaatgcagagcatgttgttgggtaagttgcctcagctgttctgaaacttctggctctgtcactttacatgggctgtgtttaaatccaaagtttagatccaaacttcagtccttttccatcacatcaacatgtcatacacacacaatttttcagtcacatcatctttaattccaaccaaaatccaactttgcgttgaactaaacacagccatgatgcatttaattgccaattggctaatctaattgtgttccctctaaaacaaaaggatatatagttgtgtgattaccgtttggaaaatggttttgtgatatcaaaacgatcccgagtttagacatttaccatcaagagttatggatacactgttcatgctaaggcctggtttagttcccaaaatttttttcccaatacaaaaatgtcacatcgaatctttggatacatgcatgaagcattaactatagataaaaacaaaaactaattgcacagtttacatggaaatcgcgagacgaatcttttaaacctaactagtccatgattagccataagtgctacagtaacctacatgtgctaatgacggtttaattaggctcaaaagattcgtctcgcggtttccaagcgagttatgaaattagttttttcattcatgttagaaaaccccttctaacatccggtcaaacattcgatgtgacacccaaattttttcttttcgcgaattaaacactccctaagttaaatcatttcagctatagtacttaactttctctccctggtactattgctgaaaggaattattgccatttaaatagtctaatgacattaacttctaactaatgccggctgaattgttcaatgtaagtagactcagaactgaaatagtccacactcttttagcttctttttgacattatcgctgtttaattaaattcaaaattcctggattaattaaagctctatcaactggcacttagtggctacttatagagttataatgaagtgtcaaatactatggacggaggaactatacctatgcttttagcagggccgtcccgtcaaatttaggggccctgtgcaaagttgaaggataaaaacttaactgatgatataatataaaaataatttatacttcttaatatatttcatagaaatctagaatggcctaaaatgataatataaaattaaggagtactggattagaaattaccagaaagaattaggtcaggggcgcggcaagcgtcaggcggcaacagcgttaggcggcacgaccgcatgagagagagaggtgaggcgtcgtttactgctctcgttcgttgcgattgacgattggcgattggcgaggtccacaatgggagacgattcaagattgtgaaccgacaaaggcgtaatcgaagccgaaacaacaagaaaaataacatatttttgggactagttagctaccaatttacttattgagttatatatctagtgttgaagttttgggctcaggggcccctgaaaattgggggtcctgtgcgggcgcgctggccgcacgcccctaaggacggccctggcttttagtggcatttcatttaagcatgttgcttttattctcatatatggatgatgtttaggttttctagttaaagtgttcccatttaatgagttatattatttttttccaaccatatatatatatatatatatatatatatatatatatgcatgttttcaagatgaattaatacaatctcctctccatcatttttttggatatatatttcatcctctcccccctttcggtcgtcttgccaactaactcttagctaggataggaatatataaacggaagttagtcaaacaaataggggcgaaacctagggcaagagggaggcctggcccctccaacgatgaacctcccccccccccccccccggcgaacccaaaatgcagatcccttccgattcctatcatgctgcgttagtgatgataagattaagatgggctattacttgatgactttaggtcctatacacatacagttatgattttttacgaaaatttatacattaacgtgcgaaagaaaaaccatggaaattatagttttgcctgccaaattaaatagaatacgatgaagaggggggggggaagattgttgtttcagttggtactagctcatccatattcttcaaaatcgacggaagattgctaccttattctaataaaatcatgccaacatcatggaagttgcgcgagaagagaattactctaatatgcaattaaagtcctaaaatctccatggattgtcttgatatatttttttaactaacacctcataagttagctcgtcccgccctcatgtctagatcctagcttcgccaatgctaacgaataaggggaaatattggcatatttcgatcaagaaagagatacatattgttctcgctattgcagcaagaacccaacaattctctagagtttgggcaaacacacgcgtagaagttaaacatcattgtagaaaatacatgtcatcataatagagtgacctgctaatgagccgcccaggtcatccaggcctttggtccgcccttggttaatttgctgcagaatatatatgccagagtgccgcgctttggcaaatagagggagagctttacaaaagttttatgcatgtgatattcaattatttaaaaaactactcctattctaagcaaatatatatttattttgtgtttcaaacttgctcttaacaacttcttgtctacagtaacaactaataggaaaacttgaggtatactccgttatacgggagcgtatcctatgcacacaggccctcgcgtgtacacaccgtgtacatcaactaaaaattatcacaaaaaattctaggaaaattcatatatgtactttcaatagtattacatctacgcgcaaagtcacatcttcaaattcattctacatagagaataacaaaaaagataaaattctgacaaaattgcaaccttaaaactgtcggattttttgttttttttttgttacggctaaaatataatgaatttgacgttaagattttaaccctaggtgtaatacaattgaaagtatgtgtatggttttttctagattttttggtgacattttttagttggtgtgtacgtgtgtacacgtgagggcctgtgtgcataggatatgttgccccgttataaaacatatgaatttctacatatactcttcattcaatactaattaaacatcacgaaaccattcaacatttttatatatatatatatatatatatatatatatatatatatatatatatatatatatatatatatatatatatatatatatatatatataaaacatgcattacgaacttattactcttaccaacttatgttgtgtgcaccattaatttatccgtaacatttcatgttacaaagtgcagcgcatcccagtactagctagctacccgtcaacaattaatctagcaaaccccatgaatgacctttctttcaatttgcgagatccaagaatgatggattagttgtgtttatgtatcatacgaacgcggcgaatcgcaattctagatatcaacctcatctagcatgtggaaaggtttgggcggaagcgatcgcactcgtgctgtgcgtcgattacgtgttatatatatctgacgggaaaagcccccgtcgtggctttgtacagaagagcgcggccaggaaacaatcccagccggattacatgaaagaaacgatatatgcagtaacaaactacctaacagatgcatatctataacaaaccaagtttgttactgcatggatgaggatcggcaaagcctgatctggatcggccaagcctgatccgagcttatctagctaactaacaccctctctcaatcctgaccgtacaaggttaagattgctcttgaaattctccagaagtcttaccgacaatggcttagtgaaaccatctgcaacttgatcgttagttgaaacaaaatcaatctctagaagtttctgacttaccctttctctaacaaagtgatagtcaacttctatatgttttgttctggcatgaaacactggatttgctgacatatatttagctccaagattgtcacaccatatttttgcggccctaggacttttaattcctaattctgcaagtaaggtttgtacccacatgatttctgcagtagcatttgcaatagctttatactcagactctgtactagatctggaaactgtagcttgctttctggcactccaggaaaccagatttgaccccaaaaatattgcaaagcctcctgttgaccttctgtcatccaggctaccagcccagtctgcatcagaaaacccactaacaagagtagatcctgatttatgaaactcaattccaagctgagcacattgctttaagtatctaagaattctttttactgctatccagtgtacagtgtgaggagcatgtaaaaattgacagactttgttaacagagaaagcaatatcaggcctagtgagagttaaatattgcaaagcaccaacaatacttctatattgagttgcatcatcaggacctaataaagaaccttcatgaagagagagtttctcacttactgacataggtgtacatgcaggtttgcagtctgacataccaaccttcttaagtaaatcagttgcatatttttcctgactcaacacaataccattctgaaccttatttacctctattccaagaaaataatgaaggtcaccaagatccttgagtgcaaattccccctttagatcctgaagcaaagctgtagttgccctctctgaagaactggctacaatgatatcatcaacatacaccagaacaaatataattatgccacctttgtttgaaaagaataatgaggtatctgctttagaaccctgaaaaccaagatcaaccaacttcttacttaaccttgagaaccaggctctgggcgcttgctttagtccatataaggctttgtcaagcttacaaacaaagtgtgggttagcaggatcctcaaaacctggtggctgtaacatgtatacttcttcttctaaatatccatgtaggaaagcattttgaacatctaactgtctaagactccatcccttggatacagctaaagacagtattattctgatagtagcagctttaacaacagggctaaacgtatcttcataatcaataccatacctttgtttaaacccctttgctactaaacgagctttatatctatctagtgtaccatcagctttccttttgatcttatacacccacttacagccaattatattttaccctctctgaggaggaactagatgccaggttttattcttaactaatgcatcatactcagattccattgccattttccagtttttgtcctttatagcttctaaatcattagtaggttcaccagaagcagtaaaccaggaatgcttatatttaatagtaccatcagtatataccttctctttgcgaactccactctgaagcctggttcgcggaccaacttgtgtcgcatcaacttctgtcgatgtcgagtcagctgctgttggattactttcacccgtgtcaggcgcctcggctggttctgactgccgcgccgactgccggtgctgtagctgttgtgctgtccccctggatgcagaaccggagccgccaaccagggagcg

SEQ ID NO: 75105 - DNA, 12098 bp, Oryza sativa
tgttgcttggaagggattggattcatgccaattgttgtattccttcgaccatgcaccaatgcttgattcaatggcaaggcgacaaggttgagattgtaccagccgacaggtcagttaatgttgctagtgccgatctagctctttgggagatggatggccttgattgtttatccaggaagatttgggttggagattttctaaaagtgtccgattctgatatacagccgattgaagatgaagaacccaagctattattttgagggcgtcgtggagggttcaagcgtctacgccaaggacacggtagatgatctcgatgacaagcaaggttagggttttatgtcggccgatgatttagaagaagtggatataggtctgggtgatcgaccaaggccgacattcattagtaagaatttgtcttcagaatttagaaccaagctgatggagcttttgaaagagtttagagattgctttgcttgggagtattatgagatgccaggactcagccgatcgatcgtcgagcatcgattacctttaaagccagggattagaccacaccagcagcctccgagaagatgcaaagccgatatgcttgaacctgtcaaggctgaaatcaaacgtttgtatgatgctggttttattcgtccttaccgatatgctgaatgggtttctggtatagttcctgttatcaagaaaaatggtaaggtgagggtttgcattgatttcagggatttgaataaagctaccccaaaggatgaatatccgatgccagtggccgatcagttggttgatgctgcttcaggacataagatactaagttttatggatgggaacgcaggatataatcaaatctttatggccgaagaagatatccataagacagccttcaggtgtcctggtgcgatcggcttgtttgaatgggttgtaatgactttcggcttaaagagcgctggagctacgtactagagggctatgaattatatatatcatgatctgatcggatggttggttgaggtctacattgatgatgtggttgttaaatctagagaaatagaggaccacatagccgatttgagaaaggttttcgagaggactaggaaatatggtttaaagatgaatccgacaaaatgtgcttttggtgtatcggctggccagttcttgggatttcttgttcatgagagggggattgaaatacctcagaggagtatcaatgcgatcaaaaagattaagcctccggaaaactaagacagagttgcaggagatgatcggcaaaattaattttgttcgaaggtttatttctaatttgtctagaaaactggaaccttttacaccattgttaagattgagagctgatcagcaattcacttggggggcaaaacaacagaaagctttggataatattaaagaatatttaagttctcctccagtattgatccctccacaaaaagggattcctttccggttatatttgtcggccggtgataagtcaatcggcttggtcttgattcaggaacttgaaggaaaagagagggttgtgttttatttaagccgtcggctcttagatgcagaaacaaggtattctcctgtggagaaattgtgtttgtgtttatatttctcttgcactaagttgaggcattacttgttgtccaatgaatgcactgtggtatgtaaagccgatgtgattaagtacatgctatcggctccgattttaaaagggagagttggcaagtggatattttctttaacgtagtttgatcttcggcacgaatcaccaaaggcgattaagggacaggctgtaaccgattttattgtgggtcatcgtgatgattcaatcggcttggttgacattatgccttgggtattattctttgatggatctgtatgcagtcatggttatggtatcggcttggttataattgcgccttggggggcaagttttgaatttgcctatgctatcaaacaccgtgtgactaatcatcaggctgagtatgaggcggtcttaaaagggttacagttgcttcaggaagttgcagccgatgctattgaaatcatgggtgattcgttgttggtgattagtcaattggcaggggagtatgaatgcaaggatgatacattgatggtttattatgaaaagtgccgaacgttgataagtgaatttaggatggtgactttgaagcacatatatcgagaacagaatatagaggctaatgatttggctcaaagagcgtcgggatataagccaatgacaaaagatatcgagatagagattgctacaattacagccgatgattggagatatgatgtgtttcagtatttacagaatccatctcaatcggcttcgcagaaattgcgttataaggccttgaaatatactttattggatgatgacctctattatcggatgattgatggagtgttgcttaaatgtttgagtgccgatcaggcaaaagttgcaatcggcgaagttcatgaagggatatgtggtacacatcagtcggctcataaaatgaagtggttgctccgacgtgctggatatttttgccgacaatactggaggattgtttaagatattataaaggttgtcaagattgtcagaagtttggagcgatccaaagggcgccagcatcggctatgaatcctattattaaaccgtggccttttagaggttggggaattgatatgatcggtatgattaatccaccctcgagtaaaggacataagtttatattggtggcaaccgattattttaccaagtgggtagaggcgattcctttaaagaaagttgattctggggatgctatacagttcgttcaagagcatataatctatcaatttggtatccctcaaactattacgactgatcaaggttcaatttttgtatctgatgagtttgttcaatttgccgatagcatgggaattaaattgttgaattcttcaccgtattatgcacaagctaatggacaggccgaggcatctaataagagtttgatcaagttgattaagaggaagatttctgattatcctcggcaatggcatactcggctggctgaagcattgtggtcttatcggatggcttgtcatggatcgatacaggttcctccttataaacttgtttatggtcatgaggctgttctgccatgggaagttcgaatcggctcgaggagaacagagttgcaaaatactttaacagccgatgagtattataaccttatggccgatgaaagggaagatctggttcaatcacggctatgagctcttgcaaaggttactagggataaggagcgtgttgtccggcattataataagagagtagtacccaaggacttttcggagggtgaacttgtatggaagttgattctgccgattgggactcgggatagcaaatttggcaagtggtcgccaaattgggaaggaccgttccaaatttataaggtggtatctaagggagcatacatgttgcaaggactcgatggagaagtttatggccgagctctaaatagcaaatacttgaagaaatattatcccagtgtttgggttaatgcatgatcgactagtgttgccgatacatgatagccgatgtgtttgcatcgcctggagatggccgatattgttatatcgcccttagttgcttttcactattgtaatcggttgtggtttgccgatctacaaatggccgatattgttatatcgcccttagtcgtttctataattttgtcaatgttttcaacattgtaaaattaggggggcacatacatagagaattgcaaagaaaaatgagagaattgaaatttttgaacaagccggcacaaggatggcagcaaagtaattagggtgtcttagccgattacaacagttttctacaaactattacatggaaatcactgagacaagtatcgctggatagccgatatagccctttgcctaatttgatctatttcttcgatagcttgggcgtcttgagcatcggttccaggaatgactttcaaggatttagtcatctcagcaatgttcttgatagctgattttagccttgccttctgttcttcgacagcttgcatgagatcggttaacttcttgtgctctagatccagtttagcattgcattcttgaagttgtgccaagagttcaatcttgtgagcttcaagccgatcaacattagatttgatcgggccttcagataactgatcaagcttggctttctcttcatgaacacgctgccgattggtttggattgtagcctcgatgtccttgcgctcccggcgatcggataacctctgcctggctttctccagtttgaattgatgctgctcgaggtagacagctggagtaagagcatcggctaattcgtccgaaagaaaggcttggatatctgcaaatcttgcccggattgagccacagttggtcaccaggttatctagtgatgctcctaaccgatgggagatgtcttcgagtgttttcttcatatcatcagacaggagagctatcgctttactggtggtgtcttcttctgtttcatcgaggtaatctttgatgtcaaaggagaacagatcggctaagacctgcaagagacaatatcatggatgattaaggatcaagatatgattggccgatctcaaatttatgttaataaaccttactggaatagtaggtgcagctaattgttcctcctcttcaacatgatgactgcctgcagtcgatggagtgtggccgcctgattctgcctgcacaagaggggaagaaggaggaggagactgctaaagggataaatattagatataatcagcccaaatcagttaatgagatgataaaagtatcttactgtaggagctggtttaagggttgaagtagctgatctattcctcacagcaattttctttctctatatttattaaaattgtgaggaatcggctataaagtaaatgactgcaaaagtggacagataaagtcgcttacctttgccaattgagctgaagcagaaggggatggaggagattgcttaggtgaagccaatggtgttctttcagtatcgcttatttcggctgcagcttggtcgatgtcttcctcgatttcttcttcatccagagcttgttcaatggatggatctagggcgggtagatcgtcagctggcttagctttctttgtcttagccttattcttcggagccggggctgaagtatctgcagccgatgatctggttctccgcttcttgccggcatcggctggttctctgatgagtcctcggggaagtgctgaggtctttggggcattgtagccaatggcagaaggggatggcccacctccatttggaattagacccggagcatacttaatgaccttgccgctattgctctggtgaggaggagaagattctgttgtctgcaaaacagaagaaaagttagtcaaggttcaaatcggttgattgactattcaagcaagattgaagaaataaagattaacatgagggatagcatcagggaataagtctgtcatgtacatggaagccgattgatggaacagatgcagcttccactcgccccaccatctgtcaaatgtcctgctcctgaaccttgccagctttatgttctcgatgctgcccaacggaggtccagggatgttcaatagctgatccatcattaaagttgaggagatgtcgcctctgcattggatcttgttggcaaagtacagaccgattggcaattgtcccattccaagttgtctggccgatgacatcggatgataaaactcgtaagagacttggatatttctcccttgatggatgccgactgggaggatacatgggctgatagcagtagtaaagatttctctggattgctgaaacttctcatgattaatatcctcgaacctgaaatcggctggcagttcgaaatccattgagtcggcatagaagaaccaaactcgggcatctttttggaatccatcataaaagctgaagaaccagtccttcagaagttcagccgataactttgctcctgcatcggctggtgtagatgcatattctccgtatgacatacatctgcgatgggtgtgttcttctccatcatcttccacaatcggctccaaacttggaaattcagcttctgtcacagatggccgattgacaactttcatgactaccaggttcagctaggattgcaagagccaccatggtccacctgttccaaccactgagccgataattatcttggccgatgcgttgtttaatatctggtatagatagccgagaaggattttgcctaagggaaattgtttcttcgttactagggcctcggctaagaattgccagttggttgtaggaccgcagcttgatccgcagaaaaggaatttttccaaccacatcagcaaaaaagctacgtgctctctaggagtgactggccctttgcccatatatgctgtgatatatcctgaccaacccccaatgctcttagttttgaactcaaaagtgttcttggtgttcaggttcatagggttagctgatgaggttacatctaggccagtgagcatgataatatccagcagcgttggggtcatcggcccttggttgaaaagaaaagcattgagagtgttggaccagaaataagttgcagcagccattaggggttcatctttggccgaatttgctattgtgagggctagggcttggctgattccgatctcatcccaatgggcttgtttgctagccgatatccgcttataccatacaggccagcttttctccaaagaaggccaggatttgaaggtgtttttccaatggcttgtgtttggattggccgacctaaaaggggttctgttggtttcggctatgataaactcagtggggtctagattgccgattggaccgagaaagtattgttggtcatgaaacagactgggaaccgcaacaagattggaaagatgctacaagaatagagaagaagaaaacaagataaggtgagcgaaaaccggtctgatgaacggaaaagggggtctagccgatggggacttacctcagcgtattcggctgatgatgcggcggtcggattggtggaggtcgacatcgtcacgggtgaagatctggccgggagtggaatcgcctagaaatcgccatgcgtgttgaggaggtcgccggagagagaaaggacgggatctgtttaagcggtgaaaacggaaatcacgacgtgaagattctttggggcaacggttagtatttaaagtagagcgataacggacaggaaaacagcaagtgcgagtttctctcagagtcggtatatggcaaatccgaaacattatccaatattccggacttggggggcatgtgttaacgaccaaatttggtaaattctatcactattggcatcggaggtgaagatcagattgaagtgggatccaaaatgaagatcgttgcggaaacagagtaagagtcggctgcagtccaaatcggctaaggtcaagtcggaagagttcgagtcggacggggctagccgatacagccgattctgataatatgactcggtgtacgtcatcgggttcaagttgatgtgcttcaagatggttgccatgcatggatagagtcctgggaaggcaattgtatctattaattaggatattctatgtaatttccttagatatatgtttgggcaaaagtctgccgtaaagacttatgttatcttagagtttgttagagataatagtcatgtctgttgtggacgtatcttgtaattctcgggtataaatagacccgagccctatgtaaaaaagggacgacatccaatacaatctcggcgtatcgccaccctttttgctttacttttatttcgacgagttcgtactctcgggttgagctgcatcggtttcgatcttcaacaagaggtaaaacttgtcatgacgacttatgttctcaggattagtgcttccatctttatgatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattgtttttcttttcatacttaatgctgcatcaattgagtttgatctattaagtcatgcttagaattgcaatctctagcctgctttctggtcgccgattagggtagtatcggagtttcagccgatcttatctgatttaactacttttattccatatgcttaatctatatgttaaatctgccctttatgttaagatcttgtcacatctaagtacattaggcttctgtttggtatattctacttgctttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgattcaagtatatatcgatataaggattatatatcattaatatctacagccgatcgagtagatttagttctgatttgcttattgatatttgccgatcgatgtacgcatgacatcggcttgaaataaatgatatgtcatcggcacctagccgatcggctatcatttataggattaattgcggtttctttgttctatttcttgttgattgcaggatcaaatcaactagcacgctcatacatccgaacgcgagttttggacctgcactggagttaagcagatctcccaggcctcgtgttttctgtcaacacgcttttggcacgcccggtgggacgaattagaagtcagaaatcaatcttcctcatggccgagaagctgccaccttcgccatcctcggctagcccgggtactgttaaagagaaaatccaaagaccaggattgagcgaagtcaatgaagggaatattgtggctattgatccggaaaagctcacacctgaccagaagaaggacttcgaagcaatgatgcaacaagcacgagaacagttcttcaaatcattcacacagactcgcaagggaaaatttgtttaaaagtacaaggtaaaggtggttcccgatgagcctgagaccagtacctttaaggagggagaagggaaaagagttttagatggctcggctcaagagaatcagggtgacgactctcagggggcacatgcagttcaaggtgatggtgctcacgagccacaacgaggaaatcttaatcagaatggtgagacagcacaagatttcttcaacaatttccaagatcgagtggactacgccgtacacaatgctttgatcaatcaatctggagtgttagtcaacaccttgtctaacatgatgaagacgatagccgatggatcaatagttgagcatcaagctgcaggcccggtttacttgccgggaggtgtttttccgaattatcgatctttgatcactgatgttcagccgcttgctcaggcagttcttccgagtgcaccatcggctcagccgatggcaccgccattgacttctttgcctgctccatcagcgtcgacaccaggccagccgattaatcctcggctattgatgagggagcagccacagcatagcggacagacggtaaatcggccagcacaggatcaggtggctgctatgtttctacccctccaatctactgtcaattcgattcagcagacgccaccaaggcaacaggttgtgcagccgattcaacagactccaccaaggcagcaggttgtgtagccagttcagccaacacttccgggacaacaaactatacagccgattccgcagcaagctttgatgaatcaatcggctgagcaatcagctggacacgccctgaatcaggttgttccagaacatttggttcaccatatacaaccagatggtacgacgatgcctcagattgtgccagagcacttggtgcaaagtattcagccaaattaacagaatttattcagccaaattaacagaattaccaatgaggcaatataatcagtttgaaccaatacagcaacagtcgcaaggagcaggtcaacaacgaccatgggctgatgtaattgccgatgtgatgagagaacaatttgggcttaagccgaaagatactggaaaattgtatcggcaaccttaccctaaatggtttgagaaagttcctcttcccaaccgatttaaaatcccagacttctccaaattttcgggacaagatggtgtgtcaacttatgaacacattagccgatttttagctcagtgcggcgaagcatcggctgtggacgctctcagagttagattattccggttgtccttgtctgggtcggcttttacatggttttcttctttgccgtatgggttagtcaatagttgggccgacttggagaagcagtttcatagctatttctatagtggagttcatgagatgaagttatctgacttgacagcaatcaaacaaaggcatgatgaacctgtgcatgagtatattcagagattcagggagatgaggaacaagtgctttagcttaagtttgactgatgcccagttagccgatttggcttttcaaggcatgattcctccgattagggagaaattctgatctgaagattttgatagcctgtcgcatctcgtacagaagataacattgcatgaacagaggtttgcagaggccaggagaagctctaagagggttaatcatgtctgcccttacatgtatggatcggatgatgacgatgatgactccgaaatagctgcagccgaatgggtaaggagtaaaaaggttataccttgtcagtgggaaaagaattctggaaaagaggagagatatgattttgatattaccaaagctgacaagatttttgatatgctactccgggagaagcaaattcaactccccgctggtcatgtaattccatcggctaaggaactaggcaaaaggaggtattgcaaatggcataattctggatctcattctactaatgattgcaaggtctttagacagcagattcaagtagccattgaaggagggaagattaagtttgatgattccaaaaagccgatgaaggtcgatggtaatcctttccttgttaacatggtgcataccgttggtcggacagccgatgtgggacgagcgagaggtttttgcgtgaattcggctagaattataaataagtatcagaggaaatacgacaaacaacaagagaggcattatgaagaagataatgatggtttcgatccttattggaattgtgagttctttcggttctactggaacgaaggtatgaggctaccatctattgaagactgtcctgagtgcagtgatattacagagagttcaagccgatcgtacaatagaggcaatcggctgaagcaagctagagttcccgttcatcaaaggttgggcccggcaaatcaaaatgattacttggaggaagacgagaacgcgaagactcagtggtgtccttctgatatttttacaaagaatcagaaaagaagggttcaaaggttgaggaatagggagcgctttcaggaggtcgagcaagaaattggtcatcggctgaggaaagcaaagccaaggaaggagtggcgtgttaagaatcaagttcttggagccgatgatattgcagccgatgaagcaaagaggttggcaaaagggaaaagtattgtaacggcgccaattaacatggtctttactttgccagccgaattcgggattgaccaagccgatgttgacgaactggaagaggaattggctaagttggttctatcaccagaacgagcagtttttgaaaagcctgaagggacagaaaatcggcatcttaaaccattgtatataaatggctatgtcaatgggaagccgatgtctaagatgatggtcgatggtggggctgcggtaaatttgatgccttatactacgttcagaaagttaggtagaactactgaggatctcatcaagacaaacatggtgcttaaagactttggtggcaaccaatcggaaacaaagggtgttctgaatgtagaattgacagtcggcagtaaaactatccctaccacattttt

SEQ ID NO: 75106 - DNA, 11594 bp, Oryza sativa
  unsure (1)..(11594): unsure at all n locations
gctcgcccaaccgcaataaatgtggttaggtgagccccgctatgctcacctaccccatatacgcggcgcaaaacccacaaggggtcggggcgcctcggccctcggggccgagacgggagcggtccaacccctcggggagataaagagaagggcggtcgtatcaccctcgggcccgacccccccccccgagggggttaggccacgtgggtgatcgtgtctgcctcaagtctctaagtcatgatactcccggtcccatgtcaccgacaaacaggcggataaaacctttttgaccggggtgatgggtggttctgtgtgaacctggttaggtggtaatgtatctgtgtgatcgttgccgggtacggtctctgtgtgagcctactgttgagctgtgtgctattgtagtttggcaagttgtcttggtcaattaaggacttcacttcataagtcatggatctgagcctaacgtgcaaccacatgttctcatgggaagaacctggcccagtaggattccgagtcttggcactgtcggcccaggtggctagatgataggagtttaggttcgccatggggactttcttgtctgtgtgagggaaaggtgtctcatgggggaaggcagtgttgggacgaagtttctaaaaagccttgttacagactccttggccacacacaacctgaagtgtgacacttgcgcatggccgttaaaaggacgatgtatcttgtgggtcaagctgcacaacctttgcagagtgttaattaatctattcgaatagtcgcgtccgcggtcatggacatgctcggtgatatctcatgaggggtagttgtgaaaactgggaatgaactgtgtgcaggttaatgaatatagctatgtggtcctgtgtggacgaatcctgtgtgaatggatagttggtaatactgttatttacaactattgttttaaacctgtttataaattgtttataactgcaaattgttgtgttatgcaaaatagccattttctttgttgtcagcttgcatatgcatatttctgtgtgcttgctgagtattccatgtactcaccttgcaatttcccccaattccagaagaaaggttcccgctgtttcctgaggagtttgttgctgaagacgaggaataggtcgtgagtcctagttgactgcctgtggcaagttgaatggagctactacgcatttatcttatttccgctgctactttaatattttccttaggcccttcgtggcagaataaatgtaaactttagccataaggtttatcacagtcattattaatattaaatattaggtttcctttgtgatattggctgtgatattatctttgtgtctgtgtgtgctagcttgatcctggactagcacttatacacaggaggtcctattttgggtcctcacacgccgtcagccgctccacccgcgatgcccagcagaacggcgccgaccctcctcgctcggtcgccgagcgccggctccctcctcgcaccggccaccgacgtcctggatggtcacatacgggttggagccctgcctcctttcccggtcgccgagtgcgccttcctcctcgcctggccgccaccgccgacgtcctcgatggtcacatccgggtcggagccctccctcctcgcccggtcgatgagcgccgcctccctcctcgcccggtcgacgagtgccgcctccctcctcgtccggcgacgagcgctgcctccctccttgcccggccgccgcgcgccgncttcctgctcgcccggccgcctcgagcggcccctcctctcgcccggccgccgcgcgccgcctccctcctctcctggccaccgcaagctacccgtcctcgcctggccgtcgcgtgcctctctgcccaccgccccccgctgcgccgccgctcaccgttctgtaagggagagagaggggggatagagagtagaggaaaaaaaattgaaaatatacctctttttcattggttttgtacaaatacgctcatttagaaaatatttacagaaatataccattgtcgtgaaatgaaagcgcgaaatcgtgcgttactgcacgatgtcgcgcgaggtgtgcgcgaaaccgctcggtctcgcaccgcgacttcgcttacctaacccgcgtactctcgctatcaataaattaattagtgtaattagcaattaattaattacaattactcctttaactaacatcattagtaattaattaatcgttaatcacccgttaatcgtccactgatcatgagtcatatcaggccatctcgcaaggtgatgaagcgagaccgccggtctcgcgacctgctgttgcgataccgtggcggatgcggcggaatcgcgccatgattctgcgagaccgtgacgaagtgtcccgttgtcgtcattttcgcttaacggcttagcgatatattagcgatatatcgtttcgatttcgctctttcaatcagcgacgacgatatatttgtgctaaaaattttacatctcgaatatttataaaataaataaataaataatatactttcaaatttaattcgagagtagagggggctgacatgtgggaccacatatgccccaccttttcttattatttttgtgtagctgacttgtgggtcccacattttttattatttcctgagatccaattgccacgtaagcgccacgtcaatgccacgtgggacgaggaccaagacaaagggagccacgtaggcgccacgtcatccaaaaccgggcacaatactgctgagagacctcttttgcacggttttgtaagttgagggacccgtcatacctggttttgcgaccgagggatgaaaatcggactggacgacaaatagagggaccaaatgtgaacttattccattttaaaaaacgagccaagcgtgctagtcacaactttttatttccagcctagtcaccatctaagctaccgggccggagcccatggcacaaaactaggcacgtgtttaagcctagcccagaaagcatagcacattagcacacgagcatagtcatactagtactagcaggtacgagacgcggaagaaaattacacaagactgagggtccctacagtcctccgaaagacctcgtccctctacatatgacacctgtccactacgaatctcaaagtaggcagcctctgtcttcttcctatctccccaatctcctgtgttctgccgttcttcctcaacacgaccaagtagagcttacgcacgaccaacgcacgcggtggcggccgccggtgtcgagcggcaacactcacccagccaattgacaattcgatggtgactaatggtgaacacttagattttgctcgttgctttcaatctccattactgctaagtgctaattattaatggtgattgaatttatccgagcatttgatgattcttttggacagtgaaccttggaaaatcacatcgttgtctgctttctcatcaagaggcttggtgtacatcaactcccgaatacatattgtggagcggaccaacggagttcacacgctacagcaaacatgatgcaagccgactggcagcggcagttgagcacgatgtcatcgtcgcactctcccgacagtcatccatgagcccgaagccactcgccgtcgcgcccgctttggtcgggttcgagggatgcctcaccgagcggaggaagaagaatggggattagaggggagagaggttgtctctttgagattcgtaatggacacttgtcacgtaaggggacgaagtcctttagatgagtgtaggacttcagtcctatgtaattttcttccacgagacgctccaactgtccaagcagaagtcgtcttctcgcgagaaaaacactgaaaaactgatgacgcgagtacactcgtcgagcggttagcgacggagccctgcagcgtcgacacgcgttccaccacgcaccccacggacgtgtcggccgccagaagctccggctcgcctgtatttagcacgtacgacgacgagcgatcccactcctaacacagtacagcgacgacgacagattaaccgagagcgatcgatcaaccaaatcagaatcagggcaagaaacaatggcgcagctggtggacaaggcgaaggggttcgtggcggacaaggtggcgcgggtggagaagccggaggcggagctggccgagctgtcgttccagagcgtgggccgcggcggcgccaccctcgcggggcgcgtggacgtgcgcaacccctactcccactccatcccgatctgcgaggtgagctactcgctgaagagcgccgggagggaggtggcgtcggggacgatgcccgacccggggtcgctcaccgccggcgacaccacgcggctggacatcccggtgaaggtgccgtacgacttcctggtgagcctcgccagggacgccggcagggactgggacatcgactacgagatgagggtcggcctcaccgtcgacctccccatcctcggcaacttcaccctgccgctcaccaagtccggcgagctcaagctccccaccctctccgacgtcttctaaatcggcatcgtgcacacgtacgggccgagtgtacgagaacttgtgtatttccagacttctggagtaataataaagaacacgagtggttggttaatcgcgaatcgtatgcgcggtgtctgtaacgtacgtttatgtgtggacgttatgctacggcgccatatgtccatatgcgtgccgacgcgcgggccgggggccataggcggctaaatcaagtaattagtcaaccgcggcgatttggtgagatcgctccttaaaggctcgcgccatattgcccacatgcgttccaccaggccacgaggctcacgagcaaacgacgcgcccggcaacggcacgatcgcccatgagcgcgctcgccctgccgtgctgcggtgtacccatgccgctcatgcgattgggatttgagagaggttcggagttatttagaggagctcaatattatgagaaaagctgttatttgagaagctgttagcctctagttttaagaggatctggaaaagccggattgtacttccttcttcacagattgatcattatatgatagaatttaaattttttcacagattaatcattatatgatagaatttaaatttttttaaattgatcatcatgtaaccatattgaaaacggattttatcgaaatataattaatggacacgaattttattgtaatacaattaatacatcataggagaatatatatatatgtgctaggatgtataattggcatggtgttttatcgatttttttaggatgtataattggcatggtgttttatcgatttttttaggagaatgtgtgtatggtgtcttagttaatgcgatttaaattattattggtcttagtgaataaatatatatgatgatcgttttggacggagtaagtattaactaaactttttcagcttttgtcttttaattctacattttataactgtcgcttctcaactgacaggagctcctctaaatatgccatatgttttcgaaattccaaatattttttctgcaaacaaagtagaaaaataaacgcttacaacacacacgctcgcgcacttatgtttataaatgcacatcatatcgctatgtgcactttcgaaagattagacaatcctattttaagattaacgaacatagacaaagttatcacaatcgactgttaaaaaaataactaatcgtaaataggaacactcatattattaaataggggctcatgttaaatccgaccaatcactgagcaagttctatcataagaaatctaaccatttaagcacttgagttacgctcgattataatatataaaaagtaaaacttttactctaaaataaaataaattcaccttttgtaaaaataaacttaatgtgagattagagtagttgatatttaagtttgaagtattttagaaattacggatggtcagaagtttaattatttaattaatctcaaactcgtactaagcgttacaagtacggaaccggagggtagtaggatgaacatttattaattagtgtttattattgtctattgatggtaaatattgcactaaaaaaaagagaagtatgttcctaacctgagcattgaaatttcgtaatataataagaaaactaattgtaaaatttcaaatttatctggcattttactttccggtcataatggaagttcgaaaataatttgaactttctaagtatatttgcacgctttgcgtttcatgcaagggcacccaataaccttaaaatctattttttctctttcaagtacagaaaacttactttgttgcatgtttatactcatttcaaattataatcagttggaatttgaaaccaaaagtttcggttgcgttgatagtctccgtaggtactagtaatacgcgaaacggtggggctgggagcacttttatagcactgtaaaagaactcacacatctttatcgtttcattagtttttttactaatcatgtccgcagagcaaaactagagaggcagcggaaaatttaattatttgctacttttccgtttggtaattagccaaatacctttttaggtttacacttatgaatttaccattggagagagaagcttttgtaattttttttcactttttttcactgtagagtgccacggccggtacatgtgcatgccaacatggaacctacgcaaaaaaatgactaatctacccatgctagctagcaaacatgtgcatcttagtcataattcattaactggagaaataacgagagaaatcggcaacctgtccaatcttcccattttaaatttgcaaggcgacaagatcaatggcaccattccggttacatcagttcattaacttttttaatcaagctaaatctctgtagcaccatgccaacaatgccagccaaattaaataccgctcttaatcttagtcacaaccatccagtggatctatttcttcaaatattgattcgttgtccgacttggaggtacttgatctttcatacaaggaccaccaattgagcaggttgtcgctcgaatcttcaatggccacctcataaacagtgaacaacatccatacctctgccatagattttgcgaaagcaattttatcctaataccgttcctgattcagcctataccacaaccaattgctagcagggtagattggtcatttcatgtgcctgtccatgctggcatgcatgtgtggtgctacacagtgcagaaagtggtaaaatattacaaaatcttctctctccaatggtaaattcttaagtgcaaacctaaaaaagatatttaactaatcatcaaacgtaaaaatgttaaatagttaaattaccaggcaacaactatgataagcaaaggtaaaatctaaaccgataacactttcggtttagtcttaattaaagagcgacggacacatacgtaagagaactactaatacacgtctatcatgtctagttgctaccagtacacccaacaatgcatgcctttctttcttcttatagaattctcttttaaattacttatccgatctataattcgattacactattatattcattgcaattaaatctttataacaaaatcttacaagactatattatgatgaaaaatatttatgttgtaaattactattattatatatattagttatttttatcatatatatatatatatatatatatatatatatatatatatatatatatatatatatatatatattatattttattaaactactttttagatattcagtgcatgatcagtgtactttataggttagttttataatatgttgattaaatttaatttctagatagacttatgtttttatcccccataatagatttacttttgatgtcgtgacaagttacttttataatatatgtaaattttttataatatatgtaaattatttttaggttttattgaatttaattttatatgaccaagaagtaatttaataaaatctaaaagttatttagatatattataaaagtaatttgtaacttttcataaaaaatataataatgtaagatcttgttataaaaatttaattgttacgaacacaatgatgtaatcggatcgtaaatcagatgagtaatttaagagaaaactttataagatgaaaaataaacatacactgttaagtgtactagtagtaacctgatcgctggttatgacaatctaacatacaacaccatcttaatcatgtccataaataaaagaacaagactatatagctagtggccatctatgagagcaaaaataaccccagtaccccacacgaaacccacgtgccttcagtatctctccgccacccgacagagtccactctccactgtccatagctgccttcgcctgagttcgactaggatacatttgcaccatatagtatcattcaccaactcgaatcaacacacactagacacgcatctaatttgcacttaagtaatccgatcggtatctgcatgcgcctgatctccacgttgcgctgcatgaaacgcgtgacgtgaacaggccagctacccgggatctctcatgacgatcgacaggtcaggtcggatccgtattaatcttcgctccaaatatttaccagttgtaggggtaggtttcccactgcatgtcaaatatatatgtcattgctgacacgatctaattaatttgtccatgtcacgctaaactaaacaagcgtctgcgatttttacggcgaaatttggagtaattaagtaaaaacattttggcttgttgctataatgcatcgagctcaatctcaaagtttcagagtcctgtcagttatcaccacgaggggttagttagctgtccatgtttgcacgcgtcccgactgatcattaaaaaaatatttcttgttaaagatggaaagggaagcaagtatagtaatgacctggaatctgattgccttgcttgatttggagatgtcgagtcagcatggtctcatggattattcccggacaagtgaagatcagatctgatgtgaactcttcttttcgaacaaaacgatgggaactggcctgctaccactatttttttcctggaatgggacgatatgagtctcagctggcgctccattatttgctagaacagtgatcgatgcgatcacagcttgggctacgggctccaaccatgtcaccaaccaaatactgcctccgtcccatcccaaaataagtagagccgtaggtgcagaacgttcaaacgttaaacacaaacaatacaaatctacacttatttattttagaatagagaaagtagtactcaacaataagagaaaaacgatctttttttaaaaaaaagctaaattgattatttgtctgatgattgtttggacacctagaaattatccatatgaaatctaattgcgtcgttgatgccactacattttattcgtaagataacctagttatgcttctaaactagctcacaaccaatgaacaaagcctataatattacaagctttaacttttaagggtgatggatcgagcgcgtgaagtacgagtaactgtccacctttgcatggaaggtggcaccactgagcatcccaacctcatcgataaccagtaaggggaagttttatagtggatgtgaaatttagttcacatcatcaactcattaattataagagacaatatatataaaacaaattacctctaacacatttgccccaatacatcatattaatttactttatttgtttcctatcaattcattggtctcttgttctcatctctcttggagtttgtgtagagattgccccttgcatgagaggtggcaccttctctcacacctttcatatatctcttccacgtcatcacgtgagcttacatggaacctgaggacaagtgtgtagaggcttataatacttgccctaagaacgtcactgctcttttcaagcggcgaatcttctctttcattggtcaattcgctaagccaaagcctcattaccaccgctttgtgagataaccttttaccctcgcttccttttcttctctcctgacctataatattagttagtcttcgttgcctcgccatgtccccttttgcccaacttttcttcacacttgaccggagatggacttttttttccctcgaggggacatccactcgttttgtacataacgtttaaaatatcatcaaaaaaatttgtcaataattgttaatatagatcattatatgatatatctttgcacaaacatgcaagttaaattttgacctataaaatttgaaacaaaaataacaaatttgaccatgaattacgtatttcatagtcaaatttgatatttttgtttctacttgtataagttgaatttgaacatgtatgtttatggagtgatatatcacatactgatctatcttacttttttttcaaattttttgatgactttttaagagatatgtaaaaatgagaggatatcctcttaagggatgattagagtttccccacttgacctatgcccacaacttctttttcttctcccttgaccttaccccttttgcctttcccttaacctctggacaactagatccaatcatcataaatttctctttgttggaaaacaacatagagtagagctaacggtgaggacaattctcatcatgtcaagtcgaagaggatttgaaaggggaacatgatgatggcatacctaagaaatccttaggggcaaaagatctaataatttgccaaatacaagcatcttgttaaaagcaaaataactatgcagcatttggtaggaaaatctaggagtgactatttttccataagataaaacctaggtaagcacataagtgacccttactcttagggattgtattttcataccaatcttgatgattccacttaatttttgaaattatatgggatgaaggcacatccatatttctcttttgttgatgccgacccgatttaaatgatcaaacacatccagctatcatcattttcaaatcataatggtatctagggccataagcgaaaatggtatattttcactggccattgatcgttggcggtagcattggctgtttaagaaaacttaaaatgtatgtcagaaaaagtccattttgtagtagtgtcttccattttccttccccctcagctgcacaccatgcacgatggctcaatgcctccactagggttaaaagtcgatttaacttttcagaaacttttagtcgattggtaaatactcactctgtttcatattataactcgtttgacttttttctagccaattttttttaagttttatcaagtttatagaaaaacttaacaacatttaaaatataaaaactgtttcattaaatctaatattgaatatagtttggtaatatgtttattttatgttgaaaataatactatatttttctataaatttgatcaaacttaaagaagtttgactagaaaaaaattcaaacgacttataatataaaacggagggagcagcaaaatgaacggcctcgacatcatataaccccagcacttcccacgcctctataaaattttagttttcttgacgtggatcacgcgagctcaaattattgacacattctagaccaggagtacttttgctatatatatatatatatatatatatatatatatatatatatatatat

SEQ ID NO: 75107 - DNA, 13489 bp, Oryza sativa
  unsure (1)..(13489): unsure at all n locations
caaaccttaacataggctagcttttttgtgcacttacttgagactagttgatttaggttttgaattgtgcaaaaccattttgatttacgcttccgcatacaaaattcggttttagccaaaagttttaaaaccgcctattcaccccccccccctctagtcggcctccttgatcctacagccaccccttttagttttgccgaaatattgtttcaacaagaactacgaggaagccgagataatgtttcgacaagaactacgaggaagttaagtttccaacaggtccacatctgataataaagagactctcaaggtttgctacctcaacttcttatctcttgaaggttattgatactgaagtgctagctgatagaatgttctatatccaaacacttgctaataccattgtggcttcggttcttttggaggctatcctagctaagctcagctcatttgcaatggacatgaccctatatttttcttgcatgttcatctaccaaagtagttggcagcatggtctcttcatctcttcaaacaagtgcaaatcaggtgaacaagaaatctattttgcttcccttcaatatcccaattattttcttctatcatggataatttgtattcttccacctctagggtaccagccaaaaccagctaaataaaactagtgtatatatataatatgtattcatccttcttgaaagaaaatcacataaatatcatgcatgtactattgtgatgtgttttttccatgccactacggcgcagcagaggctatgtgtgttcagatgatgagtagagctgtcacttggaataaaactgacaaatcaattactacatttcaacaaaaaatctggaggcatattgaggtttggtaaatttctagtgacatatatataaggaattttcctatagcatactatagttctcctgttcagttatgggcctgatgcacttcacatcagggattccaattttgttttggaaaaaaaataatcagaactgaaaaaaattaatgaccatatataattgtttgaactcgatttatgaacgtaaaattgtgataaaaaaattcgaagcctaggtaccttggtttacacagataataatatctttcgagtttcacaccaaagagatgttgaaaccacaatagcttacattttcttctctctctctccatgaacttggcgtgcttaggctcgaatgagtcatttataacaatgattcatgtcatactccatccgttcacaaacataagagattctatattgtttagcaaagttaagattgaggttcaaattactttgatgtctgtcacgcccagaaatttagcccaaaatttcatactattttgtgtattaaatccttgttcaggaattagccagggtacacaaaacgacaaattaatatacaagtacaaacgtaaataaagcgtaaaatacttacagaagaggcacttagttctcacaccaaaaccgaagcagcagcaacggaaaaaggcgatcatagcgaggcttcagctccactccacaggcaaaactcaactggggtctgagccttggtcctctaacttcgtcttcagctcagaagcactacacttctgaaaagggggaataatagcaaggttgagtacaaccaccgtactcaccaagccacaccaatgatgcactcatgcaacgggagacaaagagaggtttgtggctatttgcataaaggtagttgcaaaacattttattgagcaaaatagtaaaactgttgattaattaaggtagtactaaatcttcactgatcaacgctacaccacgttgatcaggcctaaccatcccacctgaactaaaccagttcattaagccaatttattaagggtgagactaatcacggtgaatctggtcgatcgcccattaccacgggcacggttatttgaatagttttactctggccagaggtgcacaactgtacccacaagacacaatccaccggcatgtcaccgtgcccggctggacacgtcaccatgtcgagtgattgtggcaagacccttcatataactccctctgaccaatcgatgccacacctcaggtttcacccctcccccagcaggcagcaggcagtcccccctcgtgccacggtgaatccggaagcagcataggccgtcgcagggcccatccatactcgatcacacccaccctagcctgggtacgtcagccaaaggaaagctatactacaagtcaagcaattacccattcctgcttgtggtacgcgcggtaagtcttccagtgcatccagcgaaccagtccttaatttgctatgggcgcaactagaaaaaccatgcacccacaaaccaccattaagtcatgttttagttggataattacaaccaatgaaacatggctagatgtctcgagcacgcagctcgtcaagatatatactaggtgtctaatgatgtaattatcccattatgtgaactagtggtaattaagtatggataagcatataattctagctaggtcaacataagtaacacaaaatagtcgaattatcacctaagtttgacaaaggacgaacatcaagtaatatggcacaagcgaagaagtagataaaaccctgatcccatgtaattagcatgacatgcaattttatttgcaaacgataaaacatttataaattaggatcaacatgctcaaggggaatgtgtgacttgccctgcttcttcaaaagaatcctctgaactctttcctcgtaatcgcgagcttccgaaacagcggaatctacgcgctggcacgcaaaacaaggaaaaactctaataaaaaccaagtaaacagtatatgaaaagtaaacaaacatgtagagctcaagtttagatgaattttgcaagttgaatggcccaatttggagttcttatgaattagctatgaattttagaagttttgagccatttaaatgaatttctataattattactcgaaatattgcgcaattaaagctatttatggtgtcaaccgaggggattaggtggagccgacaagcaggccccacctgtcggtgactcaaggagccttggcctaccgtggaccgagtccacggaggcacgggctagtgcaccacgtggcgcactcgtggcgccgatggggcaccgacgtgctggccacctatgcggacacacgggcggctcagatggaggccggggccgatccgacggcccagatcggccgcgcgacaggggtggcggcaactggctgcccggcgaggacgcggcgcgcggcggcagcgacccgaccggacggccactagcggcagcggcgcgtcgcgagctggcccaggatgcgaccgacgaagcggagaaagagggagagggaggggagcgctcatcggggaacgacactgtagggaggcggccggcgaagctcgaggcggagggaggcggcggagctccagtgacgagcgacgctcaggaaggggtgtacgagctcggtcgcgacctggggatggggtttaaaggggttagggaagcgcggggtggccggaacagcgaggaaggatggccgaaggcgatgagggtggcggagctcaccggcgagcgagggagatggagctccggcgaggttttcgacggtgtggggcggtgcccgtggtacggcacagtgcaacgacgctggggtgaccatcgtggctcgggatggcgggtaacagtgggaaaacggcgaccggaggcggtgaatgtggcggctgcctcgggtgtgtggtgggaaggtcgttccggcggcgttttggggaaagggaggggacgccaagatgtagcttggcacggtggtggcggtgcagtgcggcggtgacccaagcggtggtggtgggcggctgaacgacactggtgagcggctgaggttggtggcgcggtggggcggcttttcgatggtggtgggggaaaacggagtggcggcctggcttgcccttgcggcggcgaagctggcgatgacggcggagtagagcggtgaagactagagtggtggtggcgcgcggccaaagctcaccggagggtggcggaaatggcggacggcgtgggcagcacgggaggggttgaagggagctcgggcaaatggggaaaaagggagagggaggtgcgggcatcctttttgtgggctcgggtcaatgggatcgtggccgattaggggcggcaacctgcgaggaagtggcatggcgacatggggaggatggtggctggatttggtgggaaggagtggggaaaatgggcgcaggacggacgcgaggtggaggagaggggtggcatctgggcccacgcgagagagaagcgcggggaggcatgaaaaaggtggcagcgtgggactgtttcggcagccatggagccggcccgaggagaaagaggaagatgacacgtggggcctcgggtcccacctgtcggggagagagaggggaaattggcaaggggaggttaaatagacttcatgggcaagcggaccgagggagagaggccggcccaagagaaaggagggaaggagggaggggaaaatgggccaaggagagagagggagagctttggaatagaaggggtcgaaagtgaaggagggggaaataatttgttttccatttaatttaaatgggtttaatgaactttatgctatttaaattatttcttgagctcggaaaattcgcaggaaaagttcagagagtattttagggcacagagaatattacaaaattatttgtagccatgatttttaaaggaaattttaattccctccttatttcacttgattaaattgctttaatttttaatataatttctagaaatgatttatttaatgatttttaatctcgaacgaaaattggggcgctacaatgtctgtgtgtgtttgaattaggaaagatcacgcctatcaatgagaataaatgtagaggttggatggattgggaaagtagtgctgtaaaatctcctatattcgtgaataaatttaaaccccaaatcccttatttttgtagagagagaaataagtatacgctgttaacgaccaaatttggtaaattctatcactattggcatcggaggtgaagatcagattgaagtgggatccaaaatgaagatcattgcggaaatagagtaagagtcggctgcagtccaaatcggctaaggtcaggtcggcagagttcgagtcggatggggctagccgatacagccgattctgataatatgactcggtgtacgtcatcgggttcaagttgatgtgcttcaagatggttgccatgcatggatagagtcctgggaaggcaattgtatctattaattaggatattctatgtaatttcccttgatatatgtttgggcaaaagtctgccgtaaagacttatgttatcttagagtttgttagagataatagtcatgtctgttgtggacgtatcttgtaattctcgggtataaatagacccgagccctatgtaaaaaagggacgacatccaatacaatctcggcgcatcgccaccctttttgctttacttttatttcgatgagttcgtactctcgggttgagctgcatcggtttcgatcttcaataagaggtaaaacttgtcatgacgacttatgttctcaggattagtgcttccatctttatgatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattatttttcttttcatacttaatgctgcatcagttgagtttgatctattaagtcatgcttagaattgcaatctctagcctgctttctggtcgccgattagggtagtatcggagtttcaaccgatcttatctgatttaactacttttattccatatgcttaatctatatgttaaatctgccctttatgttaagatcttgtcgcatctaagtacattaggcttctgtttggtatattctacttactttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgatttaagtatatatcgatataaggattatatatcattaatatctacagccgattgagtagatttagttctgatttgcttattgatatttgccgatcgatgtacgcatgacatcggcttgaaataaatgatatgtcatcggcacctagcgatcggctatcattaaaggattaatgcggtttcttgttctatttcttgtggatngcaggatcaaattanctggacgctcatacatcgaaagcgagtttggacctgcactggagttagcagatctcncaggcttcgtgtttctgtcaacataggcatactcagtanacataatcggttccaacgctgtctatgactgtccacagatgtanntggtatgtntttaagattcnagccatcgtcatcattcttcaagaatgatagctagatcacaaaagagtaggatatgatatggcacattaaccacaaattgaatactaccttgaggggatcgatcgtttgctctaatttgtatagtatatggagttaaataactggttcgaaatacaaggtaaaatggtctaatttttttttccttatgaatcatatttttagaatcgctaccttgagggaatcgatcgtttgctataatttgtatagtatatggagttaaataactggttttgaaatacaaggtaaaatggtcttaattttttccttatgaatcatatttttagaatcgtagagcatataatacgtgaaataattcagtaaataagcagaaaagaacggggctaataatcaaattaagaatcactccagcgcaatcatattttccaaacctatgccccttccattgattagtttcatcaactgaaagtttgatgcagtacttgtggggcagaacatgcagaccaatcaacatatatcaacaggtaaaattatacagttgaatattatgaggttataatttctcagccaaagcttcattctcaaatgaatatatcaaatctggttactcacactataaggaatttgattttttatgactgcaaaacatatttatgagtagacagtcatacatcattaaagagtggctaatctactgcgttcatcaaccaaattaaatcttgtatcaaattgatatgtaatttgtgttcatcaaccaaattaaatcttgtgtcaaattgatatataatttagcacatgttttacatgttattatttctcaatcgaatcattctttgtcttcctatctttaaccatcatctctagttttccttctcaaatcaacaggctcaaataaaaaatttgtgcctcattcaatatatatagtatacattcatctataacattgatttctctgtcttcctatctttaaccatcatctctagttttccttctcaaataaacaggctcaaataaaaaatttgtgcctcattcaatatatagtatacattcatctataacattgatttgtaagccacatgactattgataagaaacagatttaacagtttagtaagcaaccctcttgtttttctccaatattttatcacatttaataatgatcttttgcggtataactaacccatattatttcaatcatgcctaaaactagcactcctatatatcactggtacgacataaacacatcatgtgtgcaaagttagctgtatgatgccactatatactatcactgtcatttaattgctatggcatcatgtttatgttccttgcccacttatttgcttcataaatcacatacgcatgaacgctagctactcccgcatgaatcattagctagcttactttattgaaatgcagaacgatcatgcatgtaacatgtttcaatttttatgttttttttagcgcgccaattgatctctacccttctctgccctttttgttttttctaaaggtatcccaccctcgtactatctttggttgattggatggaccgacgagatgaatggagaactatccagttcatgctttcttgacatcctactgtttggatgcataaacgggattatatgtgtttggagacagcaagatattacctccgttatcacatagatgacattatagaatgcgtctagtcaaaccttgatatattaaattaagcatacataagtattagaatttaatacacaaaaatggtattgatagatttatcatgaaaaaaatattcacatggttatatgttcgttatttttataaatatactgttataaaaaaataatggcaaaacacatgcatttgagacggtgtcaatgtccaaaatgctcaattaaaaagaacagatgcatatatgtttcactaatattctcataactccaaagatgtgtatagttccgttccatataaataatatggttttggagcgtggttctttggcaagtaacaatatatgctggagacgcaatatatgtgaagatatattatttaattgacaaaacaaaacaatgaatgagatgcacctacacaaggttggcccaatccggtagaaatggaaacaaaaccaatagaaacaaataaaaacaagataataaaaaagagaaaataaaatatgaacaagaagataaggacatgcaatgaaatattatcgaggaagattatgatttacttacgtaccaacatctctatgaaaattagaaataacataaattttacccaaccattctgggtcatcttttacaatattatcaaccaaataaattgatcaatcgaaccgtagatttgatcaaacaatcaataagtgtagttattctatcctaacccccatccaacacattgtcctattccattcaacaacatccctccaacaaaacatagaatataatacatcaaatgaaatacaccttagtcataacaaatgagataaacatagaatataatccatcaaatgaaatacaccttagtcataacaaatgagatgtgtttttttacacatatcatagtatacgtgtatactcaattacattgtccattaaattttattcaatcagaacccaaccaatattgaggataaatagaattggacataatatgctcacaatttgtaggttatgcggacaatgaagataatatttgtttgagtatatcatcctccgatgaaattacaattatgagacataaaaagttacaacttatagtactatttaatatttaaaacctaaagcccactacttaaaacactaaaaatgatataattgggtcggtttaaataataaaaaaatcacaccaatcatttaaatactatatataattttcctccctgtacagagagatttcttcttaatgaaaaatgtagatatattatttctcccccatacagagcgattgcttcttaatgaaaatatggagtgatcgaatgtttttttataaaactgtcatatgaaccatatcagaaaattctatcataactatcccactcgcaggtttgttaaaccataacaaaattgacatgaatatctgttcaatctatcttcacatattttcttcaaaatctggtgggtaagaaacccctcttgctttcctccaatattccatcatgaattaatgtttctttttcagtggataaatatgtattctcatcaatactatctaatacgagccaaagctaataacctagccaaagcatgtattcatcactgatatttatatatggcaatgtattcatcactcgctggaagaaaatccaatagatcatgcgtgcagtgtttgcatgcaactgtatgttcttcatgtcacttaattacttgctgtacatgacacactattcatgtttctttactgttaatctcttccatgtagtttaagaaggttttgcatgcaactagtcgcacgttcgcgcgactataaccttcctatctattagctgctattacaattaacaataaattttccaccattcagctaaatcaataattaatgtatagactcagggtttatattcatcttattcgtgttgtttcctgctttacttgatttaatattcgaaaaaagtatttggtcggaagtgcatgttcaatacaaatactatgttgttttgatatgtaataaatacatattgtaatgaaaataaacaatttactataattacgctaaacttgtgatattattgtaagaatcaaaattaaatttcactactacctcggattccaaatatcctgggtctacatttaagtaaaattgcacatcataattgtaactatgttataagatttgtttgagatgttaactttttttttctatatctttgttttgattgttgctgactgatttaaagtgttatatgtagaataatttttccctcttatgaaattatttaattggttatctagtctaaggaccgtttgggttgattggccaggctaagccagccctaggcctatttgggaggccaacatgagataaccaataagaggtaatgagtggctcaaactcttccttctctctatattttactacttctagaagattcctcatttcaatggctaggattcttccttgctattttgtcattttgtgaatccaactgctattttttgacaaatcatgtggctaattctggttgctttttgagttttacttttcaattaggtagatgtctatgcattgcaatgcaatggaatttagagtagggataagtctatttaacacccttcaactttttgctttgttaaaaacacaccctcgaactataaaattggtttctaacacactcaaactatcaaaaccagacatttacatcctttagaggttttaggatggttttggtatagctggacatcactttggatgccacattttaaaaagatccacatcagcaaagggaagtgtcccattagtcagttccattccacccctcttcttcttccttcccctctaactcgctctcccctctcttcgtggagcagttaaagttgacagcgagctccatccgtggagagacccccaccctctcggcttggagctccacgctatttcgccgccgttggcagtaacactgctcaacaagctcgagttggaggtgaagatggcgcgggcgacgacaaactcttggtggtggaggccctgcggcatcgactcctccgtcgagttcatcttgggatcaaggccgtgctgccggcacccgtctctttaacctcggcaaggagggggagggggtgggggtgctgggtctagggtggtagtggcgcttggataggaagccatctacgagctccctgagcttgacgaggagagtgccgacggcggtagtggtggagcttgggtaggaggggacggcaaaggcttcatggaggagagaattgaagaaccacaccttggtctcgtactctcgtcgacatcggggaggagagatacctccaaatttcaactagccgtagccagatcaagatacagttgggtcgatccgcatccatcaaccctcaccagagcttgccaataaccccgtcttctatgtgcttggcgaaccctcttcttcgagcttgctaacagccccttcaccaatcacggccaagggagcaggctccgcgtcaagcttgtcaccaacctccctcttcccttgagcatggccaagggggtgggcaccgcatcaatctcactgtcaacctcgtcatggccaccgccaacctccctcttctctcgagcatggcgagatctctatggccgactcaagctcggtgagggagggagtcaaaagagtgagccatggcggcctcaagctcggtgaggggtgagcgagtcgaaagagagagggaggaggaagaaaccactctaactagtagggccagctgatatggcaataccaaaaatgccacataaaatcacaactttcacggagaaaggagaacaactgtattttaaagtagtagagaagtgcatatctcaaagaccaaatatgccacataataatacagctttcgcaatacacatttgctttattaaccactaatgcatgaaagccaacttgagcatgaatcgtttagcttagtttgctggagcctggagacgcaaaatatgatcatgcaaacgttcagaattttatatactgtttgaaggtatgcagttcgtctccacccttgccttctccccttgataatcaaaattccccatttcccctatgaagcacatcttgaccttctccccttgaatcatcaaaatgagatgcagtttccgggctacttttcagagtttacttaattatatgctcaattacattgtgttcatatgtgatgaattagtcgttctgtagagacaaatgggaaggcggggtgagctgcaaaagagcggatgagaaacgctttgcatttttctttcatattccatttgtcatccacactgtctatgtaccctcaaagagaatatatatgcactgtattagctacctacaagctatatcatccacaagtgtcaacctcattcttgaagcaccaaaacaacgcttcagtagatcttaacaaagtacaaactcattatctacctggaggctggagggaatctcccttgtgccactgggaatatgcccttgaattttgtttctcccatttatggtactatttccaaatcttatgccaaaacatgctgtggacattggccatgctgtactgaggaacgcaatgatgatttatgcccccatcctgtattagacaaacttaacgacatactctgttcttcactcatgatggtggtagctcatctgaaatcattagagacaagaagtcaagaacataaaaagaacaatttatgctatgggccaaacggagacatgagacacaagtactgtgtatttagaaaaagggtaattaccatattataaaaagggtaatttcctcgaaaatacgataaccaaggaaacggttggtaaaacaacaaaatcatttccatttctgtttctatttttagagtaaagtccatcaccggtccctaaacttgtaccgctgtgtcatcccggtccttaaactcgcaaatcgaccgttcaggtcctcaaacttattcgactatgtcatcctggtccctaaacttgcagatcactcgtttaggtcctccaacttgctcagttatgtcacctcggtccctaaacaggacggtctaaaaactttatatcaaaaaataattcataactttttcatgtgaactctaatgaagacaaactttatatcaaaattgtagccctcgacgtgacctacaactttttagttgaaaagtttttgaattaaaaccatttagggtctcaaaatattgttgcatgtttatagattttgaaattttaatttcacaattacattttgggacaaa

SEQ ID NO: 75108 - DNA, 47884 bp, Oryza sativa
cattatgctgaggacaaacatattaaatgattatatgtttgggagaaatatattgtattgtgtcagtgtggcaaggccgttagttccatatctaaccaaatatggacttcacttttatagaaatgaacagatcgatagttttttccccctgaacatgtaggagaactgcatccctttgcattaaaaagaaagatatccactaaaactaaaaaccataccacaccaaaaacagagtaatgaagcatgtatatccattgcactgcagaagttggatatctttctttgggtcttagaaagatatccactaaaattactggaatgacaactatgttcttagaaagatatccactaaaactataaactaccacaccaaaaacagagtaatgaagcatgttctgaaatgacaactatgttctgaaggccaactataccttcatcatgttctctgtcttcccacattttccaagaaaatttaaaacatggtttagtgttccaacagaaatggatgagagcgaagaatccaaatattcaatcatctcacttgctgttttccagtcacgtatcctgttatgaggaagcagaacaaaatagaatattgagttattcaatgcatcaaaagcttgtaaacaacataacaccagatgtgtgcggtaaaaaggaatttgtttctgctcaacacttgaaaccaccaatatatcacaagtccaatacaagttacatgatgaaagcatggcagcatgccatgatagcctgattatctaaacctacaaacagtgataatgaaaggagcagaggctcactggcaagttgctgtagcccatcaaggaaaatgaaattatcaatgagctacaatccgaattgtgtaagcgaacaaatgtagattgccaatacagtaaccccaacattcaattgattcaagttgtcaattactggaatcgaattaacactacacagaacattccaccctgctatcttaataaacttgaaacttcatactgtttttacctattaaaaacttatcttttatatcgcatggttgcttaagaagaacaagcagatgtttgtaagtgactcaaatggtcacctgattaaaataatcctaaagcaaagctgcacatgacaggtaagatgactgagtcatgtacacctaaaagccataaacacgatgataccaaagcaagtgtgaatgcatatttatagtgttactagatcagcagatgttgcacactgctcagataataataatagacctaagttaccaatttagaattgcctgttcgacttaagacatcagtaaacgtacatggtgcatgaagctattatctcaaaataagatttttggttcaacgggatggattttttcttcatgaattccatcaattgaaggactctttcaggttcgccacccttattgaatgcttccatgagagatgagcatataatggcatctggtggaataccatttacttccatctctttgaacaggtccaagctctcttccaaccaccttatggtccataagaactaaaagatcagtttaattcttgagaagctaaatcaattaatcataataacaaaagaatattaccaccagcattataggcttggatcaatgtagtatatgtcaaaacatcaggaaaacagcctgattttttcatagaactgaaagtagattctgcttcagatagtttgccctgaatacaaatcattgttaggatagcaaactttttagagtaaacaacagagaaaataagagcaacacttgcctgtttgatatacgaataaatcaatgaagagtaacctccttggttgaagaaaccttggagtccaccatgtcctcaaaaaatctcaaagattccgtatactttcctaatttactagatccactgatgagtatattgtaggttacagcatctggtttcacattgctctccctcattgatgtatacaactccaaagctttctcataatctccaaaacttaaataacttttaatgccggagttgtaagcaactgtatttagatcaatacctcgggacctagctgcttcaagaattgtctcaattcttgttatctgcctgcagcgaccgcaggcagccaacagagtacttatggaaacaacatctggctgaatgccatctttctccatttcatgcagcaagccaacagcttccttcaacattcccgcagacccataggcatcaataagtgcattgtaactgactttatttggtttgcatgagttcttcttcatcttgttaaagacctccctagccttctcaggctgtgcagatctaccatatgcattcagtaaggaggtatacgaaactatatcaggtcgtaacccatttttctttattaaattaaaaattgccaaggcctctctatgcatacctcgtgaggcatatgcacccaaaagcgaattatatgctacaatattaggcttcactccttcagcaaccatcaaatcaaagattgctttgcaattttcaacttgcccataaatacaataagaatgcatgatgctagtatatgtaacaacatctggaggacatttggttcttctctccctcattgagttaaacaattcaatagcttccccacactgtccaatctttacaaggcaatggatgataatatttaacgtgaaagtatcagaggtgacatttgctcctttcattatttcaaaataagatattgcttttgagtactgagctccattcttgagagcagacaagacaatgttgtgtgtaaccaaatctggtcccacaccattttctgtcattttcttacacagttctaaagcttttttccagttgccagcagccccacatgcatttatcacattattatacgtagtccgggtaggaggtatctgcagcaaaagtccggaacacaaccttctttaataaacaattatggcaactaaactaaaaaaatgaaatatataaactttgctggttttctaatagtctctttgcatttcaataacgtaaggactgatgaggcaatcaacagtgatgtgtccttgcacaaagtgagtgcatggagccaaaaactttatatggttccaagattctcttcaaattcaacccatattttagagagaaaaacttcaacccttaatcaagcaattttaccttactcaacaaactcccttaaaacaggattgcatttctcgctctgaacctctggtagttgcaaaacatgtttttcctgttattttttaactcttcattattttctttggtgcactaaatctaccatagccattactatgtatagtagaaaacagaaggaccctattgggtttatagatgaaaaattagctcaatatcaagaatggttatagcgaaatgaggaaagcaataaacgcattgtactcattgtaaagaagaagcatttccaaaattatttatctaaaatgaataaggttaaaagcacaaaagttaatgttttgtattacttcgaaaaataaaacacacaaacacatcaacttaggcatttgcaagatgagaaagcaagaatatagggtttatgtttcaaggaatgatactgacagcagcacgaagcatatcttccataatgttgatggcccaacgccattgaccagctcgagaatgagcatggatgagggaattgtatatatcagcatcaggtttacacctaaggttataaatgtcagtattttgtccaaaaaaaaaaagagaaggaaatgacagataatgaaaaatgatatatttcttatcacagtagtggaaaacaaaatatagaaatagcaaccacatggaaattgcacttagtattacacatattacagtttattatgataaagtataaatttcctacatgcgagatcagcaaccatcacttgcgctgttccctagatgatctgggaagattttggatttgcaaactcaaacaaattgaaccataacacaaacatgttatttgtatatagacaagttaccgacgagacaattactcaattatgaggtgataaatttttttagtaatatcaggcaaaactctttttgatggttgaaggaacgcagaagccaaattaaaaccttatgtcagaaatatatgttataacattcataccgccattcctgcatctcaaagaacaggccacgtgcctgatcaacctggttatgcctcgcatatagtcgtatcatcatgccataaatgtcgttacgagcacagtagttatcctgatttttcatccagcagaacacatggacagcatgctgtaaattcccagaaattgtgatctcctacaagtgatacaacatgtgtaagcgcgttattacctgaaaaggctagttttatgttagcaaatcgagagatttgagcctcgtctacaaaatttgcatgtgcagctggtactaccataacaacacagctagatcgattgaattgttcatgatttttgtaatttcaagcaatcgataacattttggccccaaaaccagtttgtcattagtgcctccacgcaaggcaaccatggcagccacattgatgtatatcatcagcaattttcaattcatgaaatgctacagagcgtggggatgatggccttacgcggatgaggagagggaagttgcggcgggcgaagcggccggcccagcagttgagcacggcgtcgacggcgcgggcctcggcgcgcgggagcgcgagcacgcgcgcggcggcctccgacaccttccagtcccgctgccaccggctcccctccacgcgcaggcggtggcgcgcggggagcgaagcggcgcccacgccctccacctcggcgcgggcctcgcgccggccccggtcgtagtccacggacacggcggggcggcgctccgcccaccccggcggcgcggcgcccgggtgcgccagccgcggccgcggcggccgtgggggcgcgcggaccacgcgcgtccgggccggtgacgctggcgccgccgcgtcgggcgtcgcagccggcgaccgcggcggcggcggagcggaagacatcgcggcgggtggtggagggggggagaaaacctttaccgttggggcggtgtgagagcgggttttccggataaggggcgatcttttcctcaacagaaaaaccaggaaatgaactccatccgtcctaaaatatcctcgcgaaattagaatcagattcgtaaaacgagaaagcattctgttatatcctagatttttatattttaaaaataagatagtaatttacaagcaccgcaatctaaaaatatcaccgtagaaatgcttttattttagaaactaggtgaaaccctacgtgttattgtaggagtttagtattataataatataagtaaaaaataatgcgtaacatagctagacaacataaactaaagtaagttgatgtgatttatgataatttaaatttaaatagtatataaaatgatgattcaagatatcattttttcaatacgattttgtatccgccaaaaagaaatacctggattcggctccgatacctatgtaaacatatgggtagattattttaccctgaaattattacagattaatatggacagacgggaaatacatgtcccgttttcaccccttgattcgatcttacccgtcctattttcaccccttgattcgatcttatccattcccgttctctctctgagtcgtcgtcttcctccttcgcctctcctatttcacccctccctcccccctcctctccaatacagcaaagaactcctttatgcaaacatagcggccgtgataatagggcttttatctaagggtaaatgggcaaacgggcacgattaccatgggcagcctccctccaaccgaagtaccgaacctgcgccgagggagacagtgcttctatgggccggattttgtcgccgtgggccaggtgagcccgctcgtttttgctaacctcgctggttgccgtccgatgcagatcgtgcgctccatctccccgctatttccctccctctgactccgaatccgaatccgtagtcgagtctctccccccttcggcgtaaaaaggagaagagaaatcccccgtctcctccgctccttgcgacaagaacagggggagggagaggcgccgatccccatctgctcgagcaaagcagcggaggggaggggatcctgcaggtgagcagcatccatccacatcctccttctgattcatggattcatctctctctctctcccacccctacttttgtctggaattcgctttgtgtgcgttcgttaaccctagctttctcttgtagatctggaagaagctcatctcttaatttcagagagagcctcaaccttttgatacaagagtaacagtattgggggttcatctgaacccccaaatgtcccaagttggatccgcccctgagacgatggatctggagacggagaatcgtcttgcttctttacttctcgaggaggcgaggaggttgcaggcggaggctgacagggaaggtgttcacgcatatctgcgaaagcccaatgtaaggcaccgtccgaattcgcgcttccttacggccacagttcgtggagttcagcaaggttagcatcgtagtttcgatttatcgttattccatacttgatacctcctcctgttgattgattagctatccaaggcaactataataatttcttagtttcttgactcattgttaatcgtttggtagacttttatctggaattgaattattttttatagaacatattaattttattgtttgcccaaaaaaatgtctgttccatgtcttaaaggagaattataggtgtggttaaacacaaaatataaaccaatcgtgtaaaacttacttcctttgtctaggaatgattcgctggatagcaagtaatgacaatctcataagtatagctgatctcatgttgctaattttcttgtccaaagatatcagcggtgttctggttgtctacttactgaattggcatgatatgtgctgttcacctacagcgaaccgtgttgtggaggtcaatgaaatgtggcgtgccagagagaaggaacttgaactggagtctaagatgaaaaggagtagaggtcttggtgacgccagaggtgaaaaacgcaaaagtgacttgagaaaccagagttccagtccaagggttgaagaagaaggcatagcttataacagttcatattcggatcaggaggatggtctaggggacgatgacattgagaagtttcttcattcgaggtctgtattttctatcttttggttgttctagtaccaacattttacacaagtagctatctgcaatgttgctgacagagatgtaactttggtctgctatagggtgaagcgaggtcgaggggccgttggttctaggatggatgagcctggtccataccttaatgttgcatctcgtagtcaagagaacgaacctaatgctgatactcaggtggaagaaaaatgggaacgaagagtacaaggcccggagaaaccagtgtctttgagatcaagatcacctgatgactattggcgtagggaagcactagatggagaaccttccagccctgaactccacaagaaaaaagagaagaagaaggaaaagagttcagagaaaaaggacaggaaagagagaaggaagaaaaaagacaagaagaaatctaagcatcgccaccaccaccatcacaaaagtcggcaaagggagtgattgttctgcttgctgagcataaaaaatgtacacaagaaacatgttagcttctaattgctactgttacttctcacttgaaacatgttgtaccaaaaacttgatatcgtgtggaatggagaactgttcttctcacacggagtgttgatacaaagccatatgttagattttagtgctctcgttggtcttgtgtatttattatcatgatgactaaatcacaccctcgttaattaggaataacgtggttttggtagctaaatgttacagcttccaatcttatctgcaactattgtatgttgtacaaatcgtacaaatcgatcaaatttgtatgctgtctgtctgtcaggcaaggattcctcaattggagcactttggagtccctgtttactggcattctagtttcactttcacatcagtagcccagatcagatattctgactcagaactttaaaacgctgctgatttgcactttgcagtatgacctcatgataatcctccaagcaacatgtaccttcgagagttcttccctagaactttcatttcgaaaaaaaaacaaattcacaaaaataaagagagatttttctctcctttaagaattagtttacatttcctgttcatagcctgataatgcagcataatctgtggaacttcatttgagtatcgatcaaaacagttcagtacccttgctgagagggtgaaaaagaacatagggatgacatgattgttcatatgtagttgcacaaatgtttacaggattacatgacataaaaaaaatgtaagaatgaaaagataatgacctagagtctaccacttctgtttacgcctgaaggcaatcagtggaacgctaatcgagatttatgggctctgtacagtataatgcaatgtgtattgaaggactggattcgacaaaatctatctgcaaaaaacaatgaaattgttactaatcagatcaaatgatcagaagcataataagggacgaagtgaagataagtagtagtaaataggcatgtggaatatggttaaactgatcatgtaaacatcattcacaaacaagcatgatgagcagtgatatttgatagcttaagaatagttgtgccaagcgaaagagacttaattctggaaggttagtaagaatcaaccacatgttcgataaataaaatggtttcaagtttcaacatacacaaagaagttaatgaccattgtactattctagctgctgtcattgagatggtttggagatttcaagtagtcaaggtaatttgtatattttgagaatttttgttgggacctgtaatgactacaaaaaattaacatactcaacaacatgtttaaatttaaaagtgtatagcgaaattgtatcagttactcccactcattcattgtgcaggtcagtcaaagctactctatgaagaaatggcactttagcttagtaagtggctattgccttagaaccatgaggcatatgtctgaacgatcatgattaacctgcctctttcttaataaaagagaatagccaaacctatatctcattgcaaactacaaatagctgaaattttagattgaacaatcgaaaatttgaaatgttgtcagcgaaatactccctccgtcccaataagtagcaacctaggataggattagacccatcctaagactagggtatgtccaaattcgtagtcctaggatgggattagacccatcttgctacatattgggacagagtgagtactcacattgcttagcagtgaaaagtacaaaacataaaaggtgagaaagatagcactgaatctattttctttaagggaaagcattgtgctgtgcaagttcctcaacatccatggctattgagcaacaagaaacaaccaagagaaggacctgaggcaatcacctgcatcaatgaatgaaggaagaatggcccaggaggattcagccaacaacaaaggggctgatctccccgttccgcatgccgcgggctatctcaccggcgatcaccaggcacgttgaaacccagccggcgagcaccatccacaccatgtccacaatgtgagccgcaagcccccacgacatcgtcatcctcgcactcttctccctcaatttcctctcctctccagcctttccctacagctgcttccagggaggcaattccacaaacacctagcctgcaagcccacaaggaacccccaacagtttgcccccccccccccccccccaatcatgagtgagccgacaagatgccatggaggtgaacaagggttagatctatctagttctccaataattgattccatcttctaatcgatgggattgacaaggcacagaacaattacctctgtataatcctgagatggcaaattcacctcaccatgcaacaacagaatcgactccagtttgcaagaacccttcacccatggcagtgattgaatcaggatcttgtgtttcaccaccccagcacgtacaattcttctcctgcttcaataagattggaaaccaaatagaccttggggaatcttcagactcttcagagtgggactgtttccccctttgcttccgccctcagattctaccaaaccatggacggatagatccttaaatttagacggaatcaagaagagataagacaggaaaaataattttttttagaaaatacaccatcaagtttcttgcttgctttccccaaactcttgcctttcacctgtcgctgtcaaactgacccaactgagcaaattcaagaaacacctaggaccaacctgcacaagaaccaactggagactgccacataggagtctctgaccaggaattttggaggagatcctcatccaaattggtttatccaatcgtctttatctgtttggttagaggattagataggggatttggacaagtatacaagtattcttcagttttgtctcatcgtcaattcgtcgaaaaacacctgccctccaggtcagcacagtacattgaacagaaaaggttctactgctgagtaaatgcagattaatcattttttttaaagaaatacagtacagacacacgctcataacatgcacactcacgttataaacgcacacacggacatctcattatcgattggtatgtcatctaccactaaaaaaataatcgatctttgactccatcaacagttgtcacaatataagccattggcttgttgagcttttcaaacccaatcttaaattgttgcaagcatttttttttcatcgttttttttttctagcccaagtcctactcgaaaaataatatcttgttgacttatttatttttgtacagcatgtgagtctttttttttcatttctcatacatattgtgtttgcttccctgagccagttccggcttataagatttgagttgattccatcatctcctctctatgctacagtagctattcttaattaattgaatattgataagtactaataagttctctagatcttttttagaaaaaaagaaaagttctctggattgttgggtcagagactcatccaaatttgggccaggctctgggtcggcctgctgtcactaggccaaaagtcatgatccagtggcccagatcttattaggtccctcactgtcattaggaaaataatttggggaccaggtgaccctgcttaaaaagttgggttatgttcaaagcagggtctcctaatctcctatgattattttccggatttcaagcattgcgatagataatatatagcgggttggtcgtgaattaatctcttgatagcagattgtgtatagagagtgctatagcggctagtatgttccaacatacttcctccgtttgtaaatatttgacgccattgattttttaaaacatgtttgaccattcatcttattaaaaaaattaattaattattaattcctttcctatcatttgatttattgttaaatatacttttatgtacatatagttttacatatttcaaaaaaattttaaataagacgaacggttaaacatgtgctaaaaagtcaacggtgtcaaacatttagaaacgaatggagtattatcttgggtccgctaactttgtagtgctagcagtagaggactaccaacattatagcggtcgccattacggccactgcaaacactatattaattaccttgcttccaagtaactgagctacatgtgtagaagtctaagaagtggatctgaagtgtttgggttaaagtcactatattatttatatttactagcgtataatatccatgcgttagatcagaattaaggaaacattgtcattaatacattctcggcacaacaggcgggtcctttggcccccacgcacaaactccattttttcccttcacaacagtgtgcagggagttgatggtgtgagtgatggatgcggattgaccattcatcacacctagttgtttcatttaaattagtatatgtatacctagaaggtaatatcatggtttaagcatgaccaatgagtttatttttcttctagaaaggtataattaacaagttattactttgttacaataccaaagcgaatcgattttcttttgattcatcactgtatgtacgtagtatgtgctgacttatcatcaaatttacacttgaaaagaaaattgtgctgatctttcaaaaataaagaaaagaaaattgtgcgcggttcgttgtttcaatttgttcaaacaaggtaaaaatatgaaatactactcatcacctgctctttattgcccatcacatgataattacacaccgttgcaagaacaagcatagcacgcgaccataatcattttattcgtttgataaataaataatctagaatataacaatggcgattattatttatcattaaacagcatcagatatcaattaatcaccaagtggcaacggcgcgatccgccgtcgtcggcgcgcgtgtcgaggtcgcactcgtcgcgcccggggagcccctcggcgatggcggccatggcccccttcttgcacgccagcggcgcctcctcctcctcgacgagcacctccaccatggcgcgcagcgcgtcgcagcggcagcgcgccgccacctccctcagctggtggcagcaccgcgcccgcacccccggcgggtcgccgccgccgcaccgccgcagcaggtacgcccggcaccccggcagcgggtccttgggcaccacgccctgccccggctcgcacccatccgccgcgcgcgcgacgccgccgtagtactcctcgccgcccgcagccgccgcgacgacggcgccgaccaccaccaccatcagcgccaccagcgccaccgccaccgacgacaccgagagcttgctgttcttcgacgccattgtcgccgtcaggaagagaaatcgatgagcagtgcaaggtttgggttgttggggggggggggggtggtgagattttagatggttggaaaaagggagagaaatggaagcgtggggaggaagacgaacagttgctttttttgtttttttgaatttgccgggaagcgaagctacgtggagagggcgtcgtgcatggcgcgcgcgggaattgtcagtgggcgtaagggattagcgtccaaattaaacaaaacgaattcatcagtgcatttccagggccgggctgcctacttgcttaatgggccgtgaaagattgggcccaaaagggacctgcacgaatctcaactcgatcggacaaagggtctcatcttttcgcttatacttattcttatcagacaaaatttgaatttttaaacttaaatttggatttgattttaagattttttcatcgaagtttatttttcaatctttgcttttaaatcgctaagaacacgtatataaaagtttaattcacaaattacttttcgtttgcaaatatgtcgtttcgcttattcagcgaaacgatggctccggaagggtttacttactactgggcccgcatactacctctccctttgtgtttccactcaccccgcctataaaaataccgccatttcatcagtatactatttactatagcatttattcatttgtattaaaatatacttatcattgagaccatgtaaagcaatttatgtgacttctaatgtccaagttgtcaacctctattctctcgttttctgcacgcacacttaccgaaccactaaatgatgtgtttttttaataaaagtttctataaaaaggttattgtaaaaatagttaactttggcgtgaaggactaatacttcggtttcaatttgcctcacgaagaaaagggtggatggaggaagaagattgatctgaccggtgggttccatgagtagatgaggaagaagatggagaaggaaggagatggatggaaaatgtgatggcagtggtggtaccaattttgtaaattttcaatggcatggttacaaatagatgaattgtagtagcatttatctgaatcaacatatttataatggcatggatccaattaacctaaaaatcaatacgtactagccctcttggaatcgtctttttcgtactgtaactaccttttactctagttcgtccatttttattggtttgcattgtaaattaaccatccatccttgctgtaaaagtgcgaatctgttaatcctgatgggtgtttaccccaatttgtctaaatttaatatgctagccgattttgatctcaattatcatcttggtcaggagtttttctagatcacggttattagcgattatattcatatcctaaggctctcggtggtacatcgtggtgattggtccctgaaaaaagggtcaacaatggcaaatatgcaatttatttcaaggcccctgaaccatattatctgaaagtttacttggtacgtattatctaaaagtttcctctatatatggttggctgttttttcttttacctttttctgattgcatgttgtccctagggactagtaattatattatatatttcagtgtccctcttgcacaaaggaattaaagaacaattcgagcgggctagtgaatcaacataagaacatcgaagttcatcatttattcaccacatacatacgtttccatgcaaatggaaacagtaattacagtaactacaccacaccacacaaagtagctatagcctagtggccagtcgccgggttcctaagataacccagccattagcaaacaccaccgatgccgatatggatatccacaccgcataatgccaggaggctcgccaccaccatgcatttcatgttgtctctccggcagccagggaatacctcgtccatgggttgcccgtgagccgccgtgccgagctccttgtacatgcctaccaacttgtggctgagcaccggacacctacataagttgttgttgatggtggcgagctgcctacagcagtctcgccagacttgctcatccacgttaccggctgcgccaccgccaatgcactggcccttcaccattgttcggcagcgtgggagtgggtacacatcgagtagtctattcttggctggcaaagctggctgggggtatacaccacctagcagtggtggtctgccattgttgtcgttgccacaagcatggagacaactatcgagagcaacactaagaaccatagtataatttgaaatttcattctccactggcaagcataaatctccctgaattttttggtttttttggtcaaaatttatttaaattcagtcaaaatatgttaaaaattcaaataatttcggtcagaaaaacccggaaatcacaccatattcgttaacccctgaaattacactaccttgtttggtgccattttgtttttctttgtgttgcagaaaattttagttagtctcaaattgtatgagagggtgtacaggtaagcgctacatcaatggtggttttatatgtagctacaaatactaaagtgattccagaacggacacaatttttatcatgagtgagtagcttatggttttgcatgtaatatttattgtggttcaaagctaatctaggcatcatttcgaaaaaaaaaaacccttcgttttatatggaccacactcttttcattttcattcttccatgcaagaaaacaaatgcacaaactgccaacagatatatagttttggaaggtaacaaaatcttttgatctttatttgcatggctttttctatatatagttgatccaatttggtaaacaagaaaaaagataatacttcagaacaaatattgttaagaggaatgctctggaagctaaaaagcatgcagtaaagaaagctgcaacactagattcagaaaattaagaaacgtgtgtttagtgaagaaacgtgtgattatgtcggagtattctgaaacacaagacgcgcacgttcacttaatttccttttattgtgtactctaatcttgagaggactgggcagttggatctaagtaacagagttattttaacaagccacggaattatatagggaagcacgtacgcataatcactttgtcaaaaaaaaaacattacaaattaaaggctagagatattgtgtgttattaccttgtcgtattgcaatttgcatagaaatgttttaagtaaagagtaaggagagcacaagaaataggtctgaagtgtggtaggtttgtcaatttgcgaaggaataaaaagagcgttgttagcttggggagtgagtttaatatctatcggaaatgtattaatttatttttaaatcttggttttaccatatcaattatcttaatcattgtaaaataaactactccctccgttttaaattatttgttgttttagttttgttacaaatcatatgtcactacaataaaaacctcatatgggacttttctagaggagtttacaacaaaaaccttatataggacttttctagaggagtttgtaaattacctctaaaatcatgagttctataacgtagaggcactttgtactttaaaaactgcccagaaaaccttttactctagagacactttttatatattttcaacatattttgttaattcttatctcgtagaggcattttttcggcactttaaaatatgcctgatatgtataagaaattttcttcaggcattttaaactctgtataaacactgtttagggccactaaagggtaagaccctgagcaaacaagccaggcctaaggtcaaacctgtaacttgcctagcatatgtttggttgctacccttaggattctagcatgatgaatcttgcctgagcaagccatgctatctcgctccacctgcctgagtaaaatcaccgcattagtgaaaatgagaccacttcttcctcctcctcctcactgctagcctagggtttttgcagaggccatttcccatcgattcttccatcgctcccgcagcggtgaccaaggaacttgcagatccggtggccagttgtttctttttccagtaaaaatcctgcatttggtgatctgttagagcgtacgctactggagaagtgatctttgctgagtcatacaaaaatcacatagtcccggttcgagtaggaaccgagactaaagatattctttagtcccggttcaaaaacctaggggtactttttgatctttactcctagttgaatagctgttagaccctcaacaaactttagtcccggttggtgataccaaccgaggctaattgtctctctcctacagcatctgttctctctctcttccttatctcctcctcctcctcctgcaaaataagctgccatcaaaccgtcttgggacttattttgtatcggttttaatagttgagggatatgttgtatttggttttccggttgaaagacgaaaatcggattcgttgacaagttaagggacctcagatgaacttattccaaattaactgtaatatatatttggttggttgcttattttttagcctagtaattataaatttcagtattccctcttgcaccatggagttaaagaaaaatccgagccggctagcgaatcatcataagactatcagagttcatcatttattcaccacatatatatgtttccaagcaaaaggaaacactaattatataggtaccacacaagacacacaaggtagctatttcttagtggccagtcgcggggttcataggataactcagccagtagcaaacaccaccaatgccaatgggaatgtctacattgcaaaacgccgggaggctcgccgccacgcgtttcatgtcgcctctccggcagccagggaacacctcgtccatgggttgccctttagcgggtgcaccgagctccttgtacattccaaccaacatgtggctcagcgcggggcacctacagaagctgtcgtcgatggcggcgagctgccggcagcagtcttgccggacttgctcgtccacggcaccgccggcgcactggcgcttcgccagcgcccggcagcggggcagcgggtacatcgggtagccccgtccggcagcgcatagctgcccgggggtataaaccacctggccacggtgatccgccattgtcgtcgttgccacgagcatggagacaactaccgggagcaacaccgagaacactaccttgatgaaagccattttctttctattgttgttgcagaaaattttaattattctcaatcctcaatgagtggttttatatatgtagctactaagactaaagtgatagtgattcaagaatggacacaaaacttttagcatgagtgattagcttgtggttttgaatgaaatatttattgtgattcacagctaatctaggcatcatctggggaaaaaaaagttggctaaagtggattcatatggaccacactctttaattgtttaaacccattttcattcttccgtgcaagaaaataaatgcataaactactaacagacacatagttatggaaggcaacaaaaatattttgatctttatttccatggctttttgtatagtggtccaatttgataaacaaaaaaatgatacttcagaacaaatattgttaaaaagaatgctctgcaagctacaaagtatgcagtaaagaaagcggcaacactagattcagaaaattaaataacgtgtgcgttctctgtatatacgtgcctgatcaagcatatattggagttttctgaaaaacaaaattcatatataagatagctttgatgtgcacgttcagtctttcacctactttttttttttgttgtactgcaatcttgagaggcctaggcagttggataacagagatatattaacaaggcacggaattatatttatatggacataagaagcacgtacgcataatcactttgttgaaaaatgttgcaaattaaaggctagaaatattgtctgctataacttttcccgttgcaatttgcactactaggaaaagcattatcgcaagcggccgaaaagggtcttcgcaggcggggcggccgtccgcctgtaagccaacgactatgaagatcgccgatcttcgcaggcggggaggccgtccgcctgcgaagataattttcgcagacggacgttggctagtccggtccgcctgcgaaaataggaatcgtccgcttgcaaaaaagaaaacttccgcctgcgaagataggtagaaaatattgaaatttaaatataatttggccgtaaattacttttaaattatttattagaaattcttgcaggtacatatattggaatattatcaagcatttggtactgagaaatctacttatattgcataaatcaaaagtgttgccaaaatatatatattacaatattgttttacattgtcacttcaaataacgtcatctagttacattatggcatagcagtgttccactcccgaagatccttgaattcgtcacttgccgctagggcaccctctgggtcgaagaaatctcctttgacatgacagcactcatggtggatgaagtggcacagatcacgctgcacatttgtgatacctgtatcgtcaaagcttgttcgacattctaatcttggcaactgcatgcattgaaattaatcaatatattagtatcataaatatcaagagctgtctagtaaatagtatagagacttacatcctccgcgttagtcctgtaccgtccattaaccctaaggaattcgcacgcataatacccgcaaaggaccgttcctcgcggttgcttgtgacactgaaggacatatcatagaaaaaagtagttataatttgcaattagtgaaactattggaatacataaagtgagtggagtattaccggccaataggtacgtactagcagcttctcccgtgttcgtgtctgttctccacccttgaacttgtagtattggtatgcactgtatgaatgtcataccatttcagagtaaggaggatatttatttgtaatacatccatatacaaatgcaagagtcataataacttactactgtaagattgttagaaattctttgtattgcttgtgtttgtaatcgagaggatccaagactaccacggttccgtctttagggtggatgagtaaacagatataatgatcgctacatattaataacattataattagttagtaacagctaaaataagacatatgtgtacaagataaatgtaccgaacttacttaaaattataagcggccatgacgactctcttattttgaaagtgcaagaaggctcgtccaatgtactgtgcgacagtaatcaatttctccttgtgcaagcccttcttgtattctgctatctctttcggattcttgcccttcagctggtctgaccctggatctagcgtaacggtatgctgtgtttggcagatctgagttggatccaagaagccgatgggttcttttttcttcttagcatccatgtattgcatcctacataagaagtttgttagtagcaatcacatggagttgtattgtacatattttttatctaattaattaaaattcgtactcacatgcaccaaacaccgacatagttgacgtccatcttatcccgacgatatatggcgtggagatctgagaaatctagccatacgtaaccttcttcgccgaaacaatctgccggtgatcgagctattatattgcccaagcctttcttgctggcctccatgtagaagttatgtaaccttctcatctcccatggtgcttctttcagtgcccattccggcaagagtgctttcccatgttcgtacttttccgggcaatcatcggttgcgaagtatgttggcccggctagcacagaagccttctgggggtcgtcatctctgagcttggcacgttccttaccccctctgaagacggttagcatgaacttctccttgttcgcatctttggacttggattcgtggctcctaatcactcgtggcacctcgggttctttcgcaggagaagggtcttcaaatatctctggctctgtaccatcccattccaatcctggtacttcatctttgactgacccgactgatgccacaaattccacctctggttctgccactgtaatctctatgggcacatccggcacttgaatctccatggctgtctccggcggtgcaatctccatggctgtctccggcggtgcagtctccatggctgtctccggcaatgcaatctccggtggcacttccggcactggattttccttaccaagttcaggatcatccgccttatcagtcaccttcctcttaggaggcctcggaggttttcccaaacccggtttaggcaacacaggtttttccccggcgtcggtgcccaatccaaagaatatgtcattcttatgccagagaattacaagatcgaccgcatccccaagtacggatataccatctgcagtcgggtagtcaatgtcgtaggactcaaacccttcgtggaccacttgtggctgcaccttggcatacgcatcgggtaagaactgttcattgtatgttctaccagggatagcaatggctgtagcggcctcaagagttttaccggagcgtccaatgggaacgtccaatctgcagggtgtattctccttgaggtcatcgaaggggtaatctggctcagtttctttggtttcggggcgaagcaaaatcatgtgcttcgaccgtagaaatcatggacgaacggtcgacgacgagcttcggtcgtggacaacgaaggaagggccggcgacgaggttcggccatggacgacgaacggcctacgacgaggttcggccgtggacgacgaccggccgaagacgtcgttcgcggccgaggacgtattcgctcgtggacgacgatcggccgatgaagccgttcagccgcgagcggaggggtgggcaacggtggtggaggggccaacggcggcggtggccgtgcgcgcggtggaggggccggcggcggtggaggagccgatggcggaggagagcgagctcgacggtggcggtggatgagccggcagcggtggatgagctcgacggtggcggtggcggtggatgagccggcgacggggctgcctcggtggagcgtggtggacgacgacggtcggctgcggcggaggacgacggtcggagagcgaaggtcgcaggcggggcggcggcggaggacggcggaggcgtgcggcggtgaaaaatttcggcagcctgacggcgccaaattttttagggttcccgcctggacttagaaattttggcgccgcgggcttgcccttatatagggcaaagatcttcgcaagcgggcggtccgcctgcgaagatcttttcaacaaactagtaattgcacataaaaatatttacacttttcaaatattactaactttaaatttttttaactaaattttcacaattcaaatggtaattgcacataaaaattagtacttagaaattaatatgcaaaatgttgagtacaattgttcgtcaatttgcgatacgatcacacatacgaccattacataactactaacttcttagatgtttatatgccactcaacaatcattaccctttaacatttttgcccacaccgtccgtgcgcatgtaaggcttcacggtcttctgagtagatgtctcgacattcttaatcttctgtacaaactgactataaagtggcatactatcatattggttgtaatcttcgacatcttcaaccccatccactcccaatatcttttgtttccctggtagcactatatctttcttcaaatttgaagggtctttcacataaaacacttgtgccacgcgattggcgagtacccaaggatcatccttgtgacccactctcgcaaggtcaacaacagtaagaccgaacttatcaacatttaccctgttcgggtattttacccactggcacttaaatatggggaattgcattgtgtgcccatagtcaatttcccatatttcttcaataaacccgaagtatgattgtttttcaccggcttcatcaattgcctccacacggacaccgctgttttgtgtacaggtcttattatctcgggctcttgtgctaaacgaatatccattaatgtcatatccctgccaagaatttactgtagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgagcttcttggaatgatttgtgatcatgggtgacgaatctcttctttcctatcgttcccctgccactcaatctgccctcgtgttggggcacaggtactccaattgcatatccatccttgagataatcgatacagcactcgacaacctcttcagtactataatcctcaaccattgatccctctagatgtgcacgatttcggacgtaacccttcagaaccgccatgtaacgctcgtatgaccacatttgatggaggtacaatgggccaagcgcaaccatctgcggcacaatgtgaacaatgaggtgctccatcatatcaaaaaatgacggagggaaacacatctcaagttggcactgggtctcatgtgcgaatgtacggagatttcctaactcttcgagactaatgaccttctgtgacactgcgttgaaaaagtagcacaaccttgtgatagcaacctttaaatgctccggttttatggctcttattgcaattgcaagaaacacggtgagcaagacatggcagtcgtgtgaattataaccagataccgacaaatctttcattgaaactagtcgactgatgtttgatgagaaacctatgggcagtctgacattacggagtgagttgcaaaatgacttcttctccttaggtgtcagtgtgaaacaggctggtggaagatatactttgccattcttttctccttcttgagggtgtaactcttccctgattcccatctcgactaggtccatcgttgattgcagaccatctttagtcttcttcggcatgtccaacaatgttccaactatgttgtcaaacacattcttctctagatgcatgacgtctatggcatgctgaacctccagatctttccagtacgggaggtacttaaaaaatatggaatgcttcttgaatgggggagggagtttatcatctggcttcgaactgtcatcttgcttcttactatcccctcccttcgtattcttctcgggtttcttgcgctttgtcccctttgatggtttcttagtcatttttccaaactcgcaaacaattttctctatcattgcacacacattttctcccgatgtaggttttggtgcaggatcagtctcttcagtaccatcgaactccgccttcatcttacggtacttgtgatttgtgcgtaggaaccgccggtgccgcatgtacacaagcttgttggaacccgggagatacctataggacgttccattcaagcagatcacacatcctgttttacctttaatttgacctgaaactaaaaacattgctggataatcgttaatggtcacgaagatgattgccttcactgtgaagtattcccttaagtactcgtcccacactttcaatccctctttccataaatcggccatatcttccaacaatggtccaagaaatacgtctatatcaataccaggctaacggggtccctgtatgaggatacagagtagtacgtattttcgcttttgacaaagccaggtaggaagattatacatggtgagaagcactggccaagtactatgtgaactgctcatgtctccaaaaggattaactccatcagtactcagggcaaatctaatgttccgtgggtctttagcaaactctctatactgcgcatcaaaggttctccattgacgagcatctgccgggtgtcgaatcatcccatccttcttgcgcccttcttcatgccagtgcattagttccgcatctcgcgggtttgagtatattcgtgtaatgcggtctttcacaggaaggtaccacatcacaagctgcgggatttttctctgtcgtccctcagttgcttcagagggttctaggctagtattgctattcgacttgtaccagcttgcaccgcatgttggacattcatccaaagaagcgtactctttcctatacagtatgcagtgatttacgcacgcatgaatcttttccacaccaagtgaaagggggcatatgagtttctttgcttgatatgtgctggatggtagtgagttaggcctcggtagcattttctgcaggagttctaaaagactgtcgaaactggtatcagaccatccatgtctcgcctttaacctcataagttcaagaactgaccggagtgttgtgaaatcactgtcacagcccttcgactcatcgtacaaaacttcctttgctgccttctgtaaagcttcaaagttatttagccctctggccgaccccatcagcacctcgggttctgcattacgtaacattttctctaggtcgattttgtcctcaacagaaccatcgtcatgcaccatgtcttcaacttgtgtcggaactacattttcaggctcgtccacttgttcttcgccatgacgtgtccatatttcgtacttgtccataaatccgtgagttaccaagtgctccttcactttaaaagcatcgtcaaagtcccaggctatttcattcttacagtcagcacacggacaaattatcttcctcatattgttcttctcagcgtgaaccttggcaataccaataaatttagccacttcgtttctatatggagacaaaaacctcggccaatgatacatccattcccgactttctatatctctaaaaaatacacgtaaaatatttgcacaattaataccaaatttgtagggtttattgaaaaaacttatagctattcaaaactaattaactaaaggttaagttgtaaagtaataaaaaatcatagtttatttcaattttttttacacagacatgccaaattagcacattaggaaaatctaacaaaatcaattcatcggcatattacaaaatactataactattttttgattgcactgaataaatagacatttaaaatttttttctctctctatacatgacaagagctagatctagatctagaactaggtggtggatatgatagcaaaaaattaaaaaacaagaatttatgttaccacattaaaccactacaacaagaggcatcaagtattacacatacatctaacataaacaaatgacaagaaataaaattaaaaaacatggagctcttccttcaaaattttggatgcataaatccatcacaaattaaggtctaaaagcttaaaaaaaatgcatacctagtgtggaaatgagtagatctaagtaccgtagaaaaatcccccgaagatttgaagttcaaaacctcccccctatatttaagtcactttaggagagagaaacgtcggggagaatgaacagggctcggggaggaagaagactatataggggcatctttgcaggcgggccatataagcgtcgcctgcgaaaatttatcccctacgacgccgaaaatgagatttctagtagtgttgcaccagcccttcccttattttataagtaaagagtaaaggagattaaaaaaatgtcttaagcggggtaggtttgttcattcctgaaggaaaaacgaggccggatttgttagcttggagagcgagttaatttaatgtctttcagaaatgcatttactttgaaatgttggttttaccatatatatccatttacgatcttaactattgcaaaataaactataaactatttgtgatttttttaacttgtcagacaaagtctccaatccatataggtttgttgccattcatgtttataataatatattcataaaaaatatttaaataaaacaacacaagtatatttattgtaaatctatgaatgcaattattcgcatagattatattatatcgcatagattgtatagacctgtgactaccatatgttttttgacacgtcatgaaaccaatcctactgtttgtcagttgcttatcgggtgacacatttgatgaaaacaagcgtaggaataataacaaaactaaaagaagagaggaacatcgtttctactcctttcaattcagattataagtcgttttgacttgggtcaaagttaaattgcttcaagtttgacaagtttatagaaaaaaagtagttacactttcatcacaagacaaatatattatggaaatatatttaatatatatatatatatatatatatatattaattgaaactaaattactgttgtaaatattactatatttgtatacaaacttagtcaaatttaaactagtttgattttgaccaaaactaaaacgacttataatcagaaacaaagggagtactcttatttcttactagtaaaatggccgtgctttgctatggataaaagaaaatatattataatatgtaatagatattaaaaattatcgaatatattaatgccacttgcttacttgtttgaatatacagtatttacttgtttgaaccatatatttggactattccataatataaaaaaacaggagcctatttggaaaacagtgggggtggcagattcactaccaccacatctagggacttttatgtacaaccttcgttttgaatataaggatgtgtctatgttgtttatcaggtgtttgtcgaatacttatatcaaaagattcatttttagtcacttcagttgtcaatttttgaattttgaattatttagatatcatttacaagaatctgattacctatgcaatcactgaaatgatgggaatcaaagtaatcagtgcatgaatacttatagtgtggtaccaaagaatggagggagtgaataagaaatgcaacattcaaatattatagatgttactattaattgtcagatcacaaaaaaatacggcagcttattatagagggcacctttaggctgcgattcggccgacatgggcgctctcctcaacaagaaattccctttttccatcatgaaattaaagaacaacgaaggctagctagcaaaccagcaagatatattcagaagaacattgaagttcatcatttattcaccacatatatataaatagatgcttcctgacaaaagaaagcactaattatttagcaaccccacatagtcacacacacacagctaactatagtagcctagtgaccggttcttggggtcctaggatacccaagccagtagcagacaccaccaggcccattggggatgtccacgttgcagaacgccgggaggctcgccgccgcgcgctccaagtcccctctccggcagccggggaacacctcggccatggggtgcccggcctcggtggcgccgagctccctgtagatgcctgacagcatgtgatcgagcgccccgcacctgcaccagccgtcgtcgacggcggcgagctgccggcagcagtcttgccagacttgctcgtccgcggcgctggccgcgccacggccaacgcattggcgcctcaccaatgttcgacattgcgggagtgagtatgtcggatagcttattcctggccgacattgctcaccggggctgtagacttggtggtggtccgccatggtcgccatcgccgccgcgagcacggagagaacgacgaggagcaataccgagaacactaccttgttggaagccatattttgcttagtttgtgaaaaatcttaattaactgtgatagctaggctcttcgtctctgggtggttttatatatagctataaagaccaaagtgattcaagaacagatagaaattttttggctgttcatgagctatttatggatttgcttgtggttctgtatgaaacatctattgtgattcacacgcctaatctggggcatcatatggacaacagatggttaaagtggattgatatgtactacactctttaattatttgaatttgtttgatccttacgtggaagaaaataaatgctatatgtggctatagaaagactaattaaagtgattcaactttgaagaacggccacaaaattgttttagctgttcatgcgtggttagtatgctcttggggttttgcatgactggcatgagcaatttgcttgtggttttgcatgaaatattttttgttattcacggctaatctgagcattatatattttgacaaaaagttggtttaaagtggattgatatggaccacactctttaattatttgaactcattttcattcttccgtgtaagaaaagaaatgcacacaccgtcaacagacatatagtactatgggtaacaaaatcttttgatatttatatttatccaatttgtttaatgacgaaaaggatagttcaaagcaaattatgtttatagctacccgtggcatgattttgttgttatgtcatatcggaagtggtcttgaagtaataacaccttgatgtaatttgtaagatcaacaaagtttcctttgtcttcaaagaatgtttgctaatttgcaaaaggaaaaaagagtattgttagcttggggattgagcttaatgtttttccataaatgtatttattcttaatgtcggtttatcatatcgatgatgttagttatttcaaagtaaacaatactcattgggaaagactctgagggaaaaaattatgcgggatctttgatgaggacatcccagctacacttgacgtgaacaaggctgatggttacgttatacatcacatggagaaatttgaagatgacgtaaaccaagttgatggcttacgtcttagtaagaacgatcaaacatatcatggtccaattatgcacagccatgctaagaaaatacaactagaggtgaactcactctttgctcaacttaacccaaattttaatgagaattttatactacctaaatattctacctttgtcttgctaaggtttacatcggaagacatcattactacgccaagaaggatgggttatgttgaggatgacaagagttacaccgagcaggaattagcccatgcactaccagcagctgtctacgccaacaaaaagttggtttacgctacaaaggctcaacatccaaggcttgtacgacccagccagtcaagttacgggttgcatggcatacatggttggaaagaggggcatgtctagcttccaatgcttcaaaccccatctcaatatcactttccaataaaaagttagagcatttttactgaggactgcgcaggagctgaagggctgtgcgtgaacccgagaaaactttttgcattctcatttatgttagccttgatcaccagaacgtggcttcttatgttcacacctacgctaggaggaatgttcctagtataaatacacttctaattcatccattagacaacttttgttcaattgaaaacctcatgtatgagagattattgaagtctgcataagtcttaccctttttgttctcgtgagttcttttgggcttgtgagaaggatcctcttgtgtcccctagttcgtgattttggccctcgggcctcttgtgtggattagttctggattgtggttctgtaattgctcgttttgacgggtcagagtccaggaaacttcggatcattctcacactcaccacttggtcgcatccaaccttggcaggtataaagctagttatcctctagctacgagtagctagttaccctcttgtgtacaatttatgccggtgctcttttgcttcaaacctactaccgtgaagatcgggtcacctctcgcgattgcgttcgcaacaaccttggttattcgctcttctagaaatacttctatttactgtcggcacgaatcttcacgaaagcaatagcttacatagacatctttaatactatagaggcattgcaaaaatatcgcacaagtgccttttgaataatctctataaatggggaaacattttatagaatgtctccattcacaatgtgatttttctagaagcatttttatgtgtataagagagtggtaaattttaaagtgccaaaaagattgattctcaaacaaagtaaatttgtctctaaaataaaaaaagttccaagcaattattaaagtgcttctaaaatgtgtctctaggctatagaactcctaagtttagagatgatttcaaaatcagctatagaaaagtgcccacgtacttaaagtttttcatgtgcttggagcagtcatcacctcctacctcagctcatgtccccaaattctcaccttctctcttgtctcaactccccacctcccttccttctccttggccggaggcccaatctccgtccagagtgcaatccatgtgcaggggcagcgagctaccccaacttttcctactctctcccactacctaactctccttccatctaagctgaagtcccaatgtttggccagatgcgtagtgacggtgccaacgtcaactcatccaaccatggggacggccgtcaaatttgttaaggtttattttggttacaatctgaaaaaccgtgaagtattttgggattggtgaaaaaccgaggtcatgcataatttcttccacatactttaggaaaatatatcgtaataagaatttctaaaagcattacataaaaaaaaacttccaagaacaaaactaaagaagagaggaacatccattccacttttttatttcttattagtactatcacatacataagaggagaaaattatagatgctacaattaattgttggcgatctcaccaccaaattaaaatagtgcagattattaaagagggcacttttaggctgcgttcgagcgcaggagaaagagagaaatattgtttcgtttttcgcgcgcacgcttcccgaactactaaacggtatgtttttttcaaaaaatttctataggaaagttgctttaaaaaattatattaatccatttttgaagtttaaaatagttaatactttattaattatgtgctaatggctcacctcgttttgcgtatcttcccaatctcctcaatcccctccttctcaaacacacccttagtttgcaaaatccgcactccgtcagcatggatgccatgcctgccatcctctggccgacgcagcccagcagcggtgctattcggtcgacatgagcaccatgaaattcttttttttcacaaaatgaaattaaataacaacgaaatattgctacccaattggcaagatgtattcagaagaacattgaagttcatcatttattcaccatatgtatatatgcttcctgacaaatgaaagcactagttatttagcaaccccacagagtcatacacacagctagctttagtagcctagtgaccagttctcggggtcctaggataacctagccagtagcagacaccacctgtcccattggggatgtccacgttgcagaacgccgggaggctcgccgccgcgcgctccaagtcccctctccggcagccggggaacacctcggccatggggtgcccaacatcggtggcgccgagctccctgtagatgcctccaaccatgtggttgagcgccgagcacctgcaccagctgtcgtcgaccgcggcgagctgccggcagcagtcctgccggagttgctcgtccacggcgccgccgggtgcgccgtggcccacgcactggcgcttcaccaccgcccggcagcgtggcagcgagtacatcgggtagcccattcctggctgacaacgctcgccgaggctgtacaccacctggtctttgtggtggtccgccatggtcgccgtcgcggcgagcacggagacgatgatgaggagcaacgccgagaacactaccttgttggaagccatggctttttgtttgcagaaaatctttagtctgaatttgtatgagagggataggtttaaggtcttcatctattggtggttttatatatagctataaagactaaagtgatttaagaagggacataaaagttttagctgttcatgagctaatagattaacttgtggttttgtatacatataaaatattaattgtgatccacgcctaatgtgggcatcatatggactaaagttggtaaaagtggattgatatgcaccacactctttattaatttgaaccttccgtggaagaaaattaaagaaatgcacataatgtcaacagacatatatagttttgcatgcaaggtaacaaaatcagttcatctttatttccatggcttgtatagtgatccaaattgtggaacaataaaaagaatagttctgaacaaatactttaaaaagaatgctctggaagctgcagtaacgaaagctgcatcactagatttcagaaaattaagaaattaacgtgcctgatgaagcatataagtattggagttttctgaaacacaaatatcatatatatagatagctttacgcgcacgttggataacagggttatattaacaaggcacggcattatatatggccaggagaagtacgcacgcataatcactttgtttaaaaattaatgatacaaattaaatgttaggaatattttgtgctataactttgtcgacttgtaataaagtaaaaaatacgtgaggttaaaatataggtattatgtgaggtggaaggaagaggttttttatttcgtgacaaaggaaaaagaaacaagctagagggttgttagcatggggtgtgagtttaatgtccttcaaaatctatatttatttggaattgttggtttgaccatatgaatgaccttagtttttgcaaaatatactatactccttgtgttcctttttatttgtacaatcacgacatagtctctctcgccaattcattaatttttatcattcctattgataatcatatattcataataaacagttcaatataactacagttatagtcttttttttatgataaatcaatgagtgccatctttgaatattaaatcatattatatttttgcatctataagtgattaaaaaaataatcaagatttcattgcctcctatacatccaaaacagcatctatttgtgaacggaagcaacactttaatggcttaacaagtgatcttatttgtgcagtcagcgatatactctatctgtactctatctcaacaaaggagtatatgagaacccttttgttgtgtatgacatgtaggggtgaaaacagtacggaatttttccggattccggtcatgttttcggaaacggaatcggccggtcggaattttttcggaatttctcggaatcggaatcgaaaacggaaatattttctcggaaacggaatcgaatatgataatagcagtttccgtcggaacccggaaacgatcggaaacattccggaaaaattgtcggaatttccgaagttaaaaataccatagattcaatagtccataattcatccctagcttcccagcccaacccaaatcgcggcggcatctaccctaaccggctaaccctataggagagagaccgtcagactcagaactcagacgcgactcgcgagttggaggcggagcggcggctgcggcatccagatcgcggcatcgcggcgccggcgtgccctcacgcccaccgcccgtggcgccggcgccccaccgcccactgctggtcgcctggccggctggcccccgccgtcctcgctcccaccatctcgcgccgcccttgctcttcgtcgtttcgccgccggccgccgccaccatctcgcacctccgccggcctgctcggtccccgccatctcaaggcgccgtcccaccgcgtctcgccgtttcaccgtcgccaccaccgccgccgacgacggaacaaccaccacaccgacgaggcgacgacgacaccaccactgcagtctcttcctcaccgccaccaacgccgacggctcctcgcctcgcagcagccagcagcccagcggcagcatctgagcaaccagcagcagcaggtgtatatagtgattgactttgcacttttactaatgctctatcattttttttgaaggctaatggaacggaacaagagacagagacagtagaagcggaatgttctaatgaggatggcattgcgccaatggatgtttgaagaaaatgttggtcaatttaattttcaagttacatctaatttcaagtttccatttcaaattagtgtactcctgctgcacaagtggatgagatatgtttgaaccatgtactgatgtgttttgtgattgaactatgttttgtgatgaactatgtatttatagggtgatgtgttttgtgattgaactaagtactgaaacactgatggactgatgtgcgttgctgttctgtgatgattgatgaactattgctgttctgtgatgattgatgttgtgaccttaggtcacgaacaagatcggggataggccggaaagaagtgttttcccgcctatccttagaaacgagctcgaacagcaaacacaacttttgaggattacttttgtattcaagatgttttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcccgggaattcgaattcccctttgccttctctttcatccttggaaaacacctgtgaaattgtaacttgtccaaaatatgtgtagttgtattagcgattatggaatgtccctaaaaaggtgttcttcacccgaagaggtattttctattcgaatgagtgttcttcctctgggaaggtattttccctttgggaaggtgttcttcctcttggaaaggtagtttccactcaaaatgagtgttttcccttctggatacttaggtcttgcaaaacctcgtagtgttttgaccgaattggaggaaaaggtgtttgcaccctgctacaacaagcccctcacgggtaagggcgatgtgtgttttcggccgaaaccgtgcctgagtttatggaaaaagggggaaaaccgccgtcctcctattcggtcgaaacacactattcaaatatgcatatacgccacgtttactattcatttatttttattcttattatttttcatttttatttatttatttattgtgtttttttttgaatgccacgtgccggtatttcattggtgcgctcaaggggtcgcgtcgcttcgggtttcgtgtccgctcgtaaacccgcgacccttaccaccctgcgctatataaggccaggaggggtcgctatcacgtgacccacgccaccactcgtttgctctgccatcaactcgaaatcacaaaatactcgaactaaatctctttcttccttcttccattcgagttttggtgctttgcttgatttcttcctttctcactacacaacatggggaaaaacaagaaaactgcggaaaagtcgaagtccaagaaatcaaaaagccacgaagatacttcttgtggtattggtgcctcttcgattaaggaaaaaaacttaaacgatcttgttgatgttggttggatatctggtcgaaacgttgtaattcgaccagtgggagaatcaaggccttctcccaagctgggatacactcttgtgtttgaggatttcttctacgccgggtttaaattcccatgcagcacttttttggttgaggtcctgaaattgttcagacttgagtttcctcaattgactccaaatgctttagttcgaattgggcttttcgaatggatgattcgaagctgcggtgggacccctcgagctgaagactttgcatacttccattgtactcggcactacaccaaacagaactcgaagtttgggtgtgtaaactttgctcctcatcccaagcgcggaagtccatggccagctgtgtctgctattcgagcaaaatgggggaacaagtggcaatcgaagtggttttatcatcaaatccctctcagcctgctgaatgataaggattgtcctttttcgttctctgggaagaaaccgaaaactgtctccgagccatcagtctctttgtcgccggagttcactgccatacaacctcgaatcgaagaacttgtttcgaaatttagctgccgagacctggtggaagagtttgttcttctcaaaattagacctctttcgagcggctgggatatcactctcggagaaatccccgaaaattgcccttccagtcttcctccatttgtggtttcgtctgatcgtaagtttccttttcgaactgcaaaccttgtttgtcttgaaaaagtgatttagttaagaagatttattttctccctttgttatcttcttccttgtagttgtgattccagaggatatggtccgcccagttcgaaaatttcttggcccttataccaaggatgagcatttgaaatttttgacacttcaaaatgagaaaaggcaaaatcgggtcttcgcctctctaggctccgatatccctgtccgcgttcatcctgaaattgtccccaaactaaagaaaaagaaatctgtgaagccctcttcctctgatgatgatgatgatgttgaagtggaagatattgacgaagaaattggggaagaaaatgctgaagaagaagaaggcgaggaaggagctgatgaagaagagaacgactcgggtgatgatagcgactcgagtagcagttcgagcgacaactcgagcgacttgtctgaatctggtgatagcaaaacagttcctcctcctactgttttagctgatttgaaaaggaagaaaactgccagcagtcctcctcctgaaccgagttctaaacgagtgcaacttgttattgacagtgatgaagagttggatgaagatgatatccgtattgatctttctgctatccatgtcaccccaattcgagctgatgctagttttgccctttcggcaaaagaagtagcttcactgtatgttgttgccccaaccaccacggttgtcgagaaagattgctcgacccaagtgggtgatactgttgagacaacaaaccctcttcgagctgatcgagacttggttgcaaaaaaggcaaaaacgcccgtcagtgcagccgaaaagtccgaagcagggaagagtgctgctgatggaggtgttcgaactacaggtagttcgaacccaactccacctccgtcaccgccgttcatcgcaaccccttccccagagctgatacaaaacgttcttggtggttttagcgaacgatgcgcaaaagatggacattggcttatgggtcttcctaatttcaacgaactcggggaaagtagccatcatggcccaaacctgtgtttgaatgacctaaagtatcgccaccccctgagttcgattggtgatgaactcgagaaagttctgattactcctgatcttgaaaaggagtttttggaagaaaatgatcttatgtcctcttggacagcacttgatgtatctgctgcacaggtatttttatttatctatttatttatttatttatttatttattattattttctttttaacttaaaacctattttctgatgcgcagactgcgagccttgctcgtcttcaacgtggtgttgctcggaaagctcttcgagctctttgcacgcaacggaagaaatcacttgatcgcatcgctaaactcgaaaaggatcgggattatcttcgctgcaaacttgatcgaatggccgacgagaagaaaatcaccaccgatctcgtgcgcaagttaagcggcgaaaagaaagagctttccgaagaaaagaagttgcttactgaggaaaagaagaaattactcgctcatgtaaaagcattcgagcgaaaaatcatcgagtatcaagacgtcgcacgacaacgcgctgaatcagaagacaagatgaaggagcaagttgaggtcttggagaagaagaataaagaactcgaactcgcctgcaaaaatcaaagcgagaagatatctgctttagagctcgagagcgaaagttgccgccaacttcttctgaaaagttgcgagaccgttcgaatcacgttgcgaagtctaggggctgacatcagcttgctatcggaagaaaataccttagcagctgtgggaaaatggttcgaggaattttccattgggctaaaagatagcgttactccctttgcatctcgctgctcgaagactgctgtggagagcctttcggcctgtctgctttcaaatgggtgtgaacactttaccacccttaaaactgatatacaaggtatacttaatgatgaggccaaatttgcacagcttcgagatgcagctcaacccgtcgtaaaggctttccaagtgctttactggaagaagaaaggatatgaagataccctgaggtctctccgagcatctcttgcctcgagatcaaagtcacaaccggccagttcgagccaacaagataaagacagtagtactccgagctcgagcgcacaggtgtgacgttcgtgaaaagaatagttaaggatgcttcgtatgttcgaaaacaatgctattttgctgcttcaaaaccgttatggttgagagcctttattgtaaaaattcatctcttattgcatgcttttcacggaaattccctttctttgggggggctgcatgttaactcgaatcgaaaacttgtgattcgacgcaacaacactttgcctactcgaaatgtgaagcacttagcatttcgagaccctgcaaagctttcttctaccaggaccgccgtctccgatgacgaactcgaagcctgttatgataatacttgtatatttgcttttaagtttttccgatggcaacgaagccatcgacatgacagtttacgtgactttgtacttgagtttagggaacggcgttcgaacaatactcttgctagtaaagccttttggcaaaacttccaaccatccgaacgccaacgtagaatatggaaaaggcgttattcaatagttccatatacagtaatgccttctcctctcaacattgtttatcccgactcttttctttcttctttgtagagtttgtatgtaacttgttataccttcttaacatcaaataaacccttcctttcttcttttctttataaatgctctttatttcaattgttcaagcacccttaggtaaactacgtcctccttatctttggaagaagttacgaaatcgaaacgtactttatctcgtcacgtgcattttccgccttttgagctcgagcgaggggaaaatagagttcgagcattctttagttggttttttggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaacgtattttacctcgtcacgcggattttctgctttttgagctcgaacgagaatagagttcgagcattcctgagctggtttttaggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaatttgctagtcgaaagtattcgactcctagcgtgaggagttatattttgtcgactttgctagtcgagagtatttgactccgagcgtgcggagttctattttgtcgactttgttagtcgaatgtatttgactccgagcgtgcggagttctattagactttgttagtcgagagtatttgactccgagcgtgcggagttctattttgtcgactttgttagtcgagagtatttgactccgagcgtgcggagttctattttgtcgactttgttagtcgagagtatttgactccgagcgtgaggagttctattttgtcgactttgttagtcgaatgtatttgactccgagcgtgcggagttctattgtcgactttgttagtcgagagtatttgactccgagcgtgcggagttctattttgtcgactttgttagtcgagagtatttgactccgagcgtgcggagttctattttgtcgactttgttagtcgaatgtatttgactccgagcgtgcggagttctattgcaatcatacacagaggcatgttttttatacaggttcgggcctccattatggataaaaaccctacgtcctgtttatatacattaacttggatatcattcgtatttacatctgagtgagtatactacaaactcgagctcccgtgttctcctttttctctttctctctctctctcctttttttttaggcataaaatttctttaaagaaatagcattccaagtatgctttaactcatcaccatcaagatatgctaacttgaatgctcccgtttctgtcttctttttgactatgaatggtccttcccactttgactcgagttttccaacagctacctcattgagcactttcttcaagactaaatctccttcttcaatcggccttgtctttactttttggttgtaatagctctttgttccttctgtgtatgatgccatcttctccaaagcttcaacccttatttcatctagcatttcaagagttatgtctcttccttcttcatctttttggtcaaatatcattcttggagaatgtgcccctacttcgcttggagtcattgcttcatcgccataaaccaatctgaaaggggtcatgccagtcgaccttactaccgtagttcttagtgcccaaagcactgatagcaaatcctccggccattttccttttgctgatccttctaacctcttcttgatagcttccatgattttaccatttgccctttccacagctccatttgtctgaggatggcctacagaggcaaagttgatttgcaaattaaggcctttacacatgtcttgaaattttccagattcgaattgctttccattgtcacatactatttcccttgggattccaaatcgacatattatgttcttccaaacaaacttttgtagtgctgcagaagttattcttgccactgcttctgcctcaatccatcttgaaaagtattcaattgcaacaatgataaagcgcaaatctcccttcgctcttggaagaggacctactatatctattccccatctgtaaaaaggccagactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctccatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctttaccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaattccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaattcctaacgaagagcccccagttatggcatttatcactctctttggcacttcttcaattgcctctatcttcataacttgcggtgcttctatggcgttttgtcctcgttgatcacgagctccttcatacttgttctcatatcgatttacgtgtttttccaacaagtgagtcatttgcctgcattcttctgtggaatgacctcctggaccatgtatatgacaaaacttactgtaacattcttctgtggaatgacctcctggtccatgtgtttgacaaaatttggtttggtcaggtttattttctcttccttttcctctttcattgttccaccatcgtcctctacctctgcctgaattccaccattgtcctcgaccttttccagattgcccccaattgtttctccctctgcgagtgttgtcccattgatgttttcctttttctctttcattgttggatccatctccgataaaatttacctgtttcttctgatcttgtttatagtcatacttgaaccttttccagggctttccggtatagacggcttcttcctcttgcactctcaactcatcttcttctcctcttgcaaaactttccattctttcaaacaagtcttttgctgtctttggtctatttctagcaagatcgaaacgaagaggaccgggtagcaatgccctttttgctgccgctatgagcatttcgtcatctacatgcctgatctgacatcttacccttgaaaacttcacgatgaaacttctcaatgtttcccctggaagctgcttcatggcatacaagtcatctgcctcttttggttcttcatacgccccaatgaatcctgctcgaaaggtgtctctcatatgttcccatgaatagattgtcattggtggaatggtagtgtaccatgataatgtactccttctagcattgttgggagtatcttagctttcgtggtatcatctccacctgctgcttcaactgctgtctcatatactctgaggtattcattgggatctgtgtctcctttgtactttgtgatgttggacaacttgaagtttattggccaaggtgccatttgcaggttttgacttaagggattctttgtatctattgctctggtcggttgaaaatagggttgtgtgggctggaattgaaaggcctggttcggtatttgacctgcatattgtatatggttggccatttgtgggatgtacccttgttcaagcatcatctctggttgttgcatatggaaaggggaaaaaccttgggggacttggtgatggttttgagctgcttgagtgtttgttgattgcgtatgtgtgaagttgggcaaagatgtttgaatctgtggtatttgggtttgtggaacttgtatttgtggtatatcattttgtgggagttgtgttcgtgggatattactttgtaggatatgaggttgggggatttggatttgattgggaagaactgggtgggtttgatgtaattgtgtttgaggatattgtacttggttaggaatttgagtttgaattggaatatgcggctggaaagaaatgtgcgtttgaatgggaatttggttttggctagggatcaaggttcgagctaggttctgagtaggaatggtaatttgagcttgaggtgtattctgggtaagaatgggaatttgagcctgagatgggttttgtacttgactgggagcttgggttcgtggtagatcttgagcttgggtggctttggtactttctccttctttgttctccccctgggcatctccttttgcctgatctgattgcttttccctagcccctggtattgcacactgatcacttgatcctcctgctcctactgtctgattgtgtagggtttgcaatctttgtaactctttttgcaattcctcatattgtcctttactcaccatgacagccccttgcgcttggaccaattcagccagctctacatcactcatgggtgttttccctgtttcttccaccaccgcaccagcaattctttcttcttgagttgtttcattacctcctgctgctgtggatgtcttggccatctctgcccactgcttatcaagtgtttccgttgctcttgccaagtcactttcttccactgccttttcccactctctctcgagtgcagctgtcgcgcttgcaaaagctcctgtatagcgtactggcacagtcttctgtcgttgagaacgtcgcatttactgtttgagcccaattcaatggagactttccgtccccacggacggcgccactgttgtgaccttaggtcacgaacaagatcggggataggccggaaagaagtgttttcccgcctatccttagaaacgagctcgaacagcaaacacaacttttgaggattacttttgtattcaagatgtcttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgggctgcagga

SEQ ID NO: 75109 - DNA, 11584 bp, Oryza sativa
ttgatgtgacactctggacgaggaggcgccctccgttgcgtgggcagcacgccggccattacgccggcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagtgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagtgcgccctggggcgtgctgccgtcgccgtagacgaggaggcgacgctccccatctcgccgcccttccctatcacccgtggatgtcgaagtcgcggatccttcgaccctctcgagcgcctcctcccgcctaggactttggcgtggagggggcggtggagtacgagctcgacggcgtgggttctgctccccgtcgtcaccgctaacactcggagagaggttgtgcgcctttgcttgttcggccattgggctgaacaggaaaagcttggcgcacacgaaagaatgcgagagcttagaaaaacacacgcaaagccccctacctggcgcgccagatgacggagcgtggggctcctcaccgggagaccgcacaggcccccctttgccggttcggccgggggccctgggtgagattctaagctcctggtctgagtgtggaaggttcgcgagagtggaaacacacaagacacgggcgatgtatacaggttcgggccgctgagaagcgtaataccctacttctgtgtttaggtggatctgtgtatgaagaagctacaaaagagctggagaaccagagagctcttactttctccctctctgatctttctggatccgaaaatcccccccttctaagtgggcaaggtcctccttttatacctcaaggggataccacatgcaccatctctctcttttttgtggggacttatcctatcttttcataaacagacggagacttgtatggttgtcgtccgaatgaccttctgatgggacagcccatacctacctccacttccgccggaagcaggcgcgacgtgggaaaatggctgtctgctgacgacatgaccagtgtcagaccggtcacaaatcggtcattcttgtccaccacgcgtcagtctataaatctgcatgttcgcccttcttcattcaatatcttgcttgtaatggttaggatgaagcctggcatatatctgaccggaaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaatcgcaataaatgtggttaggtgagccccgctatgctcacctaccccatatacgcggcgcaaaacccacaaggggtcggggcgcctcggccctcggggccgagacgggagcggtccaacccctcggggagacaaagagaagggcggtcgtatcaccctcgggcccgacccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggtgtgacgccacttcctaaggcctggtgacatggtggggccggtctaaaaatcgggacaatccggttcatttttcctggagatatggtgatggcgctttggttggcgagcgtaattaacgcgcgcacgagatgttccatctcgactgcccagccgcatgtccacctcatgcaccgcaaacgggcgaatgggattagtggaagcgtgggcgcgagaaacgagggggcaagatagtgggcgcgagaaacgaggagccgggcagcgttggcaagggtataaagtcgccgaggaagagatttgcttccttcctctcgccattattccccttgtcttcgccgcttgcgccctaactccttgtttcctgtgccctaccttcgccacacgcgctcactcttaaacatctcttcctccggcgtcatggcacggggctccgctttgcttgatggtagcgtgctgccgccttcccgcatcgtgagcgagaggcaggccgggctgccgcgccgcttcatgccggaatctgccaccggccgggagatagttacgctgggcgagggacgcccagcgccatgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttgctgttccggtggttcttcaccgtacagtcggtgtcgccgccgtcggtggttggtggctgctacttccaaccgcgggggccggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgcctggcgggcctgcgatccctggggctcacaggggccatggtgtacggcgactatcttcgtcgccggatcgcgccactccagcggcgcacccggggtgcctgggagtacaccgggtccgaggactgtatgaggactcaccagggagtcagatgggactgggctcctgaggacttcaagatagtggtccaacgggtgctgaatctcagctccgtggaggcatccctcattcctcaaggagtcctccccctctgcagcgatccagaccgcgccttcatcctgaccattatgcaggcggtcggggcgtcggaggagcgggctcctcgaggccacgatggcgcgggcgggagccgcaggggggaacaatctaccccgggagggggtcgtgcttctgggccccgcgacaggggcccggggagcggccgccctgccgacgcccgggggaagaggaagcaggaaggaacccctcccccatctcctccccgagggggcggggcggcacgtgccagcagcaggcgcccggaggggccacgccgacgtcgcagcccgagggggagcggaagaagaaacggccccgcaagatgggggggacagaaccatctcggggaaaccttatttcccctccaaggtggtcgtttaaccgacctcctcgcaggttcgtcccacgcccatcgtggccgtattcattccctcaacgcgagttttcactcatccatcttgtttgtcttctggtctttcttctgtttcagcgagatcccgtcgcgtccctcccgccatcccaagtccggccagtctgcgaccacagaggctcggaggcgggaatctgaccggcgagaagccgcggatcgcctacgggaagccgaggaggccgcccaggtggccgtccgagctcgccaagctgaagaagccactcgggaggaggccagacttcgccaggccgaggagacgacatcctccgaggcgacccgtgaaactgaccggcaagaggccgcggatcgccttcgagaagccgaggaagctgctcaggtggtcgtccgagctggccaagctgaagaagccgctcgggaggaggccagacttcgccaggccgaggcgacgacgacttccgaagcagctcgcgacgaggccgcgggcgcatcgctcgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaacctcttctgcaggccttggccgtcgctaacaccacggtgttggacgggttaagtgcccagatggaggccttgcaagcagagcgggtggagctcgacgccgcatgggcacgtgtcgaagaggggcgccgctcggtggaggccatggtggaggtgggccgcaaggcacaccgccggcacgtctcagagctcgaagttcgtcagaaggtgctgggggagatcgccaaggaggtggaggaggagcggggggctgccctcatcgccaccaccatgatgaacgaggcgcaggacaccctccgccttcaatacgggagctgggaggcggagttagggaaaaagctcgacgccgcccggggggtccttgacgctgccgctgcccgagaacggcgggcggcggagaccgaggtggcatcccggcggcgcgaagaagcccttgaggcccgtgccatggcgctagaagagcgtgcctgcgccgtggagagggacctggcggatcgcgaggccgtcgttgctattcgggaggtcacactggcggtgcacgaagccgcctgtgccgaagaagagtccgcgctccgcctccgcgaggacgcgctcaccgagcgggagcgagctctcgaggaggccgaggccgcgtcgcaacggctggtggacagcctgtccctccgcgaggctgcgcaagaggaacaagcgcgccgtaatctggaaggtgcccgcgccgagagggccgcgctgaaccagcgggccgctgagctcgaggcgcgggaggagctggacgcgagggcgcgcagctgcggggcggccgcgggcgaaagcgacttaaccgcccgcctcgcagctgccgaacacaccatcgccgatttgcagggcgcgctagactcgtccgccggggaggttgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctctcggagatagccgggactctccaacggctccccgaggagctcgagaggacgattaagtcatcctcgagggatctcgcccgaggagcggtggagctcgtactggcgagttaccaagccagggatcccgacttctccccatggacggcgctggacgagttccctcccgggaccgaggatggcgcgcgcacgcaggtccgggacgccgccgaccatattgtccacagcttcgagggttcggcccctcggctcgcgtttgccctcaacttcgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagagaaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctacttcaagtcaagatccttcaaaaggaaacaacagcacagatacaacctttaggaaatcgaaaatgcttttattgaaatacagatataagagaaataagaatatgcatatgtggtagcccccggccaaccttgcacgcccgaggggggtgcggggttggcccgagcccgaaacctgacacccgatccccttttaggggtagaagcgacgaaggtgttcgatgttccacgggttaggcaactctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccaccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctctacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggatccgcattcgccttcatggatatcagcaagaagctcgacgccttgttcccgaggaatgcatttcaggaggattccgttagccgcgcgccgatagagggtcccttctaccagcacatagcgtttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcttcgggggcctgtcaggcgcgtccgtctcccctaaggggtcgggtcgcgccgacggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagcagccaccctgagtcccgcaaggagtccctcgtactctgccatattattggtcgcccgaaagtcaaggcgaactaaatatctgaggacgtctccgctcggcgaggtcaacgtgacccccgcaccggcgccctgaagagacagggagccgtcgaactgcatcacccagtgggcggtgtgaggcatctgtgaggggcccgagctgacctcggggactgagacgggctcgggagctggggtccactctgccacaaaatcggcgagggcctggctcttgatagcgtgacgtggttcaaagtgcaaatcaaactcagaaagttcgattgcccatttcaccacccgtccagtaccctctcgattatgcaggatttggccgagggggtaagacgtaaccaccgtgacccgatgcgcctggaaataatggcgcagtttcctcgaagccatcagaatagcgtaaagcatcttctgggcccgagggtatcgggtcttggcgtcccggagggcctcactaacaaagtagacgggccgctgcacctttcggtggggccgatcctcttcgctaggggccacatccctggggtgctctttgtccaagcggcctcgcggggtgcactcgtcttctgtgccgacgacctcggggccggaggacgacaggggcggccttcccacagtggcctcgaggccgtcctgggggtcgggggctcttggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcctgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctacgcttgttgggggggcgcatccgctctatagttcgtatcttctcaaggttggcctcgatgcttcgggcagagaccaaaaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtgcgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcaccagccactccggatggatgacctcgcggatgaatccggcttccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgtcggtctccatgcgaagacgtcagcgtttgcccgcaggaaagagacgcgcgtcttcctatttgtcgtccagaagaccaccgatccgtgtggtcttggacgggccgtcgcccagggcaacctccttgaccgggacctcgtcgcatgtgactatccgctgcctcggggcagcgggggcggaggtgccaagcctctcgtcgcctccctcgggcttggacgcggcggtgaggtggtccgcgcgctgctccatacaagcaagcgcgactttgaggtcgccatggacagagttggggccaccggggcccggcatcttcatctggaggtaggcgtagtggactgccgccatgaacttcaccaacgcgggcctccctaggaccgcgttgtagggcagactgaggtcccccacatcaaagttcacccgctccgtgcggaagttggcggatccaccgaaggtgaccgggaggtcgatatgacctagcggccaagtgtgacccggcgtcacaccgataatcggctgggacggccggagcaccatccctggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaagcctaggtcatcatcgccgtcatcgatgtcctcggcgggggccttctgcttggcctcacttcgccgattgccggaaggaaccgccggggacttgccctcttggcgctcctgcctcctctcctcctcccacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatagtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcctcttcagggccatgggaaaaaaatttgccatgaccctgttttcaccccctgcagcctagatcccggtcgtgtagacgtggagaaactccgcggggttgacgctcccgtca

SEQ ID NO: 75110 - DNA, 17887 bp, Oryza sativa
tacacacagaggaagtcacatgcctagcaaagttccataaatatttggtgcaactcctgcaacggaaatcattatcttccataagttgggtagccattgttgtgggctcgcgccatgcatagtcgtccaaaccgcagtactgcggtaccattctttaggttgagaaagaggaaagggttgtcacttacatgtggacaaactattttaatctctcgagagaatatcccctcatttttttgtcactcaaatgattattaaaaaaatttaaaaaaaattgagaaggtgtattaacatgtgatataacactccacaaacatgtaagttcaaattcaacttctacatctcgtaaaaaaaatgaattaaaccgtacatagttaacgtatattcagagtcaaatttgttttttcgttgcgagatgtagaagttgaattttttacttacatgtttatggagtgatatatcgcatgttaatacatcttctcaaattttttcatattttttcataaccatttgagtgacatacaagcaacgaggggatatcctctagagggatcaaaatccacttccatgcatgtgggtgccactttttttaaaaaaaaattgtttttaactataatttttcatgtaagtgccatgcaagcgtcatctaggatgaagagcaagtgaacatatcatgtagacatcatatcagctaaaaccgttttaaaaaagagtcaaggatgtcaatacccggttttaatagttaaaagagtcttttgtgatggagggacgcgaatcaaaactcggtccatagctaagggatgcgaaatggaccttttccttcttgtgatccagttttataaattgagagacctaaagtgaacttattccacccaaccgtcctttggtattgggccgagctggatgagtcggcctgtctttttggcaaagtcgcaagtgtactgtactacaagtctacaacaatgggagacgttggtagtacttcatcatactcacgccagtacgccacgatctaccggggatgaccacaatatcgaaccattgtacactgcatggtgcatatgcttctgagaggctgagacagatggacttattactggcgctagcttagccttatcccaagtcgtcaacgactcaatctcctatctacatcgccacgtacgcatacgatacgagtagctacagcaaattaattaagctaattaattacactgacatgcacgtccacgtcgctgtctgaagaaccatcgatcgatcgcacggtcagaactgcccggcgccgagcgggcacgggtccgtcgacgtcgtcgtcgtcgatcgatcgccggcgtacgacggcggcggcggcacgccggcttcgaggtccttaatgcaggctgagtcggggtggatgtcggcggcggtggtggcgttcttgtcgcgctgctgctgctgctgctcgtggatctcggcgatgggcttgagcttgcgctcggtgatggcgatggagatgtcgttggggaagaggtcgcggtggacggcggcgtgcagcagcgtggtgaggaacagcgccgtgaccgtgagcgtcgccagcacggacagcgcgatgcagagcgactgcgtgaacgcgttcttcacctccgacgagtaccggatcgacgcgatcgccgcgctcgtcatcgggaacgtgtacgcccaccacgccagcgagaacctgaaccccctgaacaggttgatcctcaccgcctgcacaagcacacccaacatcgatcgcatcagctgctcgctgcaatggcgcgcggcgtagaaagctagctaggcagtgtcagtgtgcgcgtgcgtacgtagcgtaccagcgaggcgtagaggaacatggcgatgaagtaggcgacgcgggagccgtagccgaactcgccggtgatcctggcccaggcgaggcaggcgacgctgggggcggcgacgaagaggaagaagacggggtggaggtcgcgcgggagcgtctcgctggtggggagccgctggtacagcgtgacgaacagcacgatgtagtgggcgagcccgacggcgaagaagaagatggggccctcgcggaggcccatggtagcgccgagcagcgcgccgacgaagttgccgacgatggacaggtggttggacgggttcgccaccctcgacagccgccgctggccaccggagatccactgcccgtagatcttgagctccaggcacacgatcggcgccatgagcaggtaccacagccagtgcgggaggctcgccgccaccatcggcggcacgccgatggcgaggaagaggcaggcgatccacggcgcgaagaagaagttgacgcgcaccgggtggtagtactcccgccggacggcctcgaagtagaaggcgaccttgcacgcgtacagcgccgacacggcgcacatgagcgccacggagacgcaccagagcacgaggttgatcttgacggtgatgtgcaggaacctcgtcgacgtcgagatggcgatgttcttccacaggatcgcctggctgctcatgcccatgcacatgccgaacgccgacaccgggaaccggagcaggaacggccacgtcttgtccgacggcaggaccagcgcctccgacgactgccgacgacacgacaccaacaccaccaccacggcggcgcgttgtgagcgactacgtactagggtgcatgccaactgttcgaccaatgcgagacgacagggagagggttgctcatggtgtacccgtagtttgtcaagctcggggccttccagcgccgcgaagaagcgctgtactctcggcatcgacgagtacgaccggctgctgctcgccgtcgtcgccgccgccgccgccgccgccgccgcgtcgtcgtcctcgggttcctcatcctgccgccgctgctctggctgttgctgctgctgctgttgccggccgcctctcaggtgggtggtgatctgcttctccagcttccctgaccacgtcttgaacgagtcgtagctcgtgtccctgcgcccgcgcgccttgcccgtcgtcgtcgccgccgccgccgccgcgcgcggcgcgccatcgcggctcgtgccgtcgtgcacctgggagcttctgctctgctggggcagagcggccgcgccgccgaggacggcgatcggctgtgagcggaagatcatcctgtcgggctgcgcgacggccatcatcgccggccacccgggcagcggcagcatgcacggggcgtccgtcatggcgtgacgctggagctccaccccggacctggcgacgtcgaacccggtcggcgacgccggcaggctgatggacaccgggcgagccgcgtggaacgccagcgtggtgtccggggaggacgccatggcggtgagcaggtcgccgccgtgccgctcctacaccggcacgcgactgttcatactcgtgctccgatcaggtgatctgcgttaaccatgaagacggcccgaaacttaccatgaagattggctccttggcagagcggctcgccgggatgtgaacatctccggcgaccggccgcggcggtacaccggattcgtcagcttccatcaacctcgggaaacctgcaacacatgtaaaccatcatcatcataagaagaagaagaatcaagaatggatagttgagatcacattgttttagtgtccaagaacagatacaactaatgatatttcagccatgagatgtgtcttacgagggcacactttgcaatgcggcttaggcaacgacattgagttcaccgtgagaccaaaccaagcttcgaactttctgcttgtcttatcagaatcagaagaagattctgtccgcttatctgaactctacacaagtctcgccaatgttttctgctactagcttgatcagtgagtgcatttatacggcagcattgaatgcaacttcaaaccagcaacagtcgtataactcacggggcagcttgattaggcagagattgcaatcaaatgcagatgcattctgggccgtacaaatgtgtggcgttcgtgcaggacatcaaagcaaaccttggcacttgtggcactcaagttttggttctgggcttctggctgcaggtttagcaatgttaggcagggaattccagagacataaatggcagaatctgtcctggatggctggtaaccctcgcaattggcaaccaacattggtctctagactctagtagtctagtctcatcactcatcagctcatggttgtgaagagtgtgagcaaatctgggtaagataacagtaagtcagatacatcgatgatggcatctactgcaaaaacaggctcggtataggcaagatgaaatgctgcccatcaggcagggcagggcagggcacgcatgcagtgcaggaaagctctgaatgtttctaccagttctctgtctgactgctaatcttcggccggtctcagtaaaaatctcaacagcatgaaattgaccactaaatcatagtgtttttgggagtcgtcgatgacacgacagaatgtgctcgattcgcttatcatacatacactgtcctcttatttggacgcatctctacaaacaagaaaaaagtatgtgaaaagtatggtgtgaaaacttggttatgcagttatgctactacttctccggttaataactgcataccccgccggtcatatatggggttcacatcctctaccatactggcaatatggcactaccattacaggcactgacgtgtgggacaatagagggtgggacaaacataacagtaactgtaatgatagtaatattatagtagaggattctcacccatcagggacaaaaggaagcagttctaaaggttttttttttgtaatgtatcttcttcagataggcacctaagttttaatcttggcatatgatctttatatgataaatttatctggtcataatatcatactaaatcattaccaaatttcatgaacggatgcatgcataaggacacctgttattgtgctgttatataactctttcagcaatcaccatcaaccaagatggaacagaaaccgaaaatcctctccgaatttcctctaccctgccccattcttgcatgtaaacgcgtatctttctatgatcagcgacacctacaaatgaactaggccaacagcaagctttctgaactgaaaacgaactgcctgcacgatctggcagacaacgcgatcgagctcaaggttttccctcccatcactgacagcgtctcactacccctcctaccgaactcaagaacagcaggccatcgaggtctgaaagtaaaccacgccagagacatggcctctcgtcgctttcagagaagaattctggagcgagcgaaaacaagagcatccctaactggcagggcatcgtgatggccgagaagcgtgtcgagaggaaaacgaaggcgtgtgggctatgcggtccgcgtgaggctggaaatttttcaggttcagcaaaatcgatctcaccaaaaaaaagagagagaaagaaaagcattttccatcggcatggtggaaggatgattacccgggcgggatgcacgtgggggaagggaagaatgcaggaggagtccggtcatgtcggcggcggccggcgaggtggaggcggcggtggtcgtgggggcgcggcgcgcgagctgggagccgccggagcggcggcgatcggtggtgggtggccgcgaaggtggcgggtgttcttctctctgtgtggctgcttgtggggctggagtgtcggactcgaggtgttggggggggggggggggtgtccttcgtggtaatcgtggccgtcgatctgggatcccagcgcgaggaatcaacggctcagcttagccgggagccttctctcggggctggtccatgtgggcccccacaccccgggtacgtgagaggctgcgttagcatgacatgtggggtccaagccgtgatgacctgcggtgagtgactctgggcgcaaatagaattaccgatgcatcgtgattcgtgcagttaggaacaatagttctgatgctcctacttcgtactacttcctccgtcccacaatagttatgattctagattgtctagaatagattaaagtttaatataaaagtttataataccccttattaaataatgtatgatgagaagtggaatggttattgagggtaaaataggaaaacttttgaatagaaagtgattgataggacaacaagtactccatagtgataagtatttggggacaaaattaaaatcttaaagagacaagtattttggaacggaggtagtagaacttatcactcagtgttagagcaagtttaatatagccaactatcggctccaaatcatatatagtcaatttaatagccaattcatacaatagttacctataaacatgtactacatcattaatgtttggtaccacctgtcatacacatacgtatcttggagtccgtcctatagctggctacaaatatgtagcccgctactcttatctcttctcttttatctttttaaaatatgtgtatagctggcttacagtttactattatacctgctcttagtagtgtactctctcggtttctccgtaaaaaattaacttaaaatctgtcaaaagtccaaatttattgtagtaggacattcagtttgaggtttgtttgttttacggaggaagcacgtgtagaaaacgaaagatttttggagattctagagacaccaagtgaactgacctcgagagttttgacagatcaggcatacacagcacacattgtgatgtggggagctcttgacgtgggttgcagaggcagctctttcgcagcttcgctcgccttgtccgccggtgtgtcatgtgtgcgtctctctctcagcctcgcacgtccaatttatatacggaagtttacaccacctctggtctccattctccagttatgcggagtaacatccttacagtaacgaactaccctctccagtctagtagtagtagggaaaattacaaaaaccatttctaaaagttatttgaagtttaatatttcacctcataagttattttgttgtaaatatccagttatccaccttccactcggtttcgttgtaaaaataaccccagtgtgcacatgcttaactgaattaatatgttttcgtaaattgcaagttgccaatatgatctttaccaaaactaacaggtggtccgctcaattacacggttagcatacgtacaaaattatatatttttaatatgatttttacttaaaatttactaaacaactatctcgttgtcgtaatactttgaaaccaaaacttatcatctccatgattctacttttatagtttttaaaagtcacaccagttattaccccttatttctatcacctatttctttatttgtttgttcgatatgaactcttgtttttgtttttatatggactcttttttcaatattgtttatttttaatttagaattttagttatttctaaactgtattcctacatgagctctctttctctttttcttcgattaacgtgagaatagcatccacagcgaacgtgatatctcatttcaaaattattttaataatattatagattaaatacattacgaccaacaaatttgttagccacaagtaaaacaaaatttaaaacaaggtaaaacagaacctgacatatacccagagaagctatatacatatgcttgccatgactcctgcgattaatacaaacctgactgattattgcggcatgtctaaggtggttagacatagtaaagtaaggttgcgaaataaacatatcctaggtttttctttaaagcatcattagcacttgacatgagtgcatgaccaggcaggtatacatacagcctagctaaggagagtgtcacaccagactatgtggaaaaggggatgtcaaaatcaaggtcatttttgcaagaaagatgaggggaagaaaagcgcaaaagagccaaaggtgccacgctttaatttaaacgaaaggacaaattctgtataaattattactatctccgttttttaatagatgacgccgttaactttttctcatatgtttgatcattcgtcttattcaaaaaaatttacgtaattataatttattttgttatgaattgttttatcactcatagtattttaagtgtgatttatatcttatacatttgcataaaatttttgaataagacgaatggtcaaacatatgagaaaaagtcaacggcatcatttattaaaaaacagagggagtacaatctaaaaggtgaaaacaaaaggggaatagtcaagcttggttacttttttgaaaaaaaaaaaagagagagcacgattaagtcgtttttaacctttagcaatctgaattacattcaaaatagcttaaaccaataatagagttcagatggaaaaaacttgggatattgatttgtttataaattttgagtgcgagcgccccttgtgtgagagatcaattttatttatttctttctttttttgtaaattgagtttctggcgacaaactaagaaactaccttgttgcgataacatatcattttccggacatgttttaagttaaaccttacaaaccttgagcataaatatctttttaaatgcttatgttggatgtatgaaaatcgtatgtttaaaatcgccttgaaaataactttaataatactatacttgtattgctttttatttttctttttggcagaaattagtggtcagccgcattttaaagaacatgtctatgttcaaaattcttgtcacccgcagggaggagcacgtttttttgcatgcgacctttgctttgcttcattgacctgctttctaacccgtcatgcccaaatgcagaaaagaaaccgtcccagcaaagtcagagggttacttgataagcacagttttctcgaaatccaggaagaatcaacattctttcatcataatagaatgcttcgtttcctattaggcccaaaaaccaagtgcacccaataattcttcaatgactaaagcggcattattttttcatgaaagcaataagatatctttccataattgcaagtatcatcaaatttgtcattacgagctttaggattcagttgttggtctgtgtaatcactaatcacctcaaagagataagaaaatgggaggagcaagcaagcacaacaagaaaggcagcaggcattatgccgtgtccttattactctattatagagatatatagtactgggtgctaatgccatccaattcactaacctcttgttttctcctaatggtgtccacgattttttcgttggccatctttttctcggggccatctatatggctcatcataggggaaaagctgaagtcctaaccaatagtcccaaaatgcagctgctggaaaagtaatgcatggagatagaaatggtcaagcactcagtatgaataaaatgtattgaaatgataagctaaagaacaaatccgctattcatctaagctatcatgttatgaagttatttgctcgtatctgttgactattgctagatacagttccaagtctagatttgccggtccacttcttagtcctatcttactcagaaaattgaatccaaaacattcctcggtttaaatcttcaccagggtatctgatccaacaaacacaaagcttctcagaaactttaaacaaagtagaacatatatatttttttaaagtgctctcaggaccgattgcatcgtagataaatattcaatgaaaacctcatattaaagagatatatagggtaaaatttaactggtattgtggtactaactgaataaacactataactataattaatactaaggttatgttatgaatatgtaattttcatacaacagtgttttagatttcaagataatcttgggctgaactgggagtttgatcaaatgctgaaacattatagctcatatgctaagctattcatttctcaggtggtgattcatgatgcaggttactatggaatatcattaggaagggggcaaacgattcctaacatttattcaaggtatatcaccagcctgttgaatatatagcttacagtctaagcaacagcctacaatagttttgtacgttcagttcaacaccataagaacagatgggtacataagtataacatgatgtctccatgcattcgtaacaattagagcagtggataggaacaacactggttgatctaatatgtaaaatcccattgattttgagtcacgatctggtagttgtcatgaactactcaacagatcagaaaaggacctgtggccagtaatcatcacatagaaaagcctccaccatgtctgcataccattatcagaaaagggatgcccattctagcatttttcttcattttttcttgattccgaatataaaacgagttcgcaaggctgaattgtatacatccaatttggtccttggcatgaactacaataagttctctttagagaaggcaaagaagtttaatggtgtttccaatgtttagtacttgattacatagaacttacaaagcaacacatttgaactacaatggtgactcaagactgcagaagtggttatcacttatcagaagttcaggactgggtcactgacagtatcaatcttgccccacagtcaacaaaattgattaaaattttcagaccataagtggagcgtatcatggatgtgcaaaaagacatcctggaaaaagcatagaccggaacacaatttcttcgtaatattttttttagtgtttatgctggtgaagaaactcacagggccttatattggataactcatgtgaaaccataagataattaagtgtttaactgagggttcatagtgcaagcaattgaactttgcttagtcaatttaattttcatcaatgcaattggctacatattaaatcaaatttctgcattaatagttgacatgaaggggaaaaagtagcaactcaaacacctacttgccttgtgataaccttgaaaacttccagtggttaggcagaagaagattaaattcattacagctaagtggagttacttggacagttgggctgcactaaataggatgcccatacttcatcagctggagggggtggctgaacccagtgcccaggtattcggctgcaggcaggtgagacaattgcattgttaaataagagaatgctacatagaattcgtttcacatggtaaagcactacaatcgagagcacaatgtactaaatcctatcatcagagcacttcaataaaataacatgaatgctaccataagttattagtagatggcttgaaagaaccacaggacattcagcactataatgctatcccagtactgaaattacaagaaagcgttccagagtactatacaagtagcccaacaaacttcgaatgtatccaacaaccatcattctgtttactaaaagagattgcactttcctatggcataaacctcatatataacccaaatcaatagaacattatatattctcatgagttctttttttctcatcttggtattagttcttcagagaatcagcaaaatatatttccattgttttttgttgtatggcaaagatgcttgttgagcgaatttagtttgcatattatatttagcagagtgaaagtcataccttcctccagctctaataaaggaatcccacatcctgcggacctgcaatcaaaggtggaatacatacatgatggctgagtgaatctattgagtaattcccaatcaaaaaacatattgagtaattgcacatttgcattgatatgagaccatcgataggatcatcctaaaacattcacttggtagaaatcacattaactgattaacacataaagcattcgcaaaactcccagatgagccaattatggtattcaatggaagtgtgaaacccgccatgccatatctatgactctgatagattgatatgtaaagcctagttcagaattttggctgtgatagactgatagtgcaaagcctagttcaaatttacactgtattattcttatacactccacaaaaccttaatggtagcatgaagttgaaaagccagcataagttacctcaatgagtgttcccatgtcgtagctgcttccatgataataatggtagaactcaaaaggcagactggaaacagaatcataatgcccatgccctttgctgtcatctttatgaagttcatgctctgttttttggcttgcatgatgatttctgccgcttattcctggatctctctggttttgttccagtgttggtgcacttttggcttgatcagaatcatcttctcttgaatttgaacactgcacagccttcctcgactcttccgcggtcagaatagcatccttggcagcatcagtccgagcagcacttgcagcttggcgctcctcttcctcaactgcagccttaacacgctcaagatatttatcatcttcttctggcagaaaatgacctgaaatatattacatggtaactcatgcatcagttccatgtgtttaggttgatcaactgtactaaaacaggggaaaaaaataactattaacaaggaaaaggcaaagtttgcaggtgattttaggccctgtttgattcagcttaggattattataatctagcttattaggagtaagctgaaacaaacaagtagataattatagcagattattataatctataagccagattattataatctgataagctgctctagaggagcttttttcagattattgagtggctaaagacccactacccctacatacttgagaaaaattactcacctatgccatcaaccgaacagatagctgagggcattatagactttagcctttcaaacccaataatccatgccttcaataatccagacaaacaaacaactcacagcttattctatgccagcttattataatccagcttatagtaatctggcttaataatctagattataataatcataagctgaaacaaacagggccttagtgtgttcgcgcgagcctaccataattttatagcaaatatttttgtgaagttttcagacaccacccatttggacaacagattggcaagaaatgcattagatatgacagagaagaatgggaatgccaaaatttggcaatcatttaaacaagggacaaattcttgaagcattacaatgtgattgacccattacagtaagattgacccccatgtattaaccatttcccacattttgcacctctttagattatgactataggtttgacggactcatatattgaaataaataaaaagaaggaaattcttaaaaataatgggtagatgaatatatcctgccttgtttcttcattttttgaactctcatagagcgaagctcctgtagtttctcgaccattagggcaagctcaagctgaaaatagaagatttgtattgagaaaattagttttctagaaaacaagactattgtatttgccgctcttgaatttacaatttctacagagaatattaatagtttggaatctaaatataacatactgaaataaccactcaagaattcacaaactgattgcacaataattctgaatgaaagaaaacaggtaggtaggtggtgtaattgaagatgttgggttgcagcatatcaaacacaaatatacaagactttaagaaattttagaagcaagcttatagagtttcctaaattcgtagaaaatcagataaggtcaaagataaaaaatggtgtaacttaatgcttactacaacttaacaaaattcataactcaaggtatcacaatgtatagtaattcagcagtgtatgaaaatgaattaatgaaacatagcgctcacaatttccacgcagatgtccacagacaagcaggatttccacaccacaatgtaagcattaactttacctcagattctagacgctttctttcctcatttgcttttttcttggcaatctgcttcatgttttccacctgatttcacagtatcaatgaattgatcatctgtggagcaacagtgtatcttacccaaaacaaccccactaacaaaatgacaaattcaaaaatgagaaagaaccttgcgctgcgccatgtccttggctatttgcctagccctccattcatcagcttcctgatcaattctgtcataatctgcatgctcctgtgaaacatcaagacaattgatgtcattatggtcagttgtcactttgatttgatcacaatataaacagaaaaacgtattgatgagcgcaccttctggaaaagctctgcaacatgctttctttttctctttctccatcgcttatttctcttggatttctgcagcttctgagctaacctaatcattgcatacctctcttcccaaggacccccttggttcacagcaggataaataggtgcaagaaggttctgaatctgagaacaaagataattagcagcatctgtggccagagactcatgagtgtcttgactaatcttcatagctctagcaagctcaacgaaatgccggggcctatctgcagaagaaccatcaggctctgatgacaattttgctgaagacgagtcaggtccttgcgtgctagcatcgaccgagtttctagcctgcgcaatttcctcgagctcatttatcctgccaattcaattccattttcagtccacaaaaaaaaaaggtctaataaattagcaataaaggaaatgccttcggttttgagacaaagttgcatgattatcgctagctttaggcggttcaggaactcacactgcagtggctaattcgatggtttcctgcagcctccccacatgctcccgcacattgtcccgctgccaaaaggatgtagcggccggcggctggaaaggcggctgccactgccatggctgatgctgctgctgctgcggcggcggcggcgggggtgcgaccccgaaagcacccggtggtcggaacatggcgggcagcttccctcaaaatcccctcccttaggtcagttcaccacgctgcagttgaggcgaggaacgggcggaatcaggctcaggggaaatcgagtcttaccagggggagaccgggggaggacgaagaaggtgacccctgcgacggaaggcggcggccctcgcctccgccgccgatcgcctcgacggtgggctcggttgcggcgggcgtttcgcggcgctccgccggagcggagggagaggggaggaggaggaggaagccgcgggctcgctcggtggagtccaggaaacgaaacgcacggcccagtggcccacgtacgtttcgcctcctccccttggtgggccgcaagaagaaggcccgtgccgcgaggacgcgtgccgccgggtgagagatatttttctttctgcgtctcgctcgcgtcccgaggcgtgtgcatgcgtgccacgtatcctctccgagccagtggcgcgctgccacgtcgcgctaggttgtcatcgtccaaagcacagaaaaaaatatttatcttttatagcttggttttgaagcacatgaactaatgaaggactggcggttactagagcgttcttcttctttctcaattctgcatctgaggctttgggcattttatccagcgatgagtctcgtcaccgcgtgctccggcgagagaggacgtgtggcaaacgagagagatgaaagaaaaaatccactttatgtttgtgtttagtttacactgatatttgaaagtttggaaatatgattgaaattggaatgatgtgctgaaaagttgtgtatgaaagatttgatggatggaaagttaaaaatttaggaaaaaactttgaaactaaacagggctttcgatgcgaccaccgaagacacctgagagagcgcgtactcgctcccggagtcccgacccgacgtgccgggtggcggcttcacccgcagctgaagtccgcggcctctgtctctgtgcaacccaacggcagttaacccgtgcgcccagcgcatggagcgcgcgacattgggatcaggtgcattctcaactacagctgctcctaagagcacccacaatggtaaagtaaggtgctatctataaaacatgtacatctcagcaatagactagattaatagtaaaccacttcaatggtatgtctacatgggtatctatagctctctaatctattgcctcgtttttctctatagactatctccaggttagtagatagctttcctctccctcttcatttaatctcttccaagtaggaaaatatgctgacatggatttcttgtagagagcctataaataactattgcgggtgccctaacgcgacattgggatcgggctctcgttaggagcttacacaagatcttgttcattcaatttttcaatggaaggtctaaattaatgctacagtaacattgttataataattttgtgctgttttgttataataattaatggatagccataatatgactgtctaagttgcagtccaggctaagaactgtacaggaaccggtgtagatttttgcggcgagatgcgttgcacggggacaccgggcggggcggtaagtagtacagcaagttgggggatgccaatgattcaaaacagtttgatcatatctcaagcggaggtgcgttggatcatatcggtgcatctgcatggggcatgggtatgggcatggccatgttcaggtcgccccggccggtaaaatccggggattggtgattccaccgcaggagaggaaggttaataatatagcacactgttagctccaatttatctatagtcaatctaatagctaatttatacaatagttgcttactatgctattagtatacggtcccacctatcatacatatattgtgtcttagagtccatgctacagctagctacaaatctgtagctcgctgctcttctttctcatcttttatctcattaaaataatccctccatactcgtaaaggaagtcgtttaggacagcgacacagtctccaaaacacaactttgacttcttatttctataaaaaaatatttattgaaaagtgatatatgtatacttttatgaaagtatttttcaagacaaatctatatatatataatttttatattttcaaactcaataacttgagagttattcatgatttatattaccaaggtttgacttaaacattatcctagacgacttcctttatgagtatggagggagtataaattcaaacatagatatatccagatttacaataggcctaatttgtctagtaccatcacaaaaatcacggagttgaaaaatactatagtatgtgtcattgacatgtgggttcggccccatatgtcattctcacatacgatggtattttctaaatttttcctttactttacaataatatgatgtatcgaattcagtatcctctctgtttcaaaataaattctctaactcacaatataagaatccagggcatctcctggagctagagctcaaccaaacagtttcagttctactataaatgtgaatggagctaggtggagctctctcaccaaaatgaactagagaggtggagctgggtttaggcagctccacaactccactccagacccaactcctggagctaaatttaggagttggagcctaccaaacaggccctaagagcaagtttaatagtatagcctactactgactccaaatcatctatagccaatgtagtaaccaattcataccatagttgcttactatactattaatatatggtcccacctgtcatacacatattacgtcttggagtccgtgctacagctggctataaatttatagcccgctgctcttctcttttactttatctctttaaaatatgtttatagctggcttgtagtctactattgtatcggctctgggaatatcccaacatccatgtgagagacagaaaacaggggaaggaaccatcacgcaattacagagaaacttgtggccccatacgcaaaacctccccccggtttggacagcgccacagtgcgccacctctccccgtgaaatagcccacgtatgcgccccgcgtggtcgccc

SEQ ID NO: 75111 - DNA, 20013 bp, Oryza sativa
ggatcgcgacgtgttggtcgcggctgtcgctggggcggggcgcgggcgccttttctcgaacggaaacagagattcgggcgtgcaaaccggacggggaaagcaccggtgcaaaatcagcttttcttttgtctctcggggcttggttttatcccccgagttccacacacggcaggcatagtggtaaagctgcccgtccccgacacagccgtcttttctcagcaacacgatatattgacacaagacaaccaaagtcacacggtatgcctacctacaccccccacatgaccccatcgcatgcacaaattctgatgggaaaaaaaacgagcaagaaagtgagagatgtaacaacactcccgagattacgagaaagggagcaatttactagagagcgacttcacatgggagatggaaatattttacatatgcatactgctaagctagcactaccagattattgagctaagacggcggcgagcaaattacagataggaacaagatgggagttcatcgcggccaaaaagacaatcttttgccacgttgagacaagccgcacacatgcacgtttttttatcacggcatcatgtgttcgatatcaacaactaattatactactagcgtctaagctacggtttgagcacggcgatcaccgtttgtccgtagcggcgaatcggccggtccgagtcaagcgccgccgtcaccgccgccgccgtccttggtgtcggcccttccgccgtccctcgtgtcgctcatggaccgcagcaatggcgactccgaccctactacagagagagatgtcactacgttgcgtgatagtgtcactgggaggtgggccatggaggggggtgtggtgatggctacctttggaggcgttgaaggagcgcttgcagtgagcaatggcgctctggatgccgtcctgcagctgcagcagcgagtcgtcgcggcgctgcggctgctgcccggcggtggatggcggcggcggcagcgacggggacggcgcggcggccactgcggaggacgcggaccggctcttgccgaggcgcttgcacacctgcttcagcccggctggcacgctggcgcggggcgcgcgcacgccgcaggcgacgacgaccggctgcggcggcgctggggccaccgccgccgccgccgccgcggtaggaggctgggtgggcgccggggagggggaaggggaaggtgacggcgaggggtcgggctccaggtccgtctcctcgccctcgctggcgctggcgaagcggaggcgctcgccgtagcggcgggagaccttgacgtaaagcggtttgatcttgttcaggtacttgagcagcatctccttcgcgaaccgccgttcctcggcggtgatggccgccgcctcgggagtctgcagcgcctgcacagccggcctggctgcgccggcgccggcgccggcgtcggaggtgcgagagctgttgtcgcgcgtgaagagcgagacgaagggcgcgtcgtccactcggaacttgatcaagaaacggttcgtcttcggcgccggggagccgccgccgccgttacattccgccgggacagggaccttcggcttcctgagcttcagcagcagcacgcggaacttagtcgccggccggaggaacgacgccggcggtgccgccgcctccgagaccagctccaccaccttcgcctctccgcactcgccacccggcgccaccgccaccgcgtcgtccacggtcaccacctcgccgccggacgcgacatcccccgcgacagagaagttgaactcgaccctctcctcctccgcgtccgacgcggcactctcgtcgccgggcaccgcgaactccaggtcaaagaacgacgcgtcgtcatccacctcccctcctccacctccacccccacccccacctccgccgtcctcgcacgccgacgcggctatggtggtggccgccacggcgccgcccttgttgccggcaaccgcgccgccgcgcaagaacttgaggaaggtgaacgtctccatgccacacaacacaacacaacacaagacagcagctagccgcagtgagcttcactcgtttctagctcctactcctacctcctactgcctcagcactgagaaaaggactcttttggggagccttttgagggtggaaagagagaggtcggagaaggtggtgcatcaaggactaaacggtgagatcgtgagatagtttgttccgttttcaacgtgcgctcttcccgaactaataaacgggtgtgtttctttgtaaaaattttctatagaaaagttgttttaaaaaatcatattaatctatttttgaaatttaaaataattaatactcaactaatcatatattaattactcatctcgttttgcgtatcttcccaatcttctctatcttccctttttcaaactcagcctatatagatgagagaagagagagcgggtcagtgaggtagtgaggtgctcggctcgcgccatcctgtccgttcatcgccgactcgacggtgatgggcgagtcggggtcaaacgatatgggagggagtaactgaaacatttgggacgagtgtcccaagtgtccactaaaaagctaaactggtttggtttttcggtttcgatccttttggaattttgctggcctttctcaccgtagcaatcctctgtatttgaaagagtcgttttgaattagaattttgtaccccctcctcatcaaatgcatgcttacagtacacctatagttcgttttggaccacttcatgttttcttcctaatttgtgtgtacatctctctggtcaaaatacaacaggcatcttgatagaaaagcaatgtatccattttctgtttctatcttggtcacttgatagttgagaaggataaatggccttgtttggttagcctaacactgtaatgttttatgtctaataaaggcataactaagggcccctttcaaacacaggataggaaaaacacaggaatagaaaaaatataggaattgaagtggtatgttttactaatcctacatgaatgaaaaacacaggaaatataaagagggtccctttgatagcaccataggaaataaacaaagcaaatgatagtttccaagaggttgaacctcttgcttattttcctatgaaattgagctataggaatacaatcttaaggaaaatttcctatactttcctatgaatcaagggtttcataggaaaaattccttaggaaattaaatcctccaaaattcctataacaatcctccaattcaaaggggccctaaacttagttatttcagaaggggtttggccaagaaagttgaagggatttagcataactagctagagaggatttggaagaaggtgcatcgtgaacattttatcgggtgggtgcgcggaacatagcttatatttgcttagagtgatgattatatatcatgttgtttgagtcatgcatatgttttctgatggcaacatcttgctagccgtgttaagaaaactatctttagatcaaacatgatagagctacctaaggtttcttttgcagtaagcgataataaaggatcttttgggattttgaacctatagtgtttttttttcctagccatttggaacgaaggagattggacactattgaataaatggaaaatcctatggaatacatcaatccatgagagtttcagataaaacataacatgtggttcaaccttacgtaaattatatatcctccttttttcacatggtttatccaactaatcatttttttttaattttctttttttgtcaattttttgagtttattttccctactcctatgttttctcaaccttacgttatacaaaagatccctaacttattttgggatatgaccatacgagagtatcacccgaacgatatctctttggcttggtctagccagagacaatggttagagaccagtaaaccaaaaccaaacactacactctactccctccgttcaggagtatatacagattcgttgtattataatatgtcattagttttatatttatttatttatggagggagcttatatatatgctgaaatttccatgcccatcatttccataaaccatgataccaggaatgattgcgtccaaccagaagcatgcagtcattggcaaacgatgacagtgacacaaaagagaacgctgcagtattaccatcgcaatgatatttactcgtttctttggagatggaaggccatgatggaatcatccaagcctgacacgaaaatgatgactcttgagatacagtatcacttctacagatgtgagacacagttgggacttgggaggcttgatcagtcgtcaatcatttggagaatggatgctgaacattggagtttgagcgagagccagtagttgcaatgtgcaatgcaaatttggacgtataatttggcctcgccaccggtctggactcctactatgtcagtccttttaatctgagacactaccgtccatttgtgaggggggcacttccacatttctcctaggagtacttcattctcaccaaaatataaaaatctagttgtacgaatttaaacagagactgttcagttttatggtactaagatatatcactgtccagattcacagtagtagtactatgacatgtcatatccaatatactccatccgtcatataaaataccaatctaatactccctccgtcccataatataagagattttgagtttttgtttgcactttttggacactcgtcttattaaaaaaattttggaattattatatacttttttgtgacttactttattatccaaagtactttaagtgtaacttttcattttttatatttgcacaaattttttgaataagacgagtgatcaaacagtacaagcaaaaactcaaaatccattatattatgggacggagggagtacaggatatggcatatcctaatactacgaatcatatgccacttccagttttagatttttgtttttttgggatagatgaagtaggttcttatgttttgggataaatagagtagctagtatctttcttttctttttttttctttgtttctgttgttgcaacaatattactgttagttgacttaattggcattttggcaatatgcaacgttgccctgcgctagagtgaagctcaaatagagaaaatttaccttgttttttcacgtacatatatacttttcgaacggttaaataatgtattttgttaattcattttttaagtttaaaataatttatatttaattgattatacgttaatggtttacgtatcttcttcttcctctcttttcactatcaaccaaaacacgcttgagaatgtatagtcactggtattaggttcgaagatgagaagagtagtaggcaagtagctcgagatagtttagctctctggtgtctaatccaggccttttggatcatggcccgtccacgtgggctggggtcggttaggcaagacgcggcccaaagtcgctacttgcgtgggccttgcggttgtgaatgtgcgtgatcgtgtgagctcaaagaccaacagtttccttatctatttcgctttaatttgaacagaatagcccccattttgtttttctcaactcaaaggcaggacgcaaaccgaatttgcgagatgctctactcttgctgcagtctgcactcgcgctagtttgttcatgatttctcgacacggaaatatgaataaaccctaaaccctataccctaaaccctataatcccagcgtagcattcaagacaattgttccttcttctcgtgacaagaagcaagctaggtacgctcgctagctgaaaaggcagccttagctagctggactacgtctctctcagagcaagtttaattaatagtatttggcttcaatttatctgcagtcaatctaataacttatttatacaatagttacatattataggcaaacttttatatatatattctgagcgacttaaaattaaataaaaacaacattgaaaaaataaaaattaacttttaaaatttaaatttagtaacagcttataattcgtaactcatagcgcaagggatgagaccttaaggagccctttgctagcgattcaacctgtaacaccagccttattttgcttcgtcagtattaaggccatagacattgagtcattgacgcgacatcctctttgcaatgcgattattccttttccacatgaatagtacttctccctctatttcatattatataacactttgatttttttttaggtttctttaagttagatcaattgttctttaaaaaacagcaatatttacaacaccaagttaattttattaaacatagcattgaatatattttgatatgtttgttttgttttgaaaatatcattacttttatataaacttgatcgaacttaaaaaatttgatcaaagtgtattataatatgaaatgacgggagtttcttttttggttaaaatagtactacctcattttttatatacgatgtcatttttcacataacgttcgatcattcgtcttattcaaaaatatattgtaaatatgtaaaaaaaatataagttaaggctggagttttttttataataatacaagttgtcagggttatggataccatatacctaatagtagttgactaaatctcggcaggacccaccacataccatatcctatacggaaacaacctgcgaatatagaaggagttccggataagggaagacaatcagagttctacatggaaacgacaagtactactcagattgtatccatattggtttccctaattctacttggacaggggatacctatgggtataaatacaatgccccctaggaggagaggggacacaaccacctcaatcgacaccacaatcaacagacacgggcaacatagacaccacaaagccaatacaagccaacatacgccaagacaagacgccggatatcggcttcagggataagcacggctagtcccctacggtgtctccggatactgtcaagagaaacgaaagcgctatctctgatctcgccgggcacagattcgaggaggaagactaccctgttgtcgactacgagtcagaccttcagaccgccatgtcgacaacagttagataggctaccccaaatattgtactggtatgattatggtgaataagatcaataccggcttcggccaacaggatgtagggctattagctgacaattcaggggcccgaacctgtataaaaatcctcgtctctatctcttttacctcagtctcgcgtataccctagtaccaacgatccccataccatgcaaataccggaatcgcgacatcaaacttcgacacaagtcacaataaaaacaaatagcatttttataattttcttaataagataaatagtcaaatatcatcataaaaattagcgacgatatatatttaaaaacggaagtggtacaccatgggctacggccctattcttttctccaacaaaagttggataaacttttagataaaagtgacatgcttttcaaactgctaaacggtgcattttgtgcgaaaactttctatataaaagttgttctaaagtatcagattaatacaaatttcaagtttgtaataattaaaactcaattaatcacacgtaattaccacctcgttttgcatgaaacactttatcttcatattcatcttcaggagattcaaacaccatctaatagtagctccggggagaagtggcggaaacaaaactaaaatgatcagcttcaatttgaatctgtagttcgacgagtttcaaaagatttaactcattaaagtgcgtcacaatctactactactctgtcaaaaaaaaagccaaccctagcaatgaacatgtgtctaggttcgttggtaggattgggttttttataggatagaggggataggtctgtacatttggtcggataatcggatcacacaatgcaccgatcgagggggggataaggcctggtttagttccccaatttttttttctaaaaaaacagcacatcgaatctctagacatatgcatggagcattaaatataaattaaaaaaactaattgcacaattagtagagaaatcgcgagacgaatcttttgagcctaattattccatgattagccataagtgctacagtaacccacatatgctaacgacagattaattagactaaaagatttatcttgtggtttccagagttataaaattagtttttctattcgtatgaaaaacctttccgacattcggttaaatatctaattacatttagcgaaataaacaggccataagtttgaagttgtgtgcacaaaaatgtccggattctccacgcggacgcagagacatttggacacaccgtacgtacccgtgtggtgggcccatgccacgtcggccattttgggatactagtaggccggatactctacaaatcaaaaatgacgcagagattccgaattcaagcagatcgtggggcccggtccagcagaaaagctggccgtccgccgcagcggtagggtagtgcccgccacgttgattccggggccctttttgacatcacccgctactctcctcccggtcctcctttctttgctagatgcacccataatgttacccccaacagtttatagggtcaattaattagcacgcacccataaatccatctactatcattataattatatttccttctttatcactttatacacccaaaataacgggtcaggattaagtttcacagatcaagattgatataacctgtcattacacagcgagagagagaaaggtggaaaggagcatccgacactatagtggagatggctattcacggtgcaatataattgtttgtggaaataggctatcatatagcacgaggatgtgagaattgacataacacggtcatattcgcacaatcatgcactactgtagtagactgcaaacaatgatcgtctcatactccttagcacaccacttatattatatcgagtttggcaagtttatttgagttagattaataatgctgcatccgatagtgtgggttggcttagctagttagtgcacggaaatcaaaacacatgattagcgaatgattatttaaatattaactatcataaacttcacagattatattcatttgatttgtaggaaatatctatattttttttaaaacatatcgtttaacagttcgagaaatgtactcactataaatgagaaagtagatcagctcattagagcaagtttaacagtatagcctactactagctccaaatcatttatagctaatgtaataaccaattcatacaatagttgcttactataccattaatacctggtcccacctgtcatacacacattatatcttgaagtccatactacagctggctacaaatttgtagtccgctgctcttctctctcttttttatctttttaaaatatgtttatagctggcttgtagcctgctattgtacctgctcttagctgataagaacccaaccttagactcatattggtgtagccataatggtggctgttgttttttaatgcaattttcacgccccgagaactattagggtaaaacaggattatcttttgtcactgaacaattttgatggtataacctcaaacaagtttttttgttctaaagagagaagttcattgtgacaatctagtattctactataatcgatagcaaagtttaaataaatactcctccatatctaaaagattgtctttttattgtgaatctagagtcctcaatagtgatgtccaggtttatagctaaaaagctatccaaattcatagccaaaatgatactatcttcgtcccaaaataagtttacttttgacacaacccacacataccaaacaaaaccagaaagacaagaatatccatactatcaaatctcaatacaagtattccttactttatcttcttccaatacatcaattttgtactttcacaaactttgatgcaatgatagctttaaaaatgaacttattttggtacaaatggaagaaactaaaaatatgggacggaggaagtactcatttaggagtaacattcaagttcatagcttttttttttgagacggagctagttgtactcaatatagagaaaatatatttgattttgagaaaatgtctttcaacgttaaacaaatttgagataagggagcatgtggaaaacccaaatcgtcactaacatgatcttaaccaactttataacctcaaacaagttcttttttttaaaaaaaaaggaaaaaacattgtaacaatatactagcattctactataattgatagcatagtttaaaaaggtactccctccgccctaaaagaatgttttttttactatgaatagtgtctaggttcaaacaagatataattaggtatctaggttcaaacaagtagatagaaaatactattttagctatgaatttggataatattcattatctaggttctattgtccatgttaattgctaaaaatacattcttttggggatggatagtgttatactcactatagagaaaaatagtcgacgtcgagaaaattgaactcggataatcaacctcaaataaatttgacagaagggagtacctgaaaaaaaaacccaaatcagctccgctcggcgtcagctgatttggaggaaaatctctacgctcaagcttcctaaagtactaaatgttgctcttttttttaaaaaaaagaaaaatcacttaaaaaatcaaatcaaatcattttttaatttaaaataattaataattaattaatcatgtgtttatctttttttccctccttccaaacacactcgagtaccccaagcatttccccattccaaccctgcgtagccagtaggacatgcgtattgtggtccactcctccgcaaaaagcgccccccaccgtccacccccatcgctttccaccgtccaatccaaatccaacgtccacgattcccccatctgccctaaacccccacccccactataaaacccccatccccttccacaccgttccacgtctcctcaactcagatctcccccatttcaactccctcctcctccactttcccccccgcatcgagcagcgaagcggcgatggcggaggagcagccgcgcgcggcggcggagggcggcggcgagacgctgatggagaagatcgccgacaagctccacatcggtggggacgggtcgtcgtccgactccgacgctgacgagcgcaagcagccgaagccctcggcgccgccggccccggccgaggtcgcaacggagtcgtttgttgattcggctgctgctgccgcggccgaggccaaggccaaggtgttccgcctcttcgggcgcgaggagcccatccacaaggtcctcggtggaggcaaacgtatggctgctctctctctgctgatgatctctctctctctctgtttcaaagctgatttggtttgaatttgttagagcgggtggggatgggctggatctggattgattgggagtgttgggtttcgggctagatctggtagattagcacttggccaatgggagtagggttttagccttttgctatgtgtgaccatctattcagatctgtgggtatttggggatgagtttagatatctttgacaaatcggaacaactaatgtgatcctcgctgtgctagttaattcaaatttcggcaatgcaggttgcgtgcgtctcgtatactcgtatacaatctgatctatgtgatttcattttatccgtatctttttgagtaagtagtggacatgtttagctttgatgaatcataagcgattgtggcaaagagaaaaagatatgcttgtatgtgtcaggatccatgtgaagcggggttttgattgacatgtaaaaagtaatggaataattgaattcatgatttccttggttggtctgtcacattattgtctgctggtgtgctagtactggtccctttagagtgacaatgagcaagaattgaactgtttgtaaacagtatgtgtttgaaggttagtgattagcaatagtgtactccgcctcgtcacacagttaagccgtagctaacacaatcatattgaatgaggatgtacctcattctggtgaatccttatcaatagctacaaaggattactataagccacatatgctgttgattattgctatatttgtctgggattgttagtcttctgctgtcctgccttcaaaacaaacacctttgctctctccataggggtggtcatattttgtggttgaggtgaaatttccattatgtgctcatgttatatagcctgattatccattgttcatcctgccatattgatttcagttctctatttgcagccgctgatgtgttcctatggaggaacaggaacatctctgccggtgtactaggcggtgccactgcgatctggatcctttttgaattgcttggctaccacctcctgactttcgtttgccatgggctcatattctctttgggtcttctctttctctggtctaatgcctcatcatttattaacaagtaagattgtttttcatctctatcacaacttgttcaagttttggcaaagcataatcatgttccacaggtagataattacataaaaggtctctaaactgtgccctttctttcaggtctcccccgcggatcccagaggtgattattccagaagatttggttgtcaacattgctctatctacacgttatgagatcaacagggcctttgccaatcttcgtcagattgctcttggccgggacatcaagaagttccttattgtatgtctgtgatgcttttgtgtttgtataattattgttcccatagcaaactgaatatttatgatctataccacacttttaggtgattgctggcctttggttgctttctgttcttggaagctgctgcaacttcttgaccttggtttatattggtaagtggtttgggctactttggacagaattattctttattacctcttcaaactatagatttgactaatgttagatcttttgcttcttatgccaaacagtgtttgtggtgctgcacacagtcccaattctgtatgagaagtatgaagatcagattgactcatatggtgagaaggggtgggttgagattaagaaacagtatgctgtgctcgatgctaaggtcctgagtaaagtaccaaggggccccttgaaagacaagaagcactaggaagaggtgatgcagtgcctcgtggcaggtgatagtagtggttgggttgtggttcttgagatgcactgctgtcacctattgccttgtgttgtgtatggctcttttgttgtctgatcttgatgggagtagctgagtagcttgcgctacgacagtatgcagctgcagcgcatgctttgctccatcgctgtttgatttttgatctgtaagatgtcgcatgcatattgtttatgcgatattgttttgttactaagattgctgcattttggaatttggtgatatttatgaaccaatgttgagactagatgtcatctacccgtcatttttgttgttgacgttggtgaaaaatcttgttatgattgcgctattaaagattcagcctgcgatgtgcacatttattttttcagtttgaagatgcacataatcttggacatataccgaaattttgaagctattccaaactttggctttaggacttggaaaaatttgtggtgttgcgtcactcgacgagtcatttggggaatgcagcatcattttctatccataatgaagttttaatattgaaacatcatctgatgctgctttgtaaaggcttataaggaaccaaacttggtcccttcgactccttgagtccttgatccttgaaagcaaaggtaacacttgggcttctgatgttcacttttgctcttcttccaggctaatctatgagctgccacagctttctcacatgccaatgtgttgagtaaccatggtctcatcatgggcagcactaccggtctacctttgcttttttgcttcctcataagccatttgattgcattaaactctcaatctggctaatataacaagctacactttcgctctcaaaagatgattcttccgcgtcatggttcgtgcgatgcgcttagattcttgctgcagcagtgcagctagccggcatcgctggaactcgtggcgtaatggcatgtttggctggtgccagccacactttgtcatgccatactttcttatttttggttattttggcacggaggagtatgcaaaaagagcacagggatggaaataaaaaaagagacaaaagaaaacaaacgtccgctccggattcattattctgaagcacaacaaccggaggcaggcaaaacatagtccctgtgtatggaagttctctatcaagttttacaacaaaaaaaaaccggtttcataaccaggctcctttggtcccaaacattcttaactggtggaacttaaaacactggactattttcacatggttgttttccgtctattctagttttcaaattatgttcatacactctggatatttagatagttcagagaaagtatgtcaactgttgtttctttctggagcctccttcaccgtacaactcattccattgcttcagctcacccattattgttccttcagcagcaaagcttgccgccacctgcatttcaaagtttccacaaattgttaacaagcaagtataatgctaacagtttttcagttttatattagcaagaattacgttctgtgcatgtttcagaattctaaattcaactgtaacaaaagattcacctggttttttgcttctttcaaatctttcatgtttagtggccttagtatgatcgtctcgtccttctctttcatcttcgaagcatctgaagcattgcctccttgttcccgcttcttctcctgaagatattaggcatatatattttacttttagtataaaatttcacaaaattgtctccagtgaatgcttaagtatcgcagtgactagattaccagttccttctttctttccttttggatcagttccctcactggacgatacgctgctgttgtgcacaggttctgtcacacagcagactactgagttaaccaaagagttctttgggttgacatagattcatgtcttatgatactgacctttagatcactgccactatatccttcagtcatggtggctagttccttatagtctagaccgccatcaactttctccttcgacagaaggctcctcaaaatcaattcccgactttccaatgatggcaggccgaccatgatcctaaagaagcaaggcaatacactcaggcatggaacttggaacaatcgaaaggggctaaaaaaaagtttagatacagatgagagaactagcatctagcaaggaagagatgcaaacctgcgctcaaaccttcgaatgatagcttcatcaagatcaaagggtcggttggtcgcagcaaggacaagaattttttgatctggtcttgacaagaggccatcccagtgtgtcatgaactcattttttatcttcctcattgcctcgtgctctccagctctgttccgctgaccaagcatgctgtcgacctcatcgacaaaaatgatcgtcggtgatactttggcagctaatgtgaacaatgctctaacattcttttcatcttcaccaaaccatttcgatgtgatagtcgacattgaaacatttatgaaactcgcttgagcttcatttgcaatagccttggctagcatcgtcttgccagttccaggaggaccaaaaagtaatatacctctgcaaggtttaagaagaccccctttgaagagatctggtcttctgagagggagcatgacaagttcttgaagggattctttgatatcacttaatgcaccgatatcatcaaatgtgacaccgatttcattagcaggtatcacttcaggtctgatgcgcttttcaaactcattgtctggcggcatttcctgaatacacgaaaaggatgcaattacacattatcaaaattagattcatggggcttgtgaaagtaacataaaacgacacaagatattttttaagaactacgtatgatatatcaaagtcataaaaaaacctttcaataattgatttcaaggaactacgctttactctgcacagcattcaacagaacgacacttccataataaccaacggttctgtaatagttttgctggtgcacgtgtgcttttagacttttaattaatgctcttacaggtgcttttgcagctggagatggattatccttcttctcgaatttctctggttctgctttgctctcaacaggaggggcagcagcagctgtaggaggtactggtggtagcaaagttgcaggttttgtttctgattttgcagcaaatggagcaattcccctgtcagccacctgtatgtgaggcataatacatgaataacggttcgttaaaaaaaaacatgaataactacaaatcaacagaatattcggaatttcctgaagcgtatgaagttaatccaaaagcagtagaaataaaacaaacctttgaagcatcacgctttgcttccaacttcatgctatccttatcatacatcttgttctcttgaaaaatttccagtgcatgggacaagctgtgtcatgagagagtcataaagcggagaagagatgaagaaaccaacagacaactatacaaaaatgctaagtacctctttgcagatagaagtaattttccgtttcggtactccggatctttcttattcatcaggtgataagaaactgctgaaaccacaatctcctcaatgtacctacctagaaccatagtatcagataggcatatcgagcctaaatcatcacactcaaggtcgttttcggcaaggacttccgtaatatggttccggttatcctggaactgaatcatcttcatatcttcttctaattgggagttccagctcacaaggtggttctcattttctggtggcttgatttcgatgttgtatggaaataaagcagttagtctttcatccaactcttcatcaaagtccatatccacaattcttgagccaaggactagcactggcccttcaagtttattcagtagtttttcaaacatgacatacatttttttggacttgtgaagaaacttctcaacatctcttatgtagagaacaattgggttcttcttagatactgaatgcagtaccttgtatactgcttgcaccaaaatcttctcatcaaaagtccagctgctagcacgtctgagagaagctgcagtgtttaaccaaatacaacatgactcatgagaaacagatataggtgcaaaataccagaagcctcaggacaaattttgtgtgcaagagattttaatatgacctggattatttggagggccttgtgatgccagactactcatatcagatgaagttgaggcattccttttaagcttcgggaagctgctcgtactttcagagctcctgcaaaatacataaagaaagcatatcaacagcagccaatgatttgcagtttctgtaacaggttcacagaagcacaattttccagtaccttaatttcatgtccgtcatgctgctttgtctacgaatagttcctgtgataaaaaataaaccaaactaagataacaaatatacagctgcaaaacttcctgaggtagaatgaaatacataattcagttattctctatggtcattcagctgcaaaacttctgaggtagaacgaaatacaattaagttatgctctacattctgcaaatgcaagcaaattcaattttttttaaggtaagcactattacattcgttcacagcatcagaatttcagaccaaattgaggctaaattatgtgaagtcaagaacagttgttttgcgctttgctggcagtaagtgtacttattcattctctcagttcagcaggaattgtagttttctgaaactctgtttgaataccgatgccattcatccatataaataacagcatatacagatggaatcgctagacatttttgtttcagataactgagaatgacagcaacatggttgtattcaagatctcaactgtggtgtgcaaaagtgtgaatttcacatgaaaatacatgttccatctagtttgttctaatagaaatgaaaccagaaaagttcatgtcgtctgctaatgactgagcagagttgcaaaaattccatgcaagaactgaagcagactactgacaagcaaacataattattctgccctacttcagaataaggaacagttgaacatttcttattgtgaagtcgatcatgtcacctttgggtttctccttttgtggtagaatcgaaagagatccaagtaatccagacaccttttcaagggtcgtctcagatatggatcttttgaaagactgataaggagaaagtgctcacaagttaatagttaatttaaactggccactacttgggcagttgataaaaattctaaatttcgcaacaatgtagggaaaaaaaagcactacaatgtcaagaataagcaaaacaggacacacacatttatattctccaaggttcggaaatcagaagaatggtgaccttacaacaaatacgacaaagcgtgttgagttcttaccgagtctgtgctgctaccaccaccatatttgctatggatctgtgaggaagaaaagtctgtatcacaaacatacttaaaaatgtacatgaaaggaaatctgtgccagccaaactcacctttatgagaaaatctgtaggatctagcaacagcaattttgcttcaaaatagtgggcaagcgctttggcaagcatttgctggtaaagttcttcaagataggaacttaattagccttaacttagtcagggccagaagaagagtgattcagcaactccttaacctgtgcaatggaatatgatttacctgcagggcctgacaatagaatcgcacggctagctggtgcaagattcctggtgtattgtgagatgtctgcttgcttcaagtgaacatacgccgcgcttgtcagcaatacacgcgtttgctcgctgcaaatcatagtttggggaaaaagagaaacaaaggatgatgacatggagggtggaaaaggaaatgaacgtgtacattaaaaaagagaacagagctagaaatctatcgttcatctagcatcttccttgtcctgctgggtgatcattaaaattgaattccagctaatattttgatcttgaaagtgaacaaacagacgtttgacgtctcatcgatgttgttctgtatgtgttctatcgtcccctcattttttttctttaaccaattctaccagcactacctttcaaggctgccatttttcaatcacaaagaggaacatttcagaaaagcagggttgtctctcttcgcctcccacgcaaaattatgaacaagctaatctacagaaatatagcagtgccactgtcttcaatcagagcgttcattttgtgatctccgagccaaaagattgttgaaacctttcaaaacatttctctctctctctctctctctttttctaatttgccaaactacacagttcatctgtaaatctgttgcttgcatatcacagactcagaattatttgtgcatgataagatcataagaacggagggaaaaacatatcccctatacaggacagaacaaaggggaaaaaatcctaaaaaaaaaaatctgacgatgcaaggtgacggaacagttgcatagctcgatgaacgggaggaaaaaaaagacgttgttgatgttaatcacctgaggtagtaggggaacccgtcgaaggtgaccctgctgtcggcgccgtcgacgacgaggcggcggagctcctgctccaccctctccaccgtaaccccgaccctcgccccctgcccgccgccgcctgcccacggcgcggacgccagccccagccccaccccgacgcctatcccgatccccaccgccgacatcaccacgtgcttcccctccatcccctccccgccgccggcgttcgtcctcctagcaaggtggtgagacgcacggagcgcagcgatcgatcggtggcgcggcgcggcgagcggaggaggagggttaatgcgggggaggggtggaggtggcggaatgggtggctcggcgagaatg

SEQ ID NO: 75112 - DNA, 48478 bp, Oryza sativa
  unsure (1)..(48478): unsure at all n locations
aaaattgtagccctcgacgtgacctacaactttttagttgaaaagtttttgaattaaaaccatttagggtctcaaaatattgttgcatgtttatagattttgaaattttaatttcacaattacattttgggacaaaaaatgacttaaaataaaaaaaaatcaactacaaagttgtagatcacgtcgagggctacaagtttgatataaagtttgtcttcattagaattcacatgaaaaatttatgaattatttttaaatataaagtctttagaccgtcctatttgatccagatgatattcaaatccaagtttagggaccggggtgacacaactgaacaagttggagaacctaaatgagtgatctgcaagtttaggaaccgagatgacacagtcgaacaagtttgaggatttgaacggtcgatttgcgagtttaaggaccgggatgacacagcggtacaagtttagggaccggtgatggattttactctttttttttaccatttccatttttgtgtctgtcagtaaccatttccatttctatcagtaacaaatcatgaacgattaccgttcggtcggtaacaaatcatgaactatagccagtcggtcaggaattaccaggggcactgtttttcacaacttcacccgtaactgaccacggagtggaaacagcgccaggacaccttgtgcatgctcactcctgttatgcactcgtgacagcaatgaggaggcaccaagcccatagtataggcttgtggaccagaactgcaacagccacactgggatgtacgcagtggaggtgaggctgcacaggcattacccaacctacatggaggtggcaagaaatgcaaagttttcccagaatgatgcatatcaattatcaaagcagtggctcgaccaccccagatgagcatatcagaggtgcggttacgcactcgttgcccatcctatgttgaggtggcaagaaatgcaaacttttgccagattgatggatatcaaaccttaaccagcgacacgatcacccagatgagcattagaggtggagagatgcaatcctcatactgccctgttctaggtgcttccctttggatgtgtgaatgccaccttgccatcctttataagaaatgggatgtgtcaattacggatgtagagtttccttctttctttgggtttatgtgtaatcagatggagagtagaggtgccacttggaataaaaatgacaagtagtacgtttgggccaaactgtgttaccgcccgatgcatattccggcataggttcacaaaggagtgccatatatgggagaagcaaaaatctggtggcatccttttcctttgggttctagttcgggaaccgccagttttctcaaaacatggatttggtttcaggatctggaaatttctagtgacacgtaaggaattttccaacaatttcagttatgggcctaatggacttcaaaccagggattcccagtttcattttggaaatagattctgggcgataaccagaaatttcagaaaaaataacacctagaattgtttgaactttgatttaagaatagaaaagcgaaaaagaaagaaaaagaagaaggcaaagagagaaaaacagaacagttctcataccataaatttctttttgtcagcacatatgtgttaccactgaaggaggcaggcgtttctgtgttggaagacctgtgtttaaagccgaggtatttcctgcttaacatcagagagatgtaaacatcgagagctcacgtttgcttgtctctcaatgaacctggtgtgattaagctcaaatgagtcatccataacaatgattcatgtaggtcccatcggttgcccatattccctaataagccaaaacggcttattagagaataaaaactaacttataggtaaaacttttatatatgtgttcttaacaacttaaaagccaatactaaaaaagaactacgttgaaaatattttaaaatcaacttcaaaattaagtttgaaaattcaaattttggctttggcttattagggcaaccgatggggctcgtaatatatgcaagctcatcaaaacagaaacaaaataagagataccaaaatattccctccatttcatattataagtcgtttgactttttttcttaatcaaagttccttaagtttgatcaagtttatagaaaaatatcctaacattttcaatacaaaacaaacatattatcaaaatatattcaatgttaaatttaatgaaactaatttggtgttataaatgttgctaatcttttctataaacttggtcaaacttaagaaactttgactaaggaaaaagtcaaacgacttataatatgaaacggagggattatattattgcatgataaattcatagtcttcttgaaatgataattagagtaggacgtatcatacttattttttcttgcatagtagcagcaaaatccatgccattttctctccagatatagggaaggacattttgaaacatatatagtgttggatgaactccagagtcctccatccactgcaaaacctacaggcacaaaaaataaagctcaaataaatatcaggttttgacctattactcttgaatctagcttgttgcaagcggtattctgagatgatcagatgatgtaaaaatgagaaggggccttgttacctcaatatactttctccatttcccaacaactaggagatttctaagaacaaccgcataagtagaaagacccacagtagaacatgaagtcaccatcttgtaaaacagctgcataagagaatcaaataattaatgtagggaacagaactgtaaatgcagatcattatttctcttacaagtgtagtggcatgtttgtgattccatggcttcctcaagtatcaatgtgtattgatgtgagaaggtgatgaactgatgatttaaaactagtcaagataaaattgttcttattgctaaatccatttttattttggacaaggagcagcaggaaaatataggtggtacatggaagtatggaattactggtagtacattgatacttgaaccttcagacattcaagaaaaacaattcactgccaaataagtaagagtagatgaaatcataaaatatttgtcaactcctctgaaaaggagaatcctataaatctatttgattatgctgaggacaaacatattaaatgattatatgtttgggagaaatatattgtattgtgtcagtgtggcaaggccgttagttccatatctaaccaaatatggacttcacttttatagaaatgaacagatcgatagtttttttcccccctgaacatgtaggagaactgcatccctttgcattaaaaagaaagatatccactaaaactaaaaaccataccacaccaaaaacagagtaatgaagcatgtatatccattgcactgcagaagttggatatctttctttgggtcttagaaagatatccactaaaattactggaatgacaactatgttcttagaaagatatccactaaaactataaactaccacaccaaaaacagagtaatgaagcatgttctgaaatgacaactatgttctgaaggccaactataccttcatcatgttctctgtcttcccacattttccaagaaaatttaaaacatggtttagtgttccaacagaaatggatgagagcgaagaatccaaatattcaatcatctcacttgctgttttccagtcacgtatcctgttatgaggaagcagaacaaaatagaatattgagttattcaatgcatcaaaagcttgtaaacaacataacaccagatgtgtgcggtaaaaaggaatttgtttctgctcaacacttgaaaccaccaatatatcacaagtccaatacaagttacatgatgaaagcatggcagcatgccatgatagcctgattatctaaacctacaaacagtgataatgaaaggagcagaggctcactggcaagttgctgtagcccatcaaggaaaatgaaattatcaatgagctacaatccgaattgtgtaagcgaacaaatgtagattgccaatacagtaaccccaacattcaattgattcaagttgtcaattactggaatcgaattaacactacacagaacattccaccctgctatcttaataaacttgaaacttcatactgtttttacctattaaaaacttatcttttatatcgcatggttgcttaagaagaacaagcagatgtttgtaagtgactcaaatggtcacctgattaaaataatcctaaagcaaagctgcacatgacaggtaagatgactgagtcatgtacacctaaaagccataaacacgatgataccaaagcaagtgtgaatgcatatttatagtgttactagatcagcagatgttgcacactgctcagataataataatagacctaagttaccaatttagaattgcctgttcgacttaagacatcagtaaacgtacatggtgcatgaagctattatctcaaaataagatttttggttcaacgggatggattttttcttcatgaattccatcaattgaaggactctttcaggttcgccacccttattgaatgcttccatgagagatgagcatataatggcatctggtggaataccatttacttccatctctttgaacaggtcccaagctctcttccaaccaccttatggtccataagaactaaaagatcagtttaaattcttgagaagctaaatcaattaatcataataacaaaagaatattaccaccagcattataggcttggatcaatgtagtatatgtcaaaacatcaggaaaacagcctgattttttcatagaactgaaagtagattctgcttcagatagtttgccctgaatacaaatcattgttaggatagcaaactttttagagtaaacaacagagaaaataagagcaacacttgcctgtttgatatacgaataaatcaatgaagagtaaacctccttggttgaagaaaccttggagtccaccatgtcctcaaaaaatctcaaagattccgtatactttcctaatttactagatccactgatgagtatattgtaggttacagcatctggtttcacattgctctccctcattgatgtatacaactccaaagctttctcataatctccaaaacttaaataacttttaatgccggagttgtaagcaactgtatttagatcaatacctcgggacctagctgcttcaagaattgtctcaattcttgttatctgcctgcagcgaccgcaggcagccaacagagtacttatggaaacaacatctggctgaatgccatctttctccatttcatgcagcaagccaacagcttccttcaacattcccgcagacccataggcatcaataagtgcattgtaactgactttatttggtttgcatgagttcttcttcatcttgttaaagacctccctagccttctcaggctgtgcagatctaccatatgcattcagtaaggaggtatacgaaactatatcaggtcgtaacccatttttctttattaaattaaaaattgccaaggcctctctatgcatacctcgtgaggcatatgcacccaaaagcgaattatatgctacaatattaggcttcactccttcagcaaccatcaaatcaaagattgctttgcaattttcaacttgcccataaatacaataagaatgcatgatgctagtatatgtaacaacatctggaggacatttggttcttctctccctcattgagttaaacaattcaatagcttccccacactgtccaatctttacaaggcaatggatgataatatttaacgtgaaagtatcagaggtgacatttgctcctttcattatttcaaaataagatattgcttttgagtactgagctccattcttgagagcagacaagacaatgttgtgtgtaaccaaatctggtcccacaccattttctgtcattttcttacacagttctaaagcttttttccagttgccagcagccccacatgcatttatcacattattatacgtagtccgggtaggaggtatctgcagcaaaagtccggaacacaaccttctttaataaacaattatggcaactaaactaaaaaaatgaaatatataaactttgctggttttctaatagtctctttgcatttcaataacgtaaggactgatgaggcaatcaacagtgatgtgtccttgcacaaagtgagtgcatggagccaaaaactttatatggttccaagattctcttcaaattcaacccatattttagagagaaaaacttcaacccttaatcaagcaattttaccttactcaacaaactcccttaaaacaggattgcatttctcgctctgaacctctggtagttgcaaaacatgtttttcctgttattttttaactcttcattattttctttggtgcactaaatctaccatagccattactatgtatagtagaaaacagaaggaccctattgggtttatagatgaaaaattagctcaatatcaagaatggttatagcgaaatgaggaaagcaataaacgcattgtactcattgtaaagaagaagcatttccaaaattatttatctaaaatgaataaggttaaaagcacaaaagttaatgttttgtattacttcgaaaaataaaacacacaaacacatcaacttaggcatttgcaagatgagaaagcaagaatatagggtttatgtttcaaggaatgatactgacagcagcacgaagcatatcttccataatgttgatggcccaacgccattgaccagctcgagaatgagcatggatgagggaattgtatatatcagcatcaggtttacacctaaggttataaatgtcagtattttgtccaaaaaaaaaaagagaaggaaatgacagataatgaaaaatgatatatttcttatcacagtagtggaaaacaaaatatagaaatagcaaccacatggaaattgcacttagtattacacatattacagtttattatgataaagtataaatttcctacatgcgagatcagcaaccatcacttgcgctgttccctagatgatctgggaagattttggatttgcaaactcaaacaaattgaaccataacacaaacatgttatttgtatatagacaagttaccgacgagacaattactcaattatgaggtgataaatttttttagtaatatcaggcaaaactctttttgatggttgaaggaacgcagaagccaaattaaaaccttatgtcagaaatatatgttataacattcataccgccattcctgcatctcaaagaacaggccacgtgcctgatcaacctggttatgcctcgcatatagtcgtatcatcatgccataaatgtcgttacgagcacagtagttatcctgatttttcatccagcagaacacatggacagcatgctgtaaattcccagaaattgtgatctcctacaagtgatacaacatgtgtaagcgcgttattacctgaaaaggctagttttatgttagcaaatcgagagatttgagcctcgtctacaaaatttgcatgtgcagctggtactaccataacaacacagctagatcgattgaattgttcatgatttttgtaatttcaagcaatcgataacattttggccccaaaaccagtttgtcattagtgcctccacgcaaggcaaccatggcagccacattgatgtatatcatcagcaattttcaattcatgaaatgctacagagcgtggggatgatggccttacgcggatgaggagagggaagttgcggcgggcgaagcggccggcccagcagttgagcacggcgtcgacggcgcgggcctcggcgcgcgggagcgcgagcacgcgcgcggcggcctccgacaccttccagtcccgctgccaccggctcccctccacgcgcaggcggtggcgcgcggggagcgaagcggcgcccacgccctccacctcggcgcgggcctcgcgccggccccggtcgtagtccacggacacgggggggcggcgctccgcccaccccggcggcgcggcgcccgggtgcgccagccgcggccgcggcggccgtgggggcgcgcggaccacgcgcgtccgggccggtgacgctggcgccgccgcgtcgggcgtcgcagccggcgaccgcggcggcggcggagcggaagacatcgcggcgggtggtggagggggggagagaagctttaccgttggggcggtgtgagagcgggttttccggataaggggcgatcttttcctcaacagaaaaaccaggaaatgaactccatccgtcctaaaatatcctcgcgaaattagaatcagattcgtaaaacgagaaagcattctgttatatcctagatttttatattttaaaaataagatagtaatttacaagcaccccaatctaaaaatatcaccgtagaaatgcttttattttagaaactaggtgaaaccctacgtgttattgtaggagtttagtattataataatataagtaaaaaataatgcgtaacatagctagacaacataaactaaagtaagttgatgtgatttatgataatttaaatttaaatagtatataaaatgatgattcaagatatcattttttcaatacgattttgtatccgccaaaaagaaatacctggattcggctccgatacctatgtaaacatatgggtagattattttaccctgaaattattacagattaatatggacagacgggaaatacatgtcccgttttcaccccttgattcgatcttacccgtcctattttcaccccttgattcgatcttatccattcccgttctctctctgagtcgtcgtcttcctccttcgcctctcctatttcacccctccctcccccctcctctccaatacagcaaagaactcctttatgcaaacatagcggccgtgataatagggcttttatctaagggtaaatgggcaaacgggcacgattaccatgggcagcctccctccaaccgaagtaccgaacctgcgccgagggagacagtgcttctatgggccggattttgtcgccgtgggccaggtgagcccgctcgtttttgctaacctcgctggttgccgtccgatgcagatcgtgcgctccatctccccgctatttccctccctctgactccgaatccgaatccgtagtcgagtctctccccccttcggcgtaaaaaggagaagagaaatcccccgtctcctccgctccttgcgacaagaacagggggagggagaggcgccgatccccatctgctcgagcaaagcagcggaggggaggggatcctgcaggtgagcagcatccatccacatcctccttctgattcatggattcatctctctctctctcccacccctacttttgtctggaattcgctttgtgtgcgttcgttaaccctagctttctcttgtagatctggaagaagctcatctcttaatttcagagagagcctcaaccttttgatacaagagtaacagtattgggggttcatctgaacccccaaatgtcccaagttggatccgcccctgagacgatggatctggagacggagaatcgtcttgcttctttacttctcgaggaggcgaggaggttgcaggcggaggctgacagggaaggtgttcacgcatatctgcgaaagcccaatgtaaggcaccgtccgaattcgcgcttccttacggccacagttcgtggagttcagcaaggttagcatcgtagtttcgatttatcgttattccatacttgatacctcctcctgttgattgattagctatccaaggcaactataataatttcttagtttcttgactcattgttaatcgtttggtagactttatctggaattgaattattttttatagaacatattaattttattgtttgcccaaaaaaatgtctgttccatgtcttaaaggagaattataggtgtggttaaacacaaaatataaaccaatcgtgtaaaacttacttcctttgtctaggaatgattcgctggatagcaagtaatgacaatctcataagtatagctgatctcatgttgctaattttcttgtccaaagatatcagcggtgttctggttgtctacttactgaattggcatgatatgtgctgttcacctacagcgaaccgtgttgtggaggtcaatgaaatgtggcgtgccagaaaacaacttgannnnnctggagtcttaatgaaaaggagtagaggtcttggtgacgccagagagtgaaaaacgcaaaagtgacttgagaaaccagagttccagtccaagggttgaagaagaaggcatagcttataacagttcatattccgatcaggaggatggtctaggggacgatgacattgagaagtttcttcattcgaggtctgtattttctatcttttggttgttctactaccaacattttacacaagtagctatctgcaatgttgctgacagagatgtaactttggtctgctatagggtgaagcgaggtcgaggggccgttggttctaggatggatgagcctggtccataccttaatgttgcatctcgtagtcaagagaacgaacctaatgctgatactcaggtggaagaaaaatgggaacgaagagtacaaggcccggagaaaccagtgtctttgagatcaagatcacctgatgactattggcgtagggaagcactagatggagaaccttccagccctgaactccacaagaaaaaagagaagaagaaggaaaagagttcagagaaaaaggacaggaaagagagaaggaagaaaaaagacaagaagaaatctaagcatcgccaccaccaccatcacaaaagtcggcaaagggagtgattgttctgcttgctgagcataaaaaatgtacacaagaaacatgttagcttctaattgctactgttacttctcacttgaaacatgttgtaccaaaaacttgatatcgtgtggaatggagaactgttcttctcacacggagtgttgatacaaagccatatgttagattttagtgctctcgttggtcttgtgtatttattatcatgatgactaaatcacaccctcgttaattaggaataacgtggttttggtagctaaatgttacagcttccaatcttatctgcaactattgtatgttgtacaaatcgtacaaatcgatcaaatttgtatgctgtctgtctgtcaggcaaggattcctcaattggagcactttggagtccctgtttactggcattctagtttcactttcacatcagtagcccagatcagatattctgactcagaactttaaaacgctgctgatttgcactttgcagtatgacctcatgataatcctccaagcaacatgtaccttcgagagttcttccctagaactttcatttcgaaaaaaaaacaaattcacaaaaataaagagagatttttctctcctttaagaattagtttacatttcctgttcatagcctgataatgcagcataatctgtggaacttcatttgagtatcgatcaaaacagttcagtacccttgctgagagggtgaaaaagaacatagggatgacatgattgttcatatgtagttgcacaaatgtttacaggattacatgacataaaaaaaatgtaagaatgaaaagataatgacctagagtctaccacttctgtttacgcctgaaggcaatcagtggaacgctaatcgagatttatgggctctgtacagtataatgcaatgtgtattgaaggactggattcgacaaaatctatctgcaaaaaacaatgaaattgttactaatcagatcaaatgatcagaagcataataagggacgaagtgaagataagtagtagtaaataggcatgtggaatatggttaaactgatcatgtaaacatcattcacaaacaagcatgatgagcagtgatatttgatagcttaagaatagttgtgccaagcgaaagagacttaattctggaaggttagtaagaatcaaccacatgttcgataaataaaatggtttcaagtttcaacatacacaaagaagttaatgaccattgtactattctagctgctgtcattgagatggtttggagatttcaagtagtcaaggtaatttgtatattttgagaatttttgttgggacctgtaatgactacaaaaaattaacatactcaacaacatgtttaaatttaaaagtgtatagcgaaattgtatcagttactcccactcattcattgtgcaggtcagtcaaagctactctatgaagaaatggcactttagcttagtaagtggctattgccttagaaccatgaggcatatgtctgaacgatcatgattaacctgcctctttcttaataaaagagaatagccaaacctatatctcattgcaaactacaaatagctgaaattttagattgaacaatcgaaaatttgaaatgttgtcagcgaaatactccctccgtcccaataagtagcaacctaggataggattagacccatcctaagactagggtatgtccaaattcgtagtcctaggatgggattagacccatcttgctacatattgggacagagtgagtactcacattgcttagcagtgaaaagtacaaaacataaaaggtgagaaagatagcactgaatctattttctttaagggaaagcattgtgctgtgcaagttcctcaacatccatggctattgagcaacaagaaacaaccaagagaaggacctgaggcaatcacctgcatcaatgaatgaaggaagaatggcccaggaggattcagccaacaacaaaggggctgatctccccgttccgcatgccgcgggctatctcaccggcgatcaccaggcacgttgaaacccagccggcgagcaccatccacaccatgtccacaatgtgagccgcaagcccccacgacatcgtcatcctcgcactcttttccctcaatttcctctcctttccagcctttccctacagctgcttccagggaggcaattccacaaacacctagcctgcaagcccacaaggaacccccaacagtttgcccccccccccccccccccaatcatgagtgagccgacaagatgccatggaggtgaacaagggttagatctatctagttctccaataattgattccatcttctaatcgatgggattgacaaggcacagaacaattacctctgtataatcctgagatggcaaattcacctcaccatgcaacaacagaatcgactccagtttgcaagaacccttcacccatggcagtgattgaatcaggatcttgtgtttcaccaccccagcacgtacaattcttctcctgcttcaataagattggaaaccaaatagaccttggggaatcttcagactcttcagagtgggactgtttccccctttgcttccgccctcagattctaccaaaccatggacggatagatccttaaatttagacggaatcaagaagagataagacaggaaaaataattttttttagaaaatacaccatcaagtttcttgcttgctttccccaaactcttgcctttcacctgtcgctgtcaaactgacccaactgagcaaattcaagaaacacctaggaccaacctgcacaagaaccaactggagactgccacataggagtctctgaccaggaattttggaggagatcctcatccaaattggtttatccaatcgtctttatctgtttggttagaggattagataggggatttggacaagtatacaagtattcttcagttttgtctcatcgtcaattcgtcgaaaaacacctgccctccaggtcagcacagtacattgaacagaaaaggttctactgctgagtaaatgcagattaatcattttttttaaagaaatacagtacagacacacgctcataacatgcacactcacgttataaacgcacacacggacatctcattatcgattggtatgtcatctaccactaaaaaaataatcgatctttgactccatcaacagttgtcacaatataagccattggcttgttgagcttttcaaacccaatcttaaattgttgcaagcatttttttttcatcgttttttttttctagcccaagtcctactcgaaaaataatatcttgttgacttatttatttttgtacagcatgtgagtctttttttttcatttctcatacatattgtgtttgcttccctgagccagttccggcttataagatttgagttgattccatcatctcctctctatgctacagtagctattcttaattaattgaatattgataagtactaataagttctctagatcttttttagaaaaaaagaaaagttctctggattgttgggtcagagactcatccaaatttgggccaggctctgggtcggcctgctgtcactaggccaaaagtcatgatccagtggcccagatcttattaggtccctcactgtcattaggaaaataatttggggaccaggtgaccctgcttaaaaagttgggttatgttcaaagcagggtctcctaatctcctatgattattttccggatttcaagcattgcgatagataatatatagcgggttggtcgtgaattaatctcttgatagcagattgtgtatagagagtgctatagcggctagtatgttccaacatacttcctccgtttgtaaatatttgacgccattgattttttaaaacatgtttgaccattcatcttattaaaaaaattaattaattattaattcctttcctatcatttgatttattgttaaatatacttttatgtacatatagttttacatatttcaaaaaaattttaaataagacgaacggttaaacatgtgctaaaaagtcaacggtgtcaaacatttagaaacgaatggagtattatcttgggtccgctaactttgtagtgctagcagtagaggactaccaacattatagcggtcgccattacggccactgcaaacactatattaattaccttgcttccaagtaactgagctacatgtgtagaagtctaagaagtggatctgaagtgtttgggttaaagtcactatattatttatatttactagcgtataatatccatgcgttagatcagaattaaggaaacattgtcattaatacattctcggcacaacaggcgggtcctttggcccccacgcacaaactccattttttcccttcacaacagtgtgcagggagttgatggtgtgagtgatggatgcggattgaccattcatcacacctagttgtttcatttaaattagtatatgtatacctagaaggtaatatcatggtttaagcatgaccaatgagtttatttttcttctagaaaggtataattaacaagttattactttgttacaataccaaagcgaatcgattttcttttgattcatcactgtatgtacgtagtatgtgctgacttatcatcaaatttacacttgaaaagaaaattgtgctgatctttcaaaaataaagaaaagaaaattgtgcgcggttcgttgtttcaatttgttcaaacaaggtaaaaatatgaaatactactcatcacctgctctttattgcccatcacatgataattacacaccgttgcaagaacaagcatagcacgcgaccataatcattttattcgtttgataaataaataatctagaatataacaatggcgattattatttatcattaaacagcatcagatatcaattaatcaccaagtggcaacggcgcgatccgccgtcgtcggcgcgcgtgtcgaggtcgcactcgtcgcgcccggggagcccctcggcgatggcggccatggcccccttcttgcacgccagcggcgcctcctcctcctcgacgagcacctccaccatggcgcgcagcgcgtcgcagcggcagcgcgccgccacctccctcagctggtggcagcaccgcgcccgcacccccggcgggtcgccgccgccgcaccgccgcagcaggtacgcccggcaccccggcagcgggtccttgggcaccacgccctgccccggctcgcacccatccgccgcgcgcgcgacgccgccgtagtactcctcgccgcccgcagccgccgcgacgacggcgccgaccaccaccaccatcagcgccaccagcgccaccgccaccgacgacaccgagagcttgctgttcttcgacgccattgtcgccgtcaggaagagaaatcgatgagcagtgcaaggtttgggttgttgggggggggggggggtggtgagattttagatggttggaaaaagggagagaaatggaagcgtggggaggaagacgaacagttgctttttttgtttttttgaatttgccgggaagcgaagctacgtggagagggcgtcgtgcatggcgcgcgcgggaattgtcagtgggcgtaagggattagcgtccaaattaaacaaaacgaattcatcagtgcatttccagggccgggctgcctacttgcttaatgggccgtgaaagattgggcccaaaagggacctgcacgaatctcaactcgatcggacaaagggtctcatcttttcgcttatacttattcttatcagacaaaatttgaatttttaaacttaaatttggatttgattttaagattttttcatcgaagtttatttttcaatctttgcttttaaatcgctaagaacacgtatataaaagtttaattcacaaattacttttcgtttgcaaatatgtcgtttcgcttattcagcgaaacgatggctccggaagggtttacttactactgggcccgcatactacctctccctttgtgtttccactcaccccgcctataaaaataccgccatttcatcagtatactatttactatagcatttattcatttgtattaaaatatacttatcattgagaccatgtaaagcaatttatgtgacttctaatgtccaagttgtcaacctctattctctcgttttctgcacgcacacttaccgaaccactaaatgatgtgtttttttaataaaagtttctataaaaaggttattgtaaaaatagttaactttggcgtgaaggactaatacttcggtttcaatttgcctcacgaagaaaagggtggatggaggaagaagattgatctgaccggtgggttccatgagtagatgaggaagaagatggagaaggaaggagatggatggaaaatgtgatggcagtggtggtaccaattttgtaaattttcaatggcatggttacaaatagatgaattgtagtagcatttatctgaatcaacatatttataatggcatggatccaattaacctaaaaatcaatacgtactagccctcttggaatcgtctttttcgtactgtaactaccttttactctagttcgtccatttttattggtttgcattgtaaattaaccatccatccttgctgtaaaagtgcgaatctgttaatcctgatgggtgtttaccccaatttgtctaaatttaatatgctagccgattttgatctcaattatcatcttggtcaggagtttttctagatcacggttattagcgattatattcatatcctaaggctctcggtggtacatcgtggtgattggtccctgaaaaaagggtcaacaatggcaaatatgcaatttatttcaaggcccctgaaccatattatctgaaagtttacttggtacgtattatctaaaagtttcctctatatatggttggctgttttttcttttacctttttctgattgcatgttgtccctagggactagtaattatattatatatttcagtgtccctcttgcacaaaggaattaaagaacaattcgagcgggctagtgaatcaacataagaacatcgaagttcatcatttattcaccacatacatacgtttccatgcaaatggaaacagtaattacagtaactacaccacaccacacaaagtagctatagcctagtggccagtcgccgggttcctaagataacccagccattagcaaacaccaccgatgccgatatggatatccacaccgcataatgccaggaggctcgccaccaccatgcatttcatgttgtctctccggcagccagggaatacctcgtccatgggttgcccgtgagccgccgtgccgagctccttgtacatgcctaccaacttgtggctgagcaccggacacctacataagttgttgttgatggtggcgagctgcctacagcagtctcgccagacttgctcatccacgttaccggctgcgccaccgccaatgcactggcccttcaccattgttcggcagcgtgggagtgggtacacatcgagtagtctattcttggctggcaaagctggctgggggtatacaccacctagcagtggtggtctgccattgttgtcgttgccacaagcatggagacaactatcgagagcaacactaagaaccatagtataatttgaaatttcattctccactggcaagcataaatctccctgaattttttggtttttttggtcaaaatttatttaaattcagtcaaaatatgttaaaaattcaaataatttcggtcagaaaaacccggaaatcacaccatattcgttaacccctgaaattacactaccttgtttggtgccattttgtttttctttgtgttgcagaaaattttagttagtctcaaattgtatgagagggtgtacaggtaagcgctacatcaatggtggttttatatgtagctacaaatactaaagtgattccagaacggacacaatttttatcatgagtgagtagcttatggttttgcatgtaatatttattgtggttcaaagctaatctaggcatcatttcgaaaaaaaaaaacccttcgttttatatggaccacactcttttcattttcattcttccatgcaagaaaacaaatgcacaaactgccaacagatatatagttttggaaggtaacaaaatcttttgatctttatttgcatggctttttctatatatagttgatccaatttggtaaacaagaaaaaagataatacttcagaacaaatattgttaagaggaatgctctggaagctaaaaagcatgcagtaaagaaagctgcaacactagattcagaaaattaagaaacgtgtgtttagtgaagaaacgtgtgattatgtcggagtattctgaaacacaagacgcgcacgttcacttaatttccttttattgtgtactctaatcttgagaggactgggcagttggatctaagtaacagagttattttaacaagccacggaattatatagggaagcacgtacgcataatcactttgtcaaaaaaaaaacattacaaattaaaggctagagatattgtgtgttattaccttgtcgtattgcaatttgcatagaaatgttttaagtaaagagtaaggagagcacaagaaataggtctgaagtgtggtaggtttgtcaatttgcgaaggaataaaaagagcgttgttagcttggggagtgagtttaatatctatcggaaatgtattaatttatttttaaatcttggttttaccatatcaattatcttaatcattgtaaaataaactactccctccgttttaaattatttgttgttttagttttgttacaaatcatatgtcactacaataaaaacctcatatgggacttttctagaggagtttacaacaaaaaccttatataggacttttctagaggagtttgtaaattacctctaaaatcatgagttctataacgtagaggcactttgtactttaaaaactgcccagaaaaccttttactctagagacactttttatatattttcaacatattttgttaattcttatctcgtagaggcattttttcggcactttaaaatatgcctgatatgtataagaaattttcttcaggcattttaaactctgtataaacactgtttagggccactaaagggtaagaccctgagcaaacaagccaggcctaaggtcaaacctgtaacttgcctagcatatgtttggttgctacccttaggattctagcatgatgaatcttgcctgagcaagccatgctatctcgctccacctgcctgagtaaaatcaccgcattagtgaaaatgagaccacttcttcctcctcctcctcactgctagcctagggtttttgcagaggccatttcccatcgattcttccatcgctcccgcagcggtgaccaaggaacttgcagatccggtggccagttgtttctttttccagtaaaaatcctgcatttggtgatctgttagagcgtacgctactggagaagtgatctttgctgagtcatacaaaaatcacatagtcccggttcgagtaggaaccgagactaaagatattctttagtcccggttcaaaaacctaggggtactttttgatctttactcctagttgaatagctgttagaccctcaacaaactttagtcccggttggtgataccaaccgaggctaattgtctctctcctacagcatctgttctctctctcttccttatctcctcctcctcctcctgcaaaataagctgccatcaaaccgtcttgggacttattttgtatcggttttaatagttgagggatatgttgtatttggttttccggttgaaagacgaaaatcggattcgttgacaagttaagggacctcagatgaacttattccaaattaactgtaatatatatttggttggttgcttattttttagcctagtaattataaatttcagtattccctcttgcaccatggagttaaagaaaaatccgagccggctagcgaatcatcataagactatcagagttcatcatttattcaccacatatatatgtttccaagcaaaaggaaacactaattatataggtaccacacaagacacacaaggtagctatttcttagtggccagtcgcggggttcataggataactcagccagtagcaaacaccaccaatgccaatgggaatgtctacattgcaaaacgccgggaggctcgccgccacgcgtttcatgtcgcctctccggcagccagggaacacctcgtccatgggttgccctttagcgggtgcaccgagctccttgtacattccaaccaacatgtggctcagcgcggggcacctacagaagctgtcgtcgatggcggcgagctgccggcagcagtcttgccggacttgctcgtccacggcaccgccggcgcactggcgcttcgccagcgcccggcagcggggcagcgggtacatcgggtagccccgtccggcagcgcatagctgcccgggggtataaaccacctggccacggtgatccgccattgtcgtcgttgccacgagcatggagacaactaccgggagcaacaccgagaacactaccttgatgaaagccattttctttctattgttgttgcagaaaattttaattattctcaatcctcaatgagtggttttatatatgtagctactaagactaaagtgatagtgattcaagaatggacacaaaacttttagcatgagtgattagcttgtggttttgaatgaaatatttattgtgattcacagctaatctaggcatcatctggggaaaaaaaagttggctaaagtggattcatatggaccacactctttaattgtttaaacccattttcattcttccgtgcaagaaaataaatgcataaactactaacagacacatagttatggaaggcaacaaaaatattttgatctttatttccatggctttttgtatagtggtccaatttgataaacaaaaaaatgatacttcagaacaaatattgttaaaaagaatgctctgcaagctacaaagtatgcagtaaagaaagcggcaacactagattcagaaaattaaataacgtgtgcgttctctgtatatacgtgcctgatcaagcatatattggagttttctgaaaaacaaaattcatatataagatagctttgatgtgcacgttcagtctttcacctactttttttttttgttgtactgcaatcttgagaggcctaggcagttggataacagagatatattaacaaggcacggaattatatttatatggacataagaagcacgtacgcataatcactttgttgaaaaatgttgcaaattaaaggctagaaatattgtctgctataacttttcccgttgcaatttgcactactaggaaaagcattatcgcaagcggccgaaaagggtcttcgcaggcggggcggccgtccgcctgtaagccaacgactatgaagatcgccgatcttcgcaggcggggaggccgtccgcctgcgaagataattttcgcagacggacgttggctagtccggtccgcctgcgaaaataggaatcgtccgcttgcaaaaaagaaaacttccgcctgcgaagataggtagaaaatattgaaatttaaatataatttggccgtaaattacttttaaattatttattagaaattcttgcaggtacatatattggaatattatcaagcatttggtactgagaaatctacttatattgcataaatcaaaagtgttgccaaaatatatatattacaatattgttttacattgtcacttcaaataacgtcatctagttacattatggcatagcagtgttccactcccgaagatccttgaattcgtcacttgccgctagggcaccctctgggtcgaagaaatctcctttgacatgacagcactcatggtggatgaagtggcacagatcacgctgcacatttgtgatacctgtatcgtcaaagcttgttcgacattctaatcttggcaactgcatgcattgaaattaatcaatatattagtatcataaatatcaagagctgtctagtaaatagtatagagacttacatcctccgcgttagtcctgtaccgtccattaaccctaaggaattcgcacgcataatacccgcaaaggaccgttcctcgcggttgcttgtgacactgaaggacatatcatagaaaaaagtagttataatttgcaattagtgaaactattggaatacataaagtgagtggagtattaccggccaataggtacgtactagcagcttctcccgtgttcgtgtctgttctccacccttgaacttgtagtattggtatgcactgtatgaatgtcataccatttcagagtaaggaggatatttatttgtaatacatccatatacaaatgcaagagtcataataacttactactgtaagattgttagaaattctttgtattgcttgtgtttgtaatcgagaggatccaagactaccacggttccgtctttagggtggatgagtaaacagatataatgatcgctacatattaataacattataattagttagtaacagctaaaataagacatatgtgtacaagataaatgtaccgaacttacttaaaattataagcggccatgacgactctcttattttgaaagtgcaagaaggctcgtccaatgtactgtgcgacagtaatcaatttctccttgtgcaagcccttcttgtattctgctatctctttcggattcttgcccttcagctggtctgaccctggatctagcgtaacggtatgctgtgtttggcagatctgagttggatccaagaagccgatgggttcttttttcttcttagcatccatgtattgcatcctacataagaagtttgttagtagcaatcacatggagttgtattgtacatattttttatctaattaattaaaattcgtactcacatgcaccaaacaccgacatagttgacgtccatcttatccgacgatatatggcgtggagatctgagaaatctagccatacgtaaccttcttcgccgaaacaatctgccggtgatcgagctattatattgcccaagcctttcttgctggcctccatgtagaagttatgtaaccttctcatctcccatggtgcttctttcagtgcccattccggcaagagtgctttcccatgttcgtacttttccgggcaatcatcggttgcgaagtatgttggcccggctagcacagaagccttctgggggtcgtcatctctgagcttggcacgttccttaccccctctgaagacggttagcatgaacttctccttgttcgcatctttggacttggattcgtggctcctaatcactcgtggcacctcgggttctttcgcaggagaagggtcttcaaatatctctggctctgtaccatcccattccaatcctggtacttcatctttgactgacccgactgatgccacaaattccacctctggttctgccactgtaatctctatgggcacatccggcacttgaatctccatggctgtctccggcggtgcaatctccatggctgtctccggcggtgcagtctccatggctgtctccggcaatgcaatctccggtggcacttccggcactggattttccttaccaagttcaggatcatccgccttatcagtcaccttcctcttaggaggcctcggaggttttcccaaacccggtttaggcaacacaggtttttccccggcgtcggtgcccaatccaaagaatatgtcattcttatgccagagaattacaagatcgaccgcatccccaagtacggatataccatctgcagtcgggtagtcaatgtcgtaggactcaaacccttcgtggaccacttgtggctgcaccttggcatacgcatcgggtaagaactgttcattgtatgttctaccagggatagcaatggctgtagcggcctcaagagttttaccggagcgtccaatgggaacgtccaatctgcagggtgtattctccttgaggtcatcgaaggggtaatctggctcagtttctttggtttcggggcgaagcaaaatcatgtgcttcgaccgtagaaatcatggacgaacggtcgacgacgagcttcggtcgtggacaacgaaggaagggccggcgacgaggttcggccatggacgacgaacggcctacgacgaggttcggccgtggacgacgaccggccgaagacgtcgttcgcggccgaggacgtattcgctcgtggacgacgatcggccgatgaagccgttcagccgcgagcggaggggtgggcaacggtggtggaggggccaacggcggcggtggccgtgcgcgcggtggaggggccggcggcggtggaggagccgatggcggaggagagcgagctcgacggtggcggtggatgagccggcagcggtggatgagctcgacggtggcggtggcggtggatgagccggcgacggggctgcctcggtggagcgtggtggacgacgacggtcggctgcggcggaggacgacggtcggagagcgaaggtcgcaggcggggcggcggcggaggacggcggaggcgtgcggcggtgaaaaatttcggcagcctgacggcgccaaattttttagggttcccgcctggacttagaaattttggcgccgcgggcttgcccttatatagggcaaagatcttcgcaagcgggcggtccgcctgcgaagatcttttcaacaaactagtaattgcacataaaaatatttacacttttcaaatattactaactttaaatttttttaactaaattttcacaattcaaatggtaattgcacataaaaattagtacttagaaattaatatgcaaaatgttgagtacaattgttcgtcaatttgcgatacgatcacacatacgaccattacataactactaacttcttagatgtttatatgccactcaacaatcattaccctttaacatttttgcccacaccgtccgtgcgcatgtaaggcttcacggtcttctgagtagatgtctcgacattcttaatcttctgtacaaactgactataaagtggcatactatcatattggttgtaatcttcgacatcttcaaccccatccactcccaatatcttttgtttccctggtagcactatatctttcttcaaatttgaagggtctttcacataaaacacttgtgccacgcgattggcgagtacccaaggatcatccttgtgacccactctcgcaaggtcaacaacagtaagaccgaacttatcaacatttaccctgttcgggtattttacccactggcacttaaatatggggaattgcattgtgtgcccatagtcaatttcccatatttcttcaataaacccgaagtatgattgtttttcaccggcttcatcaattgcctccacacggacaccgctgttttgtgtacaggtcttattatctcgggctcttgtgctaaacgaatatccattaatgtcatatccctgccaagaatttactgtagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgagcttcttggaatgatttgtgatcatgggtgacgaatctcttctttcctatcgttcccctgccactcaatctgccctcgtgttggggcacaggtactccaattgcatatccatccttgagataatcgatacagcactcgacaacctcttcagtactataatcctcaaccattgatccctctagatgtgcacgatttcggacgtaacccttcagaaccgccatgtaacgctcgtatgaccacatttgatggaggtacaatgggccaagcgcaaccatctgcggcacaatgtgaacaatgaggtgctccatcatatcaaaaaatgacggagggaaacacatctcaagttggcactgggtctcatgtgcgaatgtacggagatttcctaactcttcgagactaatgaccttctgtgacactgcgttgaaaaagtagcacaaccttgtgatagcaacctttaaatgctccggttttatggctcttattgcaattgcaagaaacacggtgagcaagacatggcagtcgtgtgaattataaccagataccgacaaatctttcattgaaactagtcgactgatgtttgatgagaaacctatgggcagtctgacattacggagtgagttgcaaaatgacttcttctccttaggtgtcagtgtgaaacaggctggtggaagatatactttgccattcttttctccttcttgagggtgtaactcttccctgattcccatctcgactaggtccatcgttgattgcagaccatctttagtcttcttcggcatgtccaacaatgttccaactatgttgtcaaacacattcttctctagatgcatgacgtctatggcatgctgaacctccagatctttccagtacgggaggtacttaaaaaatatggaatgcttcttgaatgggggagggagtttatcatctggcttcgaactgtcatcttgcttcttactatcccctcccttcgtattcttctcgggtttcttgcgctttgtcccctttgatggtttcttagtcatttttccaaactcgcaaacaattttctctatcattgcacacacattttctcccgatgtaggttttggtgcaggatcagtctcttcagtaccatcgaactccgccttcatcttacggtacttgtgatttgtgcgtaggaaccgccggtgccgcatgtacacaagcttgttggaacccgggagatacctataggacgttccattcaagcagatcacacatcctgttttacctttaatttgacctgaaactaaaaacattgctggataatcgttaatggtcacgaagatgattgccttcactgtgaagtattcccttaagtactcgtcccacactttcaatccctctttccataaatcggccatatcttccaacaatggtccaagaaatacgtctatatcaataccaggctaacggggtccctgtatgaggatacagagtagtacgtattttcgcttttgacaaagccaggtaggaagattatacatggtgagaagcactggccaagtactatgtgaactgctcatgtctccaaaaggattaactccatcagtactcagggcaaatctaatgttccgtgggtctttagcaaactctctatactgcgcatcaaaggttctccattgacgagcatctgccgggtgtcgaatcatcccatccttcttgcgcccttcttcatgccagtgcattagttccgcatctcgcgggtttgagtatattcgtgtaatgcggtctttcacaggaaggtaccacatcacaagctgcgggatttttctctgtcgtccctcagttgcttcagagggttctaggctagtattgctattcgacttgtaccagcttgcaccgcatgttggacattcatccaaagaagcgtactctttcctatacagtatgcagtgatttacgcacgcatgaatcttttccacaccaagtgaaagggggcatatgagtttctttgcttgatatgtgctggatggtagtgagttaggcctcggtagcattttctgcaggagttctaaaagactgtcgaaactggtatcagaccatccatgtctcgcctttaacctcataagttcaagaactgaccggagtgttgtgaaatcactgtcacagcccttcgactcatcgtacaaaacttcctttgctgccttctgtaaagcttcaaagttatttagccctctggccgaccccatcagcacctcgggttctgcattacgtaacattttctctaggtcgattttgtcctcaacagaaccatcgtcatgcaccatgtcttcaacttgtgtcggaactacattttcaggctcgtccacttgttcttcgccatgacgtgtccatatttcgtacttgtccataaatccgtgagttaccaagtgctccttcactttaaaagcatcgtcaaagtcccaggctatttcattcttacagtcagcacacggacaaattatcttcctcatattgttcttctcagcgtgaaccttggcaataccaataaatttagccacttcgtttctatatggagacaaaaacctcggccaatgatacatccattcccgactttctatatctctaaaaaatacacgtaaaatatttgcacaattaataccaaatttgtagggtttattgaaaaaacttatagctattcaaaactaattaactaaaggttaagttgtaaagtaataaaaaatcatagtttatttcaattttttttacacagacatgccaaattagcacattaggaaaatctaacaaaatcaattcatcggcatattacaaaatactataactattttttgattgcactgaataaatagacatttaaaatttttttctctctctatacatgacaagagctagatctagatctagaactaggtggtggatatgatagcaaaaaattaaaaaacaagaatttatgttaccacattaaaccactacaacaagaggcatcaagtattacacatacatctaacataaacaaatgacaagaaataaaattaaaaaacatggagctcttccttcaaaattttggatgcataaatccatcacaaattaaggtctaaaagcttaaaaaaaatgcatacctagtgtggaaatgagtagatctaagtaccgtagaaaaatcccccgaagatttgaagttcaaaacctcccccctatatttaagtcactttaggagagagaaacgtcggggagaatgaacagggctcggggaggaagaagactatataggggcatctttgcaggcgggccatataagcgtcgcctgcgaagattgatgccggcggggttctggctccgaattacgtgcacgcctgcgaaaatttatcccttacgacgccgaaaatgagattgctagtagtgttgcaccagcccttcccttattttataagtaaagagtaaaggagattaaaaaagtgtcttaagcggggtaggtttgttcattcctgaaggaaaaacgaggccggatttgttagcttggagagcgagttaatttaatgtctttcagaaatgcatttactttgaaatgttggttttaccatatatatccatttacgatcttaactattgcaaaataaactataaactatttgtgatttttttaacttgtcagacaaagtctccaatccatataggtttgttgccattcatgtttataataatatattcataaaaaatatttaaataaaacaacacaagtatatttattgtaaatctatgaatgcaattattcgcatagattatattatatcgcatagattgtatagacctgtgactaccatatgttttttgacacgtcatgaaaccaatcctactgtttgtcagttgcttatcgggtgacacatttgatgaaaacaagcgtaggaataataacaaaactaaaagaagagaggaacatcgtttctactcctttcaattcagattataagtcgttttgacttgggtcaaagttaaattgcttcaagtttgacaagtttatagaaaaaaagtagttacactttcatcacaagacaaatatattatggaaatatatttaatatatatatatatatatatatatatatatatatatatatatatatatattaattgaaactaaattactgttgtaaatattactatatttgtatacaaacttagtcaaatttaaactagtttgattttgaccaaaactaaaacgacttataatcagaaacaaagggagtactcttatttcttactagtaaaatggccgtgctttgctatggataaaagaaaatatattataatatgtaatagatattaaaaattatcgaatatattaatgccacttgcttacttgtttgaatatacagtatttacttgtttgaaccatatatttggactattccataatataaaaaaacaggagcctatttggaaaacagtgggggtggcagattcactaccaccacatctagggacttttatgtacaaccttcgttttgaatataaggatgtgtctatgttgtttatcaggtgtttgtcgaatacttatatcaaaagattcatttttagtcacttcagttgtcaatttttgaattttgaattatttagatatcatttacaagaatctgattacctatgcaatcactgaaatgatgggaatcaaagtaatcagtgcatgaatacttatagtgtggtaccaaagaatggagggagtgaataagaaatgcaacattcaaatattatagatgttactattaattgtcagatcacaaaaaaatacggcagcttattatagagggcacctttaggctgcgattcggccgacatgggcgctctcctcaacaagaaattccctttttccatcatgaaattaaagaacaacgaaggctagctagcaaaccagcaagatatattcagaagaacattgaagttcatcatttattcaccacatatatataaatagatgcttcctgacaaaagaaagcactaattatttagcaaccccacatagtcacacacacacagctaactatagtagcctagtgaccggttcttggggtcctaggatacccaagccagtagcagacaccaccaggcccattggggatgtccacgttgcagaacgccgggaggctcgccgccgcgcgctccaagtcccctctccggcagccggggaacacctcggccatggggtgcccggcctcggtggcgccgagctccctgtagatgcctgacagcatgtgatcgagcgccccgcacctgcaccagccgtcgtcgacggcggcgagctgccggcagcagtcttgccagacttgctcgtccgcggcgctggccgcgccacggccaacgcattggcgcctcaccaatgttcgacattgcgggagtgagtatgtcggatagcttattcctggccgacattgctcaccggggctgtagacttggtggtggtccgccatggtcgccatcgccgccgcgagcacggagagaacgacgaggagcaataccgagaacactaccttgttggaagccatattttgcttagtttgtgaaaaatcttaattaactgtgatagctaggctcttcgtctctgggtggttttatatatagctataaagaccaaagtgattcaagaacagatagaaattttttggctgttcatgagctatttatggatttgcttgtggttctgtatgaaacatctattgtgattcacacgcctaatctggggcatcatatggacaacagatggttaaagtggattgatatgtactacactctttaattatttgaatttgtttgatccttacgtggaagaaaataaatgctatatgtggctatagaaagactaattaaagtgattcaactttgaagaacggccacaaaattgttttagctgttcatgcgtggttagtatgctcttggggttttgcatgactggcatgagcaatttgcttgtggttttgcatgaaatattttttgttattcacggctaatctgagcattatatattttgacaaaaagttggtttaaagtggattgatatggaccacactctttaattatttgaactcattttcattcttccgtgtaagaaaagaaatgcacacaccgtcaacagacatatagtactatgggtaacaaaatcttttgatatttatatttatccaatttgtttaatgacgaaaaggatagttcaaagcaaattatgtttatagctacccgtggcatgattttgttgttatgtcatatcggaagtggtcttgaagtaataacaccttgatgtaatttgtaagatcaacaaagtttcctttgtcttcaaagaatgtttgctaatttgcaaaaggaaaaaagagtattgttagcttggggattgagcttaatgtttttccataaatgtatttattcttaatgtcggtttatcatatcgatgatgttagttatttcaaagtaaacaatactcattgggaaagactctgagggaaaaaattatgcgggatctttgatgaggacatcccagctacacttgacgtgaacaaggctgatggttacgttatacatcacatggagaaatttgaagatgacgtaaaccaagttgatggcttacgtcttagtaagaacgatcaaacatatcatggtccaattatgcacagccatgctaagaaaatacaactagaggtgaactcactctttgctcaacttaacccaaattttaatgagaattttatactacctaaatattctacctttgtcttgctaaggtttacatcggaagacatcattactacgccaagaaggatgggttatgttgaggatgacaagagttacaccgagcaggaattagcccatgcactaccagcagctgtctacgccaacaaaaagttggtttacgctacaaaggctcaacatccaaggcttgtacgacccagccagtcaagttacgggttgcatggcatacatggttggaaagaggggcatgtctagcttccaatgcttcaaaccccatctcaatatcactttccaataaaaagttagagcatttttactgaggactgcgcaggagctgaagggctgtgcgtgaacccgagaaaactttttgcattctcatttatgttagccttgatcaccagaacgtggcttcttatgttcacacctacgctaggaggaatgttcctagtataaatacacttctaattcatccattagacaacttttgttcaattgaaaacctcatgtatgagagattattgaagtctgcataagtcttaccctttttgttctcgtgagttcttttgggcttgtgagaaggatcctcttgtgtcccctagttcgtgattttggccctcgggcctcttgtgtggattagttctggattgtggttctgtaattgctcgttttgacgggtcagagtccaggaaacttcggatcattctcacactcaccacttggtcgcatccaaccttggcaggtataaagctagttatcctctagctacgagtagctagttaccctcttgtgtacaatttatgccggtgctcttttgcttcaaacctactaccgtgaagatcgggtcacctctcgcgattgcgttcgcaacaaccttggttattcgctcttctagaaatacttctatttactgtcggcacgaatcttcacgaaagcaatagcttacatagacatctttaatactatagaggcattgcaaaaatatcgcacaagtgccttttgaataatctctataaatggggaaacattttatagaatgtctccattcacaatgtgatttttctagaagcatttttatgtgtataagagagtggtaaattttaaagtgccaaaaagattgattctcaaacaaagtaaatttgtctctaaaataaaaaaagttccaagcaattattaaagtgcttctaaaatgtgtctctaggctatagaactcctaagtttagagatgatttcaaaatcagctatagaaaagtgcccacgtacttaaagtttttcatgtgcttggagcagtcatcacctcctacctcagctcatgtccccaaattctcaccttctctcttgtctcaactccccacctcccttccttctccttggccggaggcccaatctccgtccagagtgcaatccatgtgcaggggcagcgagctaccccaacttttcctactctctcccactacctaactctccttccatctaagctgaagtcccaatgtttggccagatgcgtagtgacggtgccaacgtcaactcatccaaccatggggacggccgtcaaatttgttaaggtttattttggttacaatctgaaaaaccgtgaagtattttgggattggtgaaaaaccgaggtcatgcataatttcttccacatactttaggaaaatatatcgtaataagaatttctaaaagcattacataaaaaaaaacttccaagaacaaaactaaagaagagaggaacatccattccacttttttatttcttattagtactatcacatacataagaggagaaaattatagatgctacaattaattgttggcgatctcaccaccaaattaaaatagtgcagattattaaagagggcacttttaggctgcgttcgagcgcaggagaaagagagaaatattgtttcgtttttcgcgcgcacgcttcccgaactactaaacggtatgtttttttcaaaaaatttctataggaaagttgctttaaaaaattatattaatccatttttgaagtttaaaatagttaatactttattaattatgtgctaatggctcacctcgttttgcgtatcttcccaatctcctcaatcccctccttctcaaacacacccttagtttgcaaaatccgcactccgtcagcatggatgccatgcctgccatcctctggccgacgcagcccagcagcggtgctattcggtcgacatgagcaccatgaaattcttttttttcacaaaatgaaattaaataacaacgaaatattgctacccaattggcaagatgtattcagaagaacattgaagttcatcatttattcaccatatgtatatatgcttcctgacaaatgaaagcactagttatttagcaaccccacagagtcatacacacagctagctttagtagcctagtgaccagttctcggggtcctaggataacctagccagtagcagacaccacctgtcccattggggatgtccacgttgcagaacgccgggaggctcgccgccgcgcgctccaagtcccctctccggcagccggggaacacctcggccatggggtgcccaacatcggtggcgccgagctccctgtagatgcctccaaccatgtggttgagcgccgagcacctgcaccagctgtcgtcgaccgcggcgagctgccggcagcagtcctgccggagttgctcgtccacggcgccgccgggtgcgccgtggcccacgcactggcgcttcaccaccgcccggcagcgtggcagcgagtacatcgggtagcccattcctggctgacaacgctcgccgaggctgtacaccacctggtctttgtggtggtccgccatggtcgccgtcgcggcgagcacggagacgatgatgaggagcaacgccgagaacactaccttgttggaagccatggctttttgtttgcagaaaatctttagtctgaatttgtatgagagggataggtttaaggtcttcatctattggtggttttatatatagctataaagactaaagtgatttaagaagggacataaaagttttagctgttcatgagctaatagattaacttgtggttttgtatacatataaaatattaattgtgatccacgcctaatgtgggcatcatatggactaaagttggtaaaagtggattgatatgcaccacactctttattaatttgaaccttccgtggaagaaaattaaagaaatgcacataatgtcaacagacatatatagttttgcatgcaaggtaacaaaatcagttcatctttatttccatggcttgtatagtgatccaaattgtggaacaataaaaagaatagttctgaacaaatactttaaaaagaatgctctggaagctgcagtaacgaaagctgcatcactagatttcagaaaattaagaaattaacgtgcctgatgaagcatataagtattggagttttctgaaacacaaatatcatatatatagatagctttacgcgcacgttggataacagggttatattaacaaggcacggcattatatatggccaggagaagtacgcacgcataatcactttgtttaaaaattaatgatacaaattaaatgttaggaatattttgtgctataactttgtcgacttgtaataaagtaaaaaatacgtgaggttaaaatataggtattatgtgaggtggaaggaagaggttttttatttcgtgacaaaggaaaaagaaacaagctagagggttgttagcatggggtgtgagtttaatgtccttcaaaatctatatttatttggaattgttggtttgaccatatgaatgaccttagtttttgcaaaatatactatactccttgtgttcctttttatttgtacaatcacgacatagtctctctcgccaattcattaatttttatcattcctattgataatcatatattcataataaacagttcaatataactacagttatagtcttttttttatgataaatcaatgagtgccatctttgaatattaaatcatattatatttttgcatctataagtgattaaaaaaataatcaagatttcattgcctcctatacatccaaaacagcatctatttgtgaacggaagcaacactttaatggcttaacaagtgatcttatttgtgcagtcagcgatatactctatctgtactctatctcaacaaaggagtatatgagaacccttttgttgtgtatgacatgtaggggtgaaaacagtacggaatttttccggattccggtcatgttttcggaaacggaatcggccggtcggaattttttcggaatttctcggaatcggaatcgaaaacggaaatattttctcggaaacggaatcgaatatgataatagcagtttccgtcggaacccggaaacgatcggaaacattccggaaaaattgtcggaatttccgaagttaaaaataccatagattcaatagtccataattcatccctagcttcccagcccaacccaaatcgcggcggcatctaccctaaccggctaaccctataggagagagaccgtcagactcagaactcagacgcgactcgcgagttggaggcggagcggcggctgcggcatccagatcgcggcatcgcggcgccggcgtgccctcacgcccaccgcccgtggcgccggcgccccaccgcccactgctggtcgcctggccggctggcccccgccgtcctcgctcccaccatctcgcgccgcccttgctcttcgtcgtttcgccgccggccgccgccaccatctcgcacctccgccggcctgctcggtccccgccatctcaaggcgccgtcccaccgcgtctcgccgtttcaccgtcgccaccaccgccgccgacgacggaacaaccaccacaccgacgaggcgacgacgacaccaccactgcagtctcttcctcaccgccaccaacgccgacggctcctcgcctcgcagcagccagcagcccagcggcagcatctgagcaaccagcagcagcaggtgtatatagtgattgactttgcacttttactaatgctctatcattttttttgaaggctaatggaacggaacaagagacagagacagtagaagcggaatgttctaatgaggatggcattgcgccaatggatgtttgaagaaaatgttggtcaatttaattttcaagttacatctaatttcaagtttccatttcaaattagtgtactcctgctgcacaagtggatgagatatgtttgaaccatgtactgatgtgttttgtgattgaactatgttttgtgatgaactatgtatttatagggtgatgtgttttgtgattgaactaagtactgaaacactgatggactgatgtgcgttgctgttctgtgatgattgatgaactattgctgttctgtgatgattgatgttgtgaccttaggtcacgaacaagatcggggataggccggaaagaagtgttttcccgcctatccttagaaacgagctcgaacagcaaacacaacttttgaggattacttttgtattcaagatgttttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcccgggaattcgaattcccctttgccttctctttcatccttggaaaacacctgtgaaattgtaacttgtccaaaatatgtgtagttgtattagcgattatggaatgtccctaaaaaggtgttcttcacccgaagaggtattttctattcgaatgagtgttcttcctctgggaaggtattttccctttgggaaggtgttcttcctcttggaaaggtagtttccactcaaaatgagtgttttcccttctggatacttaggtcttgcaaaacctcgtagtgttttgaccgaattggaggaaaaggtgtttgcaccctgctacaacaagcccctcacgggtaagggcgatgtgtgttttcggccgaaaccgtgcctgagtttatggaaaaagggggaaaaccgccgtcctcctattcggtcgaaacacactattcaaatatgcatatacgccacgtttactattcatttatttttattcttattatttttcatttttatttatttatttattgtgtttttttttgaatgccacgtgccggtatttcattggtgcgctcaaggggtcgcgtcgcttcgggtttcgtgtccgctcgtaaacccgcgacccttaccaccctgcgctatataaggccaggaggggtcgctatcacgtgacccacgccaccactcgtttgctctgccatcaactcgaaatcacaaaatactcgaactaaatctctttcttccttcttccattcgagttttggtgctttgcttgatttcttcctttctcactacacaacatggggaaaaacaagaaaactgcggaaaagtcgaagtccaagaaatcaaaaagccacgaagatacttcttgtggtattggtgcctcttcgattaaggaaaaaaacttaaacgatcttgttgatgttggttggatatctggtcgaaacgttgtaattcgaccagtgggagaatcaaggccttctcccaagctgggatacactcttgtgtttgaggatttcttctacgccgggtttaaattcccatgcagcacttttttggttgaggtcctgaaattgttcagacttgagtttcctcaattgactccaaatgctttagttcgaattgggcttttcgaatggatgattcgaagctgcggtgggacccctcgagctgaagactttgcatacttccattgtactcggcactacaccaaacagaactcgaagtttgggtgtgtaaactttgctcctcatcccaagcgcggaagtccatggccagctgtgtctgctattcgagcaaaatgggggaacaagtggcaatcgaagtggttttatcatcaaatccctctcagcctgctgaatgataaggattgtcctttttcgttctctgggaagaaaccgaaaactgtctccgagccatcagtctctttgtcgccggagttcactgccatacaacctcgaatcgaagaacttgtttcgaaatttagctgccgagacctggtggaagagtttgttcttctcaaaattagacctctttcgagcggctgggatatcactctcggagaaatccccgaaaattgcccttccagtcttcctccatttgtggtttcgtctgatcgtaagtttccttttcgaactgcaaaccttgtttgtcttgaaaaagtgatttagttaagaagatttattttctccctttgttatcttcttccttgtagttgtgattccagaggatatggtccgcccagttcgaaaatttcttggcccttataccaaggatgagcatttgaaatttttgacacttcaaaatgagaaaaggcaaaatcgggtcttcgcctctctaggctccgatatccctgtccgcgttcatcctgaaattgtccccaaactaaagaaaaagaaatctgtgaagccctcttcctctgatgatgatgatgatgttgaagtggaagatattgacgaagaaattggggaagaaaatgctgaagaagaagaaggcgaggaaggagctgatgaagaagagaacgactcgggtgatgatagcgactcgagtagcagttcgagcgacaactcgagcgacttgtctgaatctggtgatagcaaaacagttcctcctcctactgttttagctgatttgaaaaggaagaaaactgccagcagtcctcctcctgaaccgagttctaaacgagtgcaacttgttattgacagtgatgaagagttggatgaagatgatatccgtattgatctttctgctatccatgtcaccccaattcgagctgatgctagttttgccctttcggcaaaagaagtagcttcactgtatgttgttgccccaaccaccacggttgtcgagaaagattgctcgacccaagtgggtgatactgttgagacaacaaaccctcttcgagctgatcgagacttggttgcaaaaaaggcaaaaacgcccgtcagtgcagccgaaaagtccgaagcagggaagagtgctgctgatggaggtgttcgaactacaggtagttcgaacccaactccacctccgtcaccgccgttcatcgcaaccccttccccagagctgatacaaaacgttcttggtggttttagcgaacgatgcgcaaaagatggacattggcttatgggtcttcctaatttcaacgaactcggggaaagtagccatcatggcccaaacctgtgtttgaatgacctaaagtatcgccaccccctgagttcgattggtgatgaactcgagaaagttctgattactcctgatcttgaaaaggagtttttggaagaaaatgatcttatgtcctcttggacagcacttgatgtatctgctgcacaggtatttttatttatctatttatttatttatttatttatttattattattttctttttaacttaaaacctattttctgatgcgcagactgcgagccttgctcgtcttcaacgtggtgttgctcggaaagctcttcgagctctttgcacgcaacggaagaaatcacttgatcgcatcgctaaactcgaaaaggatcgggattatcttcgctgcaaacttgatcgaatggccgacgagaagaaaatcaccaccgatctcgtgcgcaagttaagcggcgaaaagaaagagctttccgaagaaaagaagttgcttactgaggaaaagaagaaattactcgctcatgtaaaagcattcgagcgaaaaatcatcgagtatcaagacgtcgcacgacaacgcgctgaatcagaagacaagatgaaggagcaagttgaggtcttggagaagaagaataaagaactcgaactcgcctgcaaaaatcaaagcgagaagatatctgctttagagctcgagagcgaaagttgccgccaacttcttctgaaaagttgcgagaccgttcgaatcacgttgcgaagtctaggggctgacatcagcttgctatcggaagaaaataccttagcagctgtgggaaaatggttcgaggaattttccattgggctaaaagatagcgttactccctttgcatctcgctgctcgaagactgctgtggagagcctttcggcctgtctgctttcaaatgggtgtgaacactttaccacccttaaaactgatatacaaggtatacttaatgatgaggccaaatttgcacagcttcgagatgcagctcaacccgtcgtaaaggctttccaagtgctttactggaagaagaaaggatatgaagataccctgaggtctctccgagcatctcttgcctcgagatcaaagtcacaaccggccagttcgagccaacaagataaagacagtagtactccgagctcgagcgcacaggtgtgacgttcgtgaaaagaatagttaaggatgcttcgtatgttcgaaaacaatgctattttgctgcttcaaaaccgttatggttgagagcctttattgtaaaaattcatctcttattgcatgcttttcacggaaattccctttctttgggggggctgcatgttaactcgaatcgaaaacttgtgattcgacgcaacaacactttgcctactcgaaatgtgaagcacttagcatttcgagaccctgcaaagctttcttctaccaggaccgccgtctccgatgacgaactcgaagcctgttatgataatacttgtatatttgcttttaagtttttccgatggcaacgaagccatcgacatgacagtttacgtgactttgtacttgagtttagggaacggcgttcgaacaatactcttgctagtaaagccttttggcaaaacttccaaccatccgaacgccaacgtagaatatggaaaaggcgttattcaatagttccatatacagtaatgccttctcctctcaacattgtttatcccgactcttttctttcttctttgtagagtttgtatgtaacttgttataccttcttaacatcaaataaacccttcctttcttcttttctttataaatgctctttatttcaattgttcaagcacccttaggtaaactacgtcctccttatctttggaagaagttacgaaatcgaaacgtactttatctcgtcacgtgcattttccgccttttgagctcgagcgaggggaaaatagagttcgagcattctttagttggttttttggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaacgtattttacctcgtcacgcggattttctgctttttgagctcgaacgagaatagagttcgagcattcctgagctggtttttaggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaatttgctagtcgaaagtattcgactcctagcgtgaggagttatattttgtcgactttgctagtcgagagtatttgactccgagcgtgcggagttctattttgtcgactttgttagtcgaatgtatttgactccgagcgtgcggagttctattagactttgttagtcgagagtatttgactccgagcgtgcggagttctattttgtcgactttgttagtcgagagtatttgactccgagcgtgcggagttctattttgtcgactttgttagtcgagagtatttgactccgagcgtgaggagttctattttgtcgactttgttagtcgaatgtatttgactccgagcgtgcggagttctattttgtcgactttgttagtcgagagtatttgactccgagcgtgcggagttctattttgtcgactttgttagtcgagagtatttgactccgagcgtgcggagttctattttgtcgactttgttagtcgaatgtatttgactccgagcgtgcggagttctattttgtcgactttggtagtcgaatgtatttgactccgagcgtgcggagttctattttgtcgactttgttagtcgagagtatttgactccgagcgtgcggagttctattgcaatcatacacagaggcatgttttttatacaggttcgggcctccattatggataaaaaccctacgtcctgtttatatacattaacttggatatcattcgtatttacatctgagtgagtatactacaaactcgagctcccgtgttctcctttttctctttctctctctctctcctttttttttaggcataaaatttctttaaagaaatagcattccaagtatgctttaactcatcaccatcaagatatgctaacttgaatgctcccgtttctgtcttctttttgactatgaatggtccttcccactttgactcgagttttccaacagctacctcattgagcactttcttcaagactaaatctccttcttcaatcggccttgtctttactttttggttgtaatagctctttgttccttctgtgtatgatgccatcttctccaaagcttcaacccttatttcatctagcatttcaagagttatgtctcttccttcttcatctttttggtcaaatatcattcttggagaatgtgcccctacttcgcttggagtcattgcttcatcgccataaaccaatctgaaaggggtcatgccagtcgaccttactaccgtagttcttagtgcccaaagcactgatagcaaatcctccggccattttccttttgctgatccttctaacctcttcttgatagcttccatgattttaccatttgccctttccacagctccatttgtctgaggatggcctacagaggcaaagttgatttgcaaattaaggcctttacacatgtcttgaaattttccagattcgaattgctttccattgtcacatactatttcccttgggattccaaatcgacatattatgttcttccaaacaaacttttgtagtgctgcagaagttattcttgccactgcttctgcctcaatccatcttgaaaagtattcaattgcaacaatgataaagcgcaaatctcccttcgctcttggaagaggacctactatatctattccccatctgtaaaaaggccagactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctcatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctataccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactg

SEQ ID NO: 75113 - DNA, 44935 bp, Oryza sativa
tactgaaacactgatggactgatgtgcgttgctgttctgtgatgattgatgaactattgctgttctgtgatgattgatgttgtgaccttaggtcacgaacaagatcggggataggccggaaagaagtgttttcccgcctatccttagaaacgagctcgaacagcaaacacaacttttgaggattacttttgtattcaagatgtcttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcctgggaatttgaattcccctttgccttctctttcatccttggaaaacacctgtgaaattgtaacttgtccaaaatatgtgtagttgtattagcgattatggaatgtccctaaaaaggtgttcttcacccgaagaggtattttctattcgaatgagtgttcttcctctgggaaggtattttccctttgggaaggtgttcttcctcttggaaaggtagtttccactcaaaatgagtgttttcccttctggatacttaggtcttgcaaaacctcgtagtgttttgaccgaattggaggaaaaggtgtttgcaccctgctacaacaattgatgaactaagtgttgatggactgatgttctgttgttgttctcaaacccatttcctggagtgataggctgatagcagtatagcacctgaattgtgtataccttataggcttataccattctgttttgctgtattcttttagaatatttgttatgcaaattatatgaagttatagaagaatatattttgctgtgagactcagtttgaggggtttatgtattccgataaattttcgttaccgtatccgcgccggttcgttttcgctccgttttcggttttgataatattcgtttccgttttcgttttcggggtttccgatttcgattccgattccgaaaaaaaatatgaaaacgaaaacgataaaggttgtttccgtccgtttccgtaccgttttcacccctaatgacatgcacgcattatcatacatccatgtctactaaatttttttttcaagtttagtttgcacctataaaaattaaaatctggaaattcatttgcacgggcgagtacttaagagaacgcaatgttgaaattgatctccacggctgtcggtatatatttacaaatctcgcgaatttcaacgttacaggccatatagtcagcctcgaaaatgcccatgtaaacgaactagctatcggcggtctacacaaacatttttttatagtgtcatggtgacactcattttttctcaccttgaaaattataaaacaatgaagcgtagcaaggaaatcttcatagagatataaacagaagaacatctgagttcatcatttattcatcatacatgcttccagataaaaggaaacacaaattatttagtaaccaaatcacacacatgaacagccaataactagctacatacagaaggctagtagccagttcccggtagccagtagcagacaccgcctacgccattggggatgtccacgttgcagaacgccgggaggctcgccgccgcgcgctcgatgtcccctctccggcagccgcggaacacctcggccatggggtgcccagcgtcggcggcgccgctctccctgtagatgatcctcagcatgtggttgagcgcatcgcacctgcaccagctgctgtcgatggcggcgagctgccggcagcagcctcgccggacctgctcgtccaccgtgccgggggcgacgcactggcgcttcacgaacgcccggcatcgcggcagcgggtacgtcgggtagccgattcctggctgacatagctggccgggagtgtagaccacctgttcttggtggtggtccgccattgtcgtcgttgctgcgagcacggagacgacgacgacgagcaacgccgagatcactaccttgttggaagccatttttttttgtttgcagaaattcttgattgttaatttgtatgagagggatagaagctctcccatctatgggtggttttatatatagctataaagactaaagtggttcaggaaatggagacaattttttttggctgttcatgagggattagcttgtggttttgaatgaaaattttgttgttattcgtacgcctaatctggcatcacacggataaaagttggttaaaggggattgatatgcaccacactctttaattatttcaacttattttgattcttccgtgcaagaaattgaattaatgcacacattgtcaacagacgcgacgcatagttatgcatggtaacaaaatctgttgatctttagttccatggcttatatggtgatccaaattgttgaacaagaaaaacaatagttccaaacaaatattttaaaagtaatgcctctggaagctgcaacagtagacgtgcctgatcaagcatatatatattggagttatctgaaacacaaatttcatatatagatagctttaatgcgcacattggataacaggttatattaacaaggcacggcattatatatggctagaagaagcacgtacgcaaaatcactttgtgaaaaaatgatacaaattaaaggctacaaataatttgtgctataatcctgtcgagttgcagtttgtgccagccctttttttaaagaaagtataagggatatcaaaatataggtcttaagtgaggggcaagaaagagtttgttattttgtgagaaaggaaacaaaataaaacaagagggttgttagcttgggtgtgagtttaatgtccttcaaagtgtatttgttttatctgatcgatgatcttaattattgcaaaataaacaactcattgtattccttttttactcgtcatacgtaccatctcgacacattaattctcaccagttcataggtttttgtcattcgtattgataattatattaataaaagacagttaaatataacaataataaatattcatattttatttttgtgtatattagtgagttaaaaagaaatcaagattttgttgcctcctatccaaaacagcatttttccatgaacgggaagtaacatatatatcaatagctttacttatattttgttcacgctttcacaattgacatatttgtgtagtcatcgcagccattttttctatatgtatacttcgttgtaatttatttttttgctggcatgcagtatatgacaaagttattgtgtatggcttttacagacgtcatgaaaaagaacagaatgtccaagaagcagttggaccagagaaaggccaaggcgaacttgataagatctgaaatggactgtgctgctacaagggtggcaaaggggatgctttttgacaggtcatgaaactagtccccgctttcacaattaacaagccacgtaatagaaattactaagaacattacaaaaaaaggggaatttcaagaacaaaataatagaagagaggaacatcgtccattccactttttattacttattattgtcatcagatatatggagacgcagcaatcgtggatgtgaaaattaattagtcggctggctagtgctagctagtaacaagctactcccttcgttacaaaataagattatagaggggaccttcaggttttgcaatacactaatacacaaacgatttttctatactagacttcatgaatttttgcaaacagaccataagtgatggcgtatgcaaaaatcgaccttcatttttgcatacgggcgtcttaagaagccgtatgtgaaaataaaatttgaaaatttaaaaatttgaaactagtttatctcactcgtatgaactctaaattggatgattctttttcctaaatgtttctaaaatcatactctatcatgttattgtgttcttttgctattattttggccatttttccttgtgacttcgttttataaattaaaaatttgaatttcaaaacttcaaataatattttgaagcagtaaataactttagtcgaaaagtcatcaacaacaaagttgtataactcatcaagatctataacttttattttggtcatttcttcatttgatgaagtgatagtaatattttcacaaaatttacatatctctcttatagtttataaaaccatatgagagatatgtaaattttatgaacaatgttactgttaatttgtcggacgaagaaatgaccaaaataaaagttatagatcttgacgagttatacaactttgttgttgatgatttttttcaactgaaatcatttagttttacaaaatgttgtttgaagttgtcataatttgaatttcaaattcaaattgttgaatcaaagtcatatagaaaaatgaccaaaacaaaagttgtatattttaataagttatacaaccttgttagtgatgtatttttcatttgaaatcatttactacctgaaaaattatttaaatttattatattttaaagttcaaattttagatagttcaatcaaactcggatagagaaatgaccaaaagaaaaatggtagatctcaatgatttctacaactttgtttttgacaactttttcacatgagttgatttagaaccataaaattcgattcgaatttctcatatttttacatgcagccccttaagaggttcgcatgcaaaaatctacttagattttttcatgcttaccttttaagtggtccgcatgcaaaaatgccaccccaatttttttcatctccctccactctcttttcccttccaccacttcaattttttttcaacacatctcctctctctctccccctctattatttaaggcaaattttgctacaggacacttgttatgtgtggttttagccccaggacactgcccaaactcacttttgggtgaaaacactccgtaaacgtggtaatttaccagtggacaccacgccgattaaaataatgctttctctcagagcgcgcttgcacggggtggcgtcggtcacggcaaagatggcgaggatggcggctggcggagtggagcggggtggcagcggcggtggacgagcgcgtggccggtggagcggcagtgtcggccaagcggagtggcagcggcagcgaccaagtgcgcgataggagtcgcggcggcgggcggctggcgagagtggcgcacaccccatggcgacggcgatggcgacgcaagctcccacgtcggctgatctctttggcggcggcggtggtattattttaatcgatttttgacatttcacgcgatttctctctcctctccaaccggaaagtattattttaatcggcgcggtgtccactggcaaattaccacgtttatggagtgttttcccccaaaagtgagtttgggcagtgtcctagaactaaaaccacatataacaagtgtcatgtagcaaaatttgccattatttatttttactctccccctctctctctctatctccacggatctgtcctctccctctctccccctccctctctgagagcgggtgccggtgaccgtgagcagggacggagatggcatcggtgggcggcggatccagcggcgccgccctagggagcggctacggctacgacgacggcgggcgcacagcgggggcggcggatagatccggcgagtgggcggcgacgcgggcggcggcgccgtcccgcgcagatccggcgccaagggctcttctcacccgcgcgaacagtggggccggcggtcggcgtcgacggcgggtggtggggtagtcgatccggtgatggcgtgcagcggggatacggcgctccggcggcgggctagggttcgggtttgttggtttttttttccgtgattttattttcgcatgcggctggtataagcgaccacatgcgaaaatcccatttcgcatgcggttgcgccggccacatgcgaagagcgtcattttggcagatcttcttgcccatgcggttggcaaccgctccttctcgcccgtatgcaaaaaggggttttcgtagtaacgatagccatactccgtcaacatatacaccgtgctggcgatcctctggccatcgcagccctgcaggtagtgccaccatgcggccgacacatggacaccctccttagcatgacattccatatttctcgtcatatcaaagtttaaagaagtaaagaacgacggcagatagctagcgaatcatcaagacatatacagaagaacatgggagttgttcatcatttattcaccacacatgcttcctaacaaaaggaaacactaattattttaggagtaaattgcattcacggtatatcaacttggcaagtggatacaatttagtgtaagataatatctacgggagcaatatattctaagataatataagacttgtgcaagaggttcttattgccatctatggatgagggttatgcatattcttgccaactatggccttgtttagttggggaaaatttttgagattggttgttatatcgaatatacagacacaccactggtggagaaaccatctttcgtcggtcggccgaattccacaatagtcccggttgcaataaaaaccaggactgttgacgaaaaaatcgaacacaccagcctgggagatcttcttagctcctgtgcaggtccaaaaattgatgagatgcgggcgtgccagtcagtttgatcctgcaactgacaagatatgcaaatagtagatcaaaacagccgaacggctgacaagccgatggagtagttccagccgatgccgataatagccgatgccgataccagccgatagcgataggatttaagcaatcggctatataaaggcaatcggctactgataataaaatataacaataatatagtccagtataaaccaatcggctagcattgatatgatagaataagcattgatatgaaggttagagcatacatcagctggaggtccgatgtcatgacatccacaagattagattaaacagtgaagcctttgttgtcatcggctaaatccaacttatatgtatatgcaattcttatgagccgatgcaacatccagataactcaccggctgaaaccccgatgaaacccttattggcaatcaagaagcaggctagatattatggttctaagcacgacatagtagatcaaacttaactgatacagcactaagtatgaaaagaaacataatatctagacaatcaagccgttgactgagttttcagggtggtagatgtctaagctaatctaatctagcaacgggatttagccgataccggcagaaaccctaaaacgagaagtagtcgatagagctaaattgatatgctaagactagattaacagagacatatgataaataggtaggcaagtatatcatccaaaccagagcaatccaagaggtcgaatgtactgatgcagccttgaacgacgccgatgtagacgatacaattgcctgggctggcggaacattggacttaccccttagccggagatcgaacaccgatgcagccccgcgtcaggtgccaagtcccgccggacaataaaataaagtagaaaaggtaaaaggtggcgatgcgccgaattgtattgatcgtggagatagattacatagaccctgggtgtacatatttatacccatgggttgatacaagtccttgtcggacaagaaagaagctttcctaaagataaaaggaaaagataaagtccttataggacactaaacacactttcctaaagataaaaggaaactaacaaactatttctaattaatagataacttgccatgccgcattctctttgaactcggtcttttctggataagcttcctttagtagatcaatttccttaaccgaatatagcaagaatccgacaactaacgacttgacaactctcatcggctaatcgcaggacttcgaagccgatgctgactctaagccgatgactactccgggtttaccaaatttcactgttaacaggcgttaaagatgatctttagtcccggttaaaaagggtaacgggcatatttgatctttagtcccggttgagtcagggcctgtcaggcccccccccccccccccgggatctttagtcccggttggtaacaagtatctttagtcccggttggtgttaccaaccgggactaaagatcacggggatctttagccccagttcataacactaaccgggactaaagtctcacccttagatattcgtcttcttcctcctctagctgcccgagcaagcttcaaaatttcttcaaaaaagaggggaggtcatgccaaaatttctagtgaatttattttggtgattatatacaaatcggaggtgcctaaaaggttagcaacttcattctccaatgttttctttgtcatattatatttggagctatgttttgcacacttttttgtctccaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtcattattgtatgactgttgaaagagtttgtaattattttataattattgtatgactgtcattattgtaagaataattatttgtgtacaatttttgttcatctcatgtagatggatcggcaatggatgtacgctgaccggtggtccaaagaggttattgacggcgtgcgttattttttgagaatggccgaagctaacaggcataagggttttatttgttgtccatgcaataagtgtaagaatcagaaggagtattctgcatccaggactattcatttccacttgtttgagtcggggttcatgccaagctataactgctggacatcccacggagagcaaggggttgaaatggaagaagatgaagtggaagacgacaatattccggactttggtcaatacgctggatttgaaggaaatcaaacggacgaggaggaaagggatgttgatggtaacgacattgcggatgatcttggttagatgttgcaagacgccaaggaggactgcaaaagtgaaaagggggcccataaattggacaagatgttagaggaccacagaacgttgttgtacccaggttgcgagcaggggcacaaaaagttaggataccactctgaagttcttgcaatggaaggccaaaaatggttttagtgacaaggcatttggcgatttattgaaactcatcaaggacattattccggagggaaacaaattgcccgagacaacgtacgaggctaagaagatagtctgccctctatgactggaagttcagaagattcacgcatgtccgaatgattgtatcctatatcgcggtgaggagtacgagaacttagaagcatgccctgtttacaaagcactacgatacaagattagacgagacgatccaggagaagttgacgggcagctaacaaagaagagaattcctgctaaggtaatgtggtatttccctataatataacggctaaggcgtttgttcaggaacaaggggaatactagaatgatgcgatggcacgctgaagagcgtcaacaggacgggatgctgagacaccccgccgatgtttcgcaatggcggaacatcgaaataaattttaaagactttggaaaggacgcacgaaacatacggtttggtttaagtacggatggcatgaattcttttggagagatgagcagcggccatagcacttggcccgttacgatgtgtatctacaacctcccccctggctatgcatgaagaggaagtacataatgatgctgattattattcaaggccccaagcaacctggtaacgacattgatgtatacctaagaccaatggtcgaagatcttaaactgttgtggaaaaaggaaggtgtcccgtgtgggacgaggacaaacaggaggagtttaacctacgagcgctgctgttcgtaaccatcaacgattggtctgcacttagcaacctttccggtcagtccaacaaggggtacaaggcttgcactcactgtatggatgaaacagaaagtacgtatcttaagcactgtaggaaggttgtgtacatgggtaatcgtcgattccttgctgcaaaccacccggtacggaagaaaggcaatcactttgaacataaggcggaccaccgtgcgaagcctaaacatcgcagcagtaaaacaatgtttgctatggttaaagaacttaaagtagtgttcggaaaggggcatagaagccagcctatagagagcgaagatggtcacgcggcgatgtgaaaaaagaactctatattttgggagttaccctattgggaattcttggacgtccgccacgcaatcgacgtgatgcacctcactaagaacctttgcgtaaaccttcttggcttcctaggtgtatatggaaagtcgaaagatacactagaagcacgtaatgatctaaaccatatggaacaacgcggcgaccttcacccagaaccaaaggagaaaggaagccattacttgagtccagccagctacactattagcaaggcagagaaggaaagtatgtttgaatgcttggagcacataaaggtaccgtctggatactccacgaatatcaagcgaataataagcacgaaggagaagaagttcacaaacctaaagtctcatgactgtcacctgttgatgacacaactgctaccagttgtaataaggggtatccttccagactatgtgcattcatgaacacaatttcgcagaaggtcatcaatccggatagattagaagcccttcagaatgatgtggtgcattgtcttgtcagttttgagtcgatatttccaccttcatttttcaatataatgacgcatctgctttgtcaccttgtcaaagagatcagtattctcgggcctgtgtacctacacaacatgtttcctttcgagaggtacatgggcattctaaagaagtatgttcgtaaccgtgctcgtccagatgaaagcatcgccaaggggtatggaacagaggaggtcatcgaattttgcataaaatttattgaagacctttgcccaatcgaggtacctgaatcacgacatgaagggagactatggggagagggatctctcagaaggaaagcaataatggcggtagacaacaatttattccgtaaagcccatttcacggttctgcaacaatcttcattggtagctccttacatcgaggagcacttggctctagttcgcgtcataaacatcggtaagtccgatgcatggattacacggcatcacattgatactttccccgcgtggctacgacaacatctcatgggtaacgagacgatcaaccaacaacttgtgacatcccggcctagggcttaataggattaatagaatactcatatcaacaagttgcaacttcttttccggaagccggtctcgaaagaactcttaggttaagcgtgcttggcctggagcaatttcgggacaaagtgtgcagaaaacactcactagtagtgtgcacgagtgaggacaaagtgtgcagaaaacactagcgttggtctgtgagggtagtctatgtcctagggaagctgctagatgtagagagggcccggtctcggagagtgtggggcgtcacacaactggccttcctggcggggcccggtctcggagagtgtggggcgtcacacaactggccttcctggcggggggaccatctgggtcgatcacgacattccaaggatggattaggttgactggtggaggtgtaatgattgatgacagtgggatgacaacggttgaccttaacaaggttggatactcggacaaacattttgtccttgccaatgatgtaacgcaagtcttttacgtgaaggacatgtctagcaaaggaaagaagggcagaggacctgacgagccgaagcgtcacgtggttctcccaggcaaaagaaaaattgtcggagttgaggacaaaactgacgaggattacgatcagttggatgggcaaccccctttcacggtgacgattgaccctagcatccttctatcaaatgaagacaccccttactcacgtagcgatcacaaggagggaacaataatgaggagaaagtacgtgcggtcaaccgtcaccttcgatgtattgccgtaattattgtgtacacgatgtaatctattttggatgtattgattatccatataaatcaattgttgtatggcatatgttaattacgtacgatgattagaggtttgaacaatattaaatcatgtaattgctagttatatgcgataattagaatttttaaaagttttaaatcatgcatgtggcatttacatatgttactgagagtttttaacaattttaaatcatgcatatgctagttatatgcgataattggaatttttaaaagttttaaatcatgcatgtgacatttacatatgatacttagagtttttaacaattttaaatcatgcatatgctagttatatgcgataattagaacttttaaaagttttaagtcatgcatgtggcatttacatatgttacttagagtttttaacaattttaaatcatgcatatgctagttatatgcgataattaggatttttaaaagttttaaatcatgcatgtggcatttacatatgttaattagagtttttaacaattaatttaatatcattcatatgctaattatatatgattatttgaatttttattaattttaaatcatgcatgtcgtatgtatttacatatattaattacagtttttaacaattaatttaatatcattcatatgctcattttatatgattattagaatttttattaattttaaatcatgcatgtcgtacgtatatacatatgttaattagagtttttaacaattaatttaatatcattcatatgctaagtatatatgattattagaatttttattaattttaaatcatataggagtatttgcttactacgttttatccacttaatgtactacagacaacaataatttttcgaagtaattgtcattaatttgaacacattattttctattttagaaacacatatgtaatggaaattaatattcagtgcgcttatcagtagtcccggttcttaactctaactgggtttaaaaagaaattggaaatagcgggaaaatatctttactcccggttattctcatcaaccaggactaaagatctagaggtatatatattcccgatgcgcgccttcgtcttctccaccaacacttagaagttttttccccaatcaatttctctctcggcttctccttcgccgccactacctagagcatccccgcgccgacgccgccgtcgtatctcgcggtcgtctcgcgcgcgttgtcgttgccgcctccgccgccgtcgcatctctggggtgagagccgccgccacctccctctctctctccgacctcgatctctctctctccccaaacagccgccggccgcctcgttgccgacgccgccgccgacgtcgtcgcggccgaacacgactccgccgcgccgatgatgactaacttgtcacgcccggaaattcactagtaatttccgaacttatttgtgcataaaatcctcgtccaggaatcagccgaggtacacaaactgacaatttaatatacagattcatcaaattagctaaaacgataaatacttacttaagaggcacttagtcctcaccatgaagaaaactgcagcggaaaataaaatctagcgaagctccggctccactcccacaggcagctcaactggggtataagccaaacgtcttctccttctggatcattttcttcaactgaggttgattgattattgaaagaattagcatatgacatactcaacaagccacacagcaaatatgcaagtgcacaaggataccaaaggatggcataatataggctcatttgcaaaaacagcatttagcaaaacatttaagagaagtaaaacagtggagtaattaatcagaaattttaatcaacactgaacaacatacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacgacatgtcacaatgtgcctcagtaccaccacggtacctcggaaaggagctgtgacattaccccttgcataacacaacccaccacagtgcaccgttcctggatcataatcaccccctcaaaaaccagaggcatggactccccagcgacccccgtgggcttatctccgccacttctcagtctggtgctctgcaatgaaccatgctatacgaaaggtaaagccgttgcccacgctggcttgtggttggcacggttaatgtttcacaacagtagctcgcgaaccggtccttaattgccatgagcacgactctcaaaaccatgtgctcacaacccaccattatcaagatttagttggcaagtaattaattaaccaatcacgattgaccatcgtgaactatcattaagccatcattaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaacctccgcaacgacggaaacgacaagctaacacgcaaaacgaagaaaaaggctaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatagccggaccaagatggcgacctcgccggagattggatggtcggctgcgactttggaggacatgtacacgtagaggacgacgagacgaacccaacggtactcaccctcgaaccaaacgacgaacgacgacggccgacgacgaggtctagcggcggcgcggcttcggtcgacggcggcgacggggctccggtgatcggcaacagcggggagagagcggccgggcttctccacacctcggcgtaccttacggcggtgacggcggccggcggcgacgacggaggcggcggcacgacgcggatggagctcggccggcgacgacggcggggtggagcacgtggcggcggcgctacgaggcacgggagaccacgggagagggggcacacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttgggggtaaagatagaggaggataagaggaatatttcccctcaactaattttagaaaaaggagcaacgagaggcgagattttggaaggggatcggcggcaacaggcacggcacggctctgctctggctctgtccagagctggaagatgaacagtagcgcagggaggaaaagtagacttcttgccgggcttttcttttctcagcctgtttagaagagggagcaataccagactttggctaagagaagaaaagagaggatgcaggctcgggttgggccggtggaagagagaggaaggaaaggaaggaatgggccgaaaatggcccaagctgaggaggaggattttattacttttccaattaaaataatcacttaaatgatctttgaattgttaaaaatacttccaatgctcaaataatttcaagaaaaatcctgaaaatacttggacactcaaagtacataaaaaattacaattagaccatttaatgattaatttaatatgtgggtaattacttaaatgctctttgtatgattaaaaattacgaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacaccaaccctgacctcgatgctgccaccaccggcgacgacgtcgcgccggcagtgccgacgaagctgcgcgcaccacaacgccgggctgcgccacgcctccgcggcggcacgacgccgagacaccacgacgccgccgcggcacgccctcgccgcgccgccacgccgccaccgcgcaacgccgccgctgcgccacgtcgatgccgcgccgccacgctgccgccgcgccaagccgcagccgcgccgccacgccgccgctccgctgccgccacgtgaacgaacgaacgatcgtgaacgagaacgaatgaacgaacatgaacgagaacgtgaacgaacgaacgaacgtgaacgaacatgaagattttggaatacaagaatttattaatgacaccgggctaactacggatcaattgctacgaggtgcaccaatcaaaaaggcggaagtgaaatacatgtacgaactcggtaaaccgcttgtcaagcctgagcagctgcagtccctacccacacaaatgtacaagttccatcaactgtacatggagatgagcgccaccggtacagaaatgatcggagcgaggatcagggacacggacttcttgcaaggagatgacattctctggatcaatttcaagggtatctacgaactataccagctggatgccctcgacgtctctattatgagttgctggattttgtaagtatcgttcagttagatttcttattatgtttcctttaattagttaggtccttgtatataagtagactacatataatatatacttccttttattgttgtagaatggagattcaaagggcccggcggcggggggttttcgatactggattcatcgaccctcggaaagtaaacgtcgcaatgctcgaccagtatccgcaagccacagaggacaatctcgtccatctcttgaaggcgcagcattacaagacgttcatactattaccgtacaacacagagttagtttaattttactgtcttcctataccaaatttcattccgtacgaacatgctaagtgtttcatatgtaatgcatcccacgcacattgcagattccactgggtctttttactcttcaacctggaggcctgcaccgtcaacgtatatgactcaatggataaaaaagagtctatgtttgacaaggttttcgaacttatagacaggtactgtcataagttcctatgttaattaagaatcttgttataattaattgctactacgaatcatagctttaaactccatgtagggcttggtatcgattccgtcatttggtccgcagtaaatggagagaaagacttaggcggaagttcaattttcctgtgagtacacatgctttacatttatattgaatctccaattcaaatacatacaagtgtatattaattagatctctcaccgtttatcatttatttatagtgcacaaagcaaaagcagggaactaacttgtgcagctgctacgtgtgcgagtattgccactgccttgtagaccaaatcatcaccgcaagagagctcgatgtacgtacaaataaattctaaatttcattgcgtacgtatcgatttgttgtttaattactaattaatttcatacattaatatagtttattcgcatgagggataacctgatcacacacaaggaatttatcgcggtggttcaagaacaactcatgggatttatcaatgaacaaatccttgatcccaagggtgaattctactacgacagaaatacaattcataggtccttagcttctgagataacgactactactacgtcgaaatcgtagctagctaggacatcataatagattgtaattaatacatgtctatttttctatatgcatgtacacattttctttaatgtaaatatatattttagtcatatatatatgcacataaaatgttaagtgctttcatatatatatatatatatatatatatatatatatatatatatatatatatatatatatacctatgcatttgcataacatatatatgtataaatacatatatattatgcatgtatatgtactgaaacatatataaatataatatatatatatatattatatgcatatatatatgtattaaaacatatatatgcatggtttttatatatatatatatatatatatatatatatatatatatatatataaaccatgcagcaacagggccatgaaaaaaaaaaggtcagctcgactttagtcccggattggtagtcccggtttgaaaaccgggactaaaggggggttacgaaccgggactacaaacgctttctccaccagtgcacatttgaagtattaaacgtaatctaataacaaaataaattacagattccgtcagaaaactacgagataaatttattaagcctaattaatccgtcattagtaaatgtttattgtagcaccacattgtcaaatcatggcgcaattatgcttaaaagattcgcctcgtaatttacacgcaatctgtgtaattgggatttttgcctatatttaatactccatgcatatgtccaaacaatcgatatgacactgtaaaaatttttgttttgggaactaaaccagctctatggatgagggttcttattgttgtctttaggctggttgagtactggtagtgtaagtggtagttttgttgtttctattcgagttgtgattttataattttgtaaccatattcgacctataatcgctgtgtaataattgattgtagtttcttttgaaaccaagaccaaaaatagacgaccgttaattagtatttgtgaagaagaaaatacgtacaccattaatggtttggtatgaactccacggcatggaagaacgaacacaagacaaataaggctgagacatttttttggctgcgatcttgcttgctgcgccgttttctggtgtttatcattctccacttattaatgggcaaacaaggggccaattacatgcatatatatgacataacgtgtactttaaagccgcccgagagttcacaagaaatcgtgccatcccaggatcgatcacgcgtacggccgctaggtcacaacagttacaaacactgaaacacacactgatgtagaaattgaagcctgatcgacgtgaacaggaacgatgacacgaaacaattaaaataattaaacaaagtagtgtagtaaagtttacgccagaagttgtaccattaagtagtattactgcataataagaggggcggcggcggtgatggggacgctgtggagaacgatagtctcgacggtgaggccaggaccgaagccgaagaggacgccccagtccatgccctcgccggtggtggcgtggccgtcgtcggcagagagcttgcgcatctcgtcgaggacgaagaggacggtggcgctggccatgttgccgtactcggagaggacgttgcgggaggcgcgcatgcgggccttgtggagggcgaccttctcctcaacctggtcgaggatggccggaccgcccgggtgcaccacccagaagatggagttccagtcgtggacgccgagcggcatgaaggcgtcggtgagcgcgccctcgacactgtcggatatgaactccgggacgtccttgggcaggtggaaggtgagacccacctcgcggaggtgccccacgatggcgtcctccgtgcccggcaggatggtctggctcgccgacacaatctggaacagcggccgctcatcggctgcctcgtcggggtcagagccgacgatcaccgccgctgcgccgtcgccgaagagcgcgtgcccgacgagggagtcgaggtgcgactcggacggcccccggaaggccatcgccatgatctccgagcacaccaccagcacccgcgcgccgcggttgttctcggccaggtccttggccacgcgcagcaccgtgccaccggcgaagcacccctgctggtacatcatcagccgcttcaccgacgtgggtaggcccagcatcttggccacctggtagtcggctccgggcatgtccactccgttggtcgtgcagaacacgaggtgggtgatccgcgacatcggctgcccccactctttgatcgcctcctcggctgccgccttccccagcttgggcacctccgccaccaccatgtcctgcctcgcgtccagcgacggcgccgtgaacacgcacatgctagggttctcctgtaggatctcctcagtaagatgcgtgtacctcttccgtatctgcgagctttcacctgcatatatcatggatgcgcgatattaatttgcacctgcgctattttaatcttaattattattaattattattgttatacggtttagatagggtgaaatttactctggaaattcgcttaaatttttttagaaaatcacgagctgcaattaggagtccgactatcgtctcaagttaatgtgcgagtttttttaagaaatatttcttatacgactccttttgtatttcaaaaaatgaacaaacaataaaattgactcaaacacgaatctatatttccaaaagcgaacgaaattacaaaccgactcaaataaaaatgacataccaaaataccgacaaaaacatgatcagtttttataatagaagtgatggcgcagtactttaatttctataaagggattcacctttcacttatttagactagatacagtatgtgtactagtataatatagatgcaaattaactgattactcattagtgcttacacatcctctggaacctctccttcaggttggttaggtgctcgctgttggtgaccctgaagtagtagtccgggtagtcggtctggtacacgcagttagccggcgttgccgtcccgatcgctagcaccgccgccatcccctccgctctttgcatcctcctaacctcctccaacttcactgttgatgtcaccatctccccactcaccggcggctaatcgtacctagctaggaatgtagtgtatatcttggtataactgagggtactagcagctagcttgttcgccacaacgaaaatgcatgtgcgctagctagctgctgcctctcagcccggctgattcgaacaaatggtcgcagctaagttatttataggggtgagctgcacgtttgtctgccagaacgttgtacccttttccaattttcctaacaataatatatctccgttgaatttgtgtgacgatactatttttttttctgaaaacgtgtttaattaagattcattgaagtttgaacaaaagtttcaattcgatctcataagatatattcttttcagctgcaaaaaccagtactttaatatatatacgaatatattggtgtaattcttgaactaaatatatttgtaatctaactaaacaggaaggaagcatgcgcacacaaacgtggacatcttatttaaagtttcttaaaattttgctagcctaacatatgcatttttgtgcgtggatgaccttttttggaaaaaaaacatattatttcattctatatattatgaacctgctatcttattaacgagttatgatttttttaagaaaaacagtacaaatgcacacgctcataatatgcgcacaatgacccctacgagcacacacgcacactaccctacctctacgagcacctttgaaagactgagacgacatatgttgggatttacaaattgaccacaagtgcctcgatgtagacaggtacgttggctactactacaacaatagttagccgtaatcacaaacacccgcgtatcaaagtctaggacataaaaccgggtgggttggttctaccaaaaaaacctaacaagttgagctatactcacttcgcgattttcttctaattatcctcacagaacatatataaaatctaaagcataattatattgaaccatggaatcttaaattgatgagaaaattattgtgtcggagttgatcctatgaaattatcatttctatgataagtgtttcttttttaattgaatatatttagcacactctttttatagtatatatactttgagcaactccggtttacatacacacacataggacatatatgggcacccgggcaccataatatgaaatacacaaattcgtctaaatttttcaaaattttctatatatctagttataagtattcgattcatacctatacctagcaacaaaacaactcaaatttaactttatatatatatatatatatatatatatatattaaaattaactggggcttcatggggcccggccaacatgattaaaaattgagtatgtacctaatgctaatgagtctgatttttttaaaaaaatgtttagttatgaacattaacttatttactagctagttcaaacaagtttgaactaaatttgaatatctttttgttaaattttgattgtaggtatataggatctaaacttatatataattacttaggtatgtaataatggattgtaaaataaagtttaatttaagttgatttattgctttggtatgaatcaaattcttatgactaaatatacactcacaatttaaaaaattatatttttcagtgtttgtgcgcgcgcgctagtaataactaaccattcaaattaagaacctaaccacctaaccatcgtacgtgagattcaaacttaggtgatatgtgtgcataagatatatagcaaaacaatgtaaccaccacacaacttgtcaacttgtggatgtacatgacgtacccactcttctttttggagtatacgaggtcagcgccaagcgttatggtggtcaatccattgcatcttctcgcgcatcaccgtgaggccttattcggttaatccttatgagagaggaattggaggggatttatttcacacctattatagtctggaattattcccccttaatcctctccaatcgccctctaagctgaataacgcctgacggggttagcggcatcgatcagggacgatgctgagctattggacctcaatgccatacggcccctgagctcatgttatttttgctgaagatttttacacggtttatttcaaaataatttttctaaaagattaataattagtcaaaatttcgatggacttataggcggaaaaatatgtgtacatgcggatgagccacctgcgcctctaccaaattgccataaccacatgtaaaaatcaatttttgcaggtggttaggttaagccgagcaacttgggaggtgattttcggtgaaaacaaataatatagctcaaaaatatccagatgcagtgccatttcctgctcgtcccatttctacggatccacaccactgcaaatcaatatcagacacaccgcaaatccaaagtcgagagtaaacttccacatcaccataacaatgctcaacacatatataacgcaattccataacaaattcacatttatctcatagcgaaataaaagcgaagtgaacataggtcaaggctgcagcaaagcttgccgttatcgagctcagcattggcccctttctcccactgccttgatcatcagcctccatctcagcgctcctgccatgtaccttgatctggatctagctagaggtggtagtggtgtggtggatgcgaaggaagaaaggggataaggcagggtgaggcaacctccggtggaccggttgcttatgagcctttaggagaccacaattgtcgtcatcgtttaacaaaccctatcggcagcagatctgccactcccaagtccactggaggttgaagttgtcagcgggtgcctagagcccaccaacaggcggtgaatccaccgctcctgagtacgcaggaggccgtagcaatcggcagcgcctgccgagccttgtcagcatcggtgatcatgtcgttggctatgattgacgatggccttgcgaagcctgccagctgagaggcgcatcggtgatgggagagggcgtagaggaattagagggagcagatctcgactcaatcgtcctatcacacaaataaatatacatggtagtcgtgttactgcacattgaccgtaacgttactacgccgttccagcgtgatgagaactaaaaaaaagtaaatctcaatctttagagagcaatatctctcacattatatagtatttttctaattcgtctgcaccatgatttctgtaaaaaagtgcttaacaaaactatttttcgatgttgttgctgcgagaaagttgtcctgttactacacgataaccgttatgttactgcgggattcctgcgagacgtgaacagcaaagtggtgggtgggagagggagtcaatgggcgggtttaactcgggtttgaccggcgggaggaggctttgactagcctttgactgaggtgggaggggagatttgggccatatgaatggtgggggagatgggattggcccatgggaggggggtgtagaatagttattctaggggaggggtgtagaatagatttgctatatataataatctaggatgggatgaaacccatccacattttggaacggagttagtagaagttataaaagttgcacctcaactttccggagggagtgtaagccaactatagcttatgccaagacgagataaaaaaaatgagaagtgctagctcttatgcaaaatctagctctacgcatgctccaaagcaaatgcattagttacataggcgagggaaaaagaggaaaacaaaaatagggcaacattacaactaaaatatatatatggtaggtttaatatggacttattgtttgaattaatagatcggtcttagcccattcgaagtttaattctttggaaaatcataaaagcccacctcatgggatatcatgcatggggagtttagtaccgccttgcctattcaatgagaggaagacctccttttaagagaggatgctcttctagccacttgaggcatgtgaggcggagagaacagggggaacacgtgctcctgacatgtcagtttaactcgggtttaatatggacttattgtttgaattaatagatcggtcttagcccattctaggagaggatgctctcctagccacttgaggcatgtgcgggaaattcatatttgttttttttggaaacactcggaataatctgatgagtgaaacggtgtggagtccgttttgctgcggaaaattcagattttttttttttggaaacactccgaataatccgatgtgtgaaacggtgtggagttcggataagttacgcgtgacttatctggttcggttcggttatgcagagtggagatcgtgtaggcgccctgatcaagtgtcctgatatctctatataatttgagccgccacctcctcgcaacatacgtggaatcaatcttgggttggcctcctcctccgtactacgttgttgtttgtagtctactccatcccactcgccggtgctcaatggcaatcgggagagcagctctccgaaacctgcgccttctacgttttgcactagaagaaggtagcaataagatttttgggtttttgggaagcgctccacgcgactgctccctattcgttcatacggctcgtcttcctcttcgctcgcgtgctgtgcgctaccgttaagggacggtaccgtgaattcttcctgccgagcaaccggatttccaaaaccatcggtatcaacatgtttcgcatcttcgatctgttcatcctttactgtcttgtttacatgtatagatcctatgatgtgattatactagtttacatcgacaatgtcatgatttatttatgtatttatggaacaaattaaatcattacgtgcttatatattcaacacttatatctactagtattaaacttgctcaaatactctgaagtacagtaaatgagagtggttgaagaaatgccaaaaaattatagccaatgcatatgtacttcctctgtctcattttaagtgcaaccatcatttttcgtgcccaactttaatatagtttgtcttagttgattttttaaaaaacttttaaaaaaactcatgcataaagtactattcatggtttatcatctcataacaataaaaatactaattataaaaaaaataaagaggacgaatgatcaaagttggacacgaaaactgatggctgcacttaaaatgggacggaggaagtaggtaaccggaagctatatgatataattgagtggaggtagctcaattaattgtcaattgacttgacatggaatacctgcagatagctatgtttgtgaaacaaatggaatcttgatcgacctagacatctacccaaaactgacaagttgttcctattttacaaagttcgagctgccatactatcattgatattctcaaattggctaataaactaccttgaatatgagcagttcaagaaatgcataaaaaatatatataggcagtgcacatctgggtaacgggaagctatttgatccaatcgggcggagttagctcaactatttgtaaatcgtcctagcaaagaattcgtgcatacaaccctgtttgttaaacaatggaatcttgagctacgtcccactactacataaatcatttttacatgcagccagcacaatcgcatgcgccaaaagatctacaaaaaatcggattttcgcatgcgaccagcgcaaccgcgtgcgaaaatggtattttcgtatgtggtcacctatatcggctgcatgcgaaaataatatcagcgaaaaaaataaaaaaaccgaatcggccgaaccctagctcgccgctgtcatcagtcggacccacgcagggcggcgccactgctgctgccagagcccaccgtcctccgcgccggatccaccgtgcgcctctcgtcgtcgccgtcagatccgccgcccccgccgcccatcgtcgtcaccggcactggatccgcgtggggatgggtcgccaccgccagatccacgctaggcggcattactcctggccacctccttgtcatcaacggcggcgccgcctgctcccaaccccaccgcctgctcccgcacactcggtgaggagaggaagacaagagagtatcagaggagaggagaggaacagacataaggagaggaagagtgagaggagaggagacgaaaagttttaagtggtgagagcgaaaagagagagcacgggaaaaaaaatctgtgaagaagagggtattttcgcgtgcggacaacttaagagacacgcatacgaaaatttatttggtatgtggccccttaagatgaccgtattggtaaatagacttatttttacatgcgatcccttgcaaattgctaccactatagaacatgacgtcgtgaacgggacatccatgataggggcttgcatcccatcatatagacctcccatttgacgggacataataaacctcgacacaaaagcaccattacaggcactcaccacaggcctctagtctggacctgttactaatgacactcatcctcgacacagatgagttttgacatcactgaccaataatctgtaactgggctccttgccgacatagaagggacccacccaacatggatgacctattccataggtgtgctgtggagtcttgaactacacatcgtctatcaaaaacattgacaaggtcttcctattttacaagctacaaggtaccattctatcattgatattgttgtcaaaacgacaactgcatacgtcgaaagacgtggttactcaacagtggatgggaaaatgaagtgtactaaattttgaattttccttggggatcccccattacatggccctaggggactatttatagccccattacaggttcttactactagggtttaggttgtacagggaaatttacatgattacccttaccaaaggggcatttacaggggtacataatgttataggggctcatgggcctctgatgggccgtctggcgatcgccggcctgttgggccggaaaggcttcctcggccctcacgggggcgaacttgtcaaggcgaagtcatcctccttcggcagatagtcttcgccctgcacccttcgcctgagacgcctctggcctggcgcttgtacgactcttcgccttgcgccgttcttgttccatagccttcgccatgggtttcggcaggtttggttgaaggacctcatgccatccgccaacaagcccctcacgggcaagggtgagattggagcttcggccgagaccgtgcaaaccatgtggtatggtatgcggcgccccctttcgaccgatgctcctgccgaaacctacattattcctgcgaatgaagtttgttatttgtgcggctggtattattttgccgcgcttcgcctcctgcgattgatttttatatatattcttttttcctgggccgaacggaagccttcctatcgtgggcttttcactgtgccgctcggtcgatgggaatttaccatttcacctacccttgcgacacgtggcgctttattactagtggttaggcgaacggtcgcctgggtgggctatatattcccgcttctctttccttttcaccgccccactttccattttaccgcgagcgctctcttcctccgtctcttcctttcacagcatctttcgacccctcaggcgtttcgccgaatctcgtttttcgccaccgcaaacgcaccgttcgccatggccccacgtaagccaaaccctacttcggcgaaagggccagatcccggcctagtcgatgacaacagcaccgcctttctgggggtctctcttgtagacgacgtcgagctggcgaagatggtcagctccggagcgttggttgaggggcaggctttcgccccagggaaaaccgtggtgccgaaacctgtcgacaatcggacagtggtgttcgccgtattttttgaggcaaggctacggtttccttgcaacgtgttgttgccggaaatccttcgcctcttccaggtggaacttccgcagctgagcccgtcggcgcttgttcagatcgctatctttgactgggcgtgctggacttccgggtttgagcctaacaccgagctctttggcgccatatttttcgccaccgtgaactcgaagacggtgattaccccggctggaatgaaaaaaacagtgttcgggagcgtgaacttcaacgttagccccgagcggtccgatctctagccggtgaacgctgccatgtcgaagtgggaccgccattggatggcgaggtggttctaccacaccatccccttcgaggctatttctgaatcagcgaaagccttccggtgccggcgcaaggcgattgcgccgaaccggaggcccaagattgctgtgaacggcaccatggaggcatggttcgttctactacggaaggtttgctcccgccttagctgccgtgacttggtggaggaattttgtatgcttcgaatttttcccctctcccagtcatggcaagtcgcggttgaacaaggcgaagaggtcgacggtttgccgaacctgatacttcctgagggggcgaacagtaagactgttgttttgctatttactgctgtgctttgttatttcgccttatttgacttttgacatagcttcacactctacttttacagtgttgaccctcgaccaggccgaagccaaagcctgcaggatgatcggcgatgtttcggccgtcgagtatagtcagctgttaacgcatcaagcggctgggcgggcgaaccgggtttacaatggcgaactgcctccccgggcgaatccccaaaaggtcgacgacgaggcagggccttcgcgaaagcggacgcgcggacaagtgaagcttgcccccaggaagcgaagggttcctacttcgtctgactccgacgctgacgacgaggatgatgccgaagaacgtgacggcgaggaggaaggagatgaagaggaggaggtggaggctgtggctgataaggccgcgagcgaggcggtcgaagactgcgtcgacacccccggctacactcctaccccaagtcccggtcacaacgagaccggggtggagtcgaacagctccccccttcatcggaaggatttggaaggggcgaaggccctagttgcgttctcttcaggtgcagcggcgaagggaggtcctggcaaaaaggtggctaagaagaaaggactcgtcgatgtcgctcgcgtttttagcgacgacgagtccttcgacgggactctgacttcgcccgctggtcgcagcctggatctttcggccgcccccattcctccattcgacgccgcgggagtggacggtagtaccgccgctggggcttcagcttctgcggaaaggattgtgacggccgcggcgaaagtattcggcaatcctccgcctcagccggttgcatcgccgctgattgaggtgaagggaaagagagctgtcgctgagacgtccgcttcggaatattcgatctcggtaccccgcttcgcccctggcgatttcgagacgcgagcggacctccttccttttttggagggggtaagcaatcttgtactgcccgccagtgccccgagcttgttcacggaactgaatgagttcgacgaagggtgttctgctataaaaagcctggctgttcgggtacgttccccccccctttttttatctttacccttcctttatcttgtttttacaattgacacttgttctcttcgccgctcgtattctgcgcccagatcctcgcggctcactgctcaacggagcgaaccgtgcgagcccgacttgatgagttcaaaagccgtcttcgggccaaggatgacaaactaggccgtaaaaatttggagatggaggcccttgccaacactcttaaggaggcgaaggctgaaaacaagcggctccaatcggaactggagaaagggaaagaagtcagggccgaagtcgatcgcttaaaggccgaactggagaaagagaaggcccattcggcggtgctcatcgactactacaaccttactgagccgaagatagtctcttcgccagaaggctagcagggctgaagcgagcgccgcggaggagtcgcagcggttttcgcgggagatggcgaagaccgccgaatctgcgagaacggcttgccaaaccctccgcctcgcccttaccgacatgggcgcgaaggggcggggggtccctaccgaggatgcctcagccttcgacttctccgagtggacccagcaggccggcggatcggtttcggactgcgccaccgcgtacggcaactgctgtgcgcgcgtgtcagcggcctttaccatgggcctcctgcagcagttcggctgcgagcacatcgccgagttccccaagtacgcgaagggggattgggaaatcagtgcacaagacatttcacctgcacttcgtgcgtggcgaaaacaattttggcagaaggacggccgctccgccgctaaggcgcgccttttggagcagctggcgaaagcagaggcggcggacctttgtgaagaggaaggcgcggcggccggagggggtggaggcgatgcccaggaccacccagaggtgtgaggccctccacccttctcttagattttcatagttttcttttggtgttcgctagatgtggcgaaccgttgtatattcggcaaactgccgctaaaccttaaaaaaggctttttggtatatttggaatgtatgacataatcttaattaccttttgatgatcgaagtctttggcatatttttatttcactcgtttcgcattatgccataccttccccttctttcgcctactcttaccattcaagatgtgttttgccttttctgcactgtctaccagggggtccgccgaaaatcgtgcattcggcccccttctgggagctggcgaagtcaaaacgagaaatttgtggcattgaaggggctgccgaagacgcaatgtccatttcggcatgtttatcgcgaaatggagataaacggtcgtagctataagattatcaaggttgccaactggctacgtgtgcaccccgggcgaaccttagaagattacgatcttgttcattcaagacgtttggaagatatggctcgcttttggcgaaaccattagaagactaaacgtcaggaatcgatctttcagcgtcgttacagtttagtctgtgtttcgccccctactcctcttaaggttgtgtatgatattagtagtgatgacgaacctagttcgtccgaccattccttagggagggataatgatcactggggcgaagatgtaatttacttgtaaaatgaattgtatcgggttgtaaaccttgtattctttgattatttttttttcgaagctaataaagaacgtgctttatttccttttcgctatttttcgcatcgtcacattttgtgcttttgttaggtcggaacatgccggcccctttgcatatattagcgaaataggtgtattgacttttcagcttttcgtcgttcgtttttaatctgtagcgttctgtgtcgagagaaacgcttttgcttttatactgatcggtcgtaacgtcgttcggctatttattttccgagacaagctgttgcggtttcaatgttcggcgagcaatgcttcggccgattcgtttcgcccccttggcctttttcgctgatcaggcgtttgccttggggtttttccacaaattatcaatcacacgaaaagtaagaagaaggcggaggacacagagattttatactggttcgggcctccatggtggataatagccctacatccagttttttttctttttctctctttcttctttttctttttttttctttgccgaaaggcttacatagtgccgaagggcttacatgatagtatgtacatttttacaagttggcgatttgggtgccacccattctagacatagaagcgcttgagggaggcggcgttccaggaatggtcgaactcctcgccttcgagtgtcgctaggcgaaaagatcccgtcctggacttgcgcttgatgaggtatggtccttcccactttgattcaagcttgccaactgctactgggttcgccttcttccttaggacgagatgaccaggcatgagctccgtgggtcgaacttttttgttgtaagttgccgaagtgcttgcggcgtacttgtgcatgtgctcgagcgcttcgactcttactgcttccaagagttcgagcgatacttcgcgtccttcgcccccgaaaaacatcacccttggtgagttagcccctagctctgctggggttattgcctcatcgccataaagaagcataaacgggctaaacttggttggtcttgtgggggtcgtctgaagggcccagagaaccgatagcaattcctctggccatttgcctttcgccgccccctcaagtcttttcttcagtgcttctaggatcttgccatttgtgcgttcggccgccccatttgactgcgggtgtgcgaccgacgcgagcttgatttccaggtcaaactgcttgccgttgtcagtaatgaactcttttggcactccgaaacggcaaacaatgtttttccatacaaacttctgtactgctgccaaagtgattgccccaagcggttcggcttcaatccatcgagagaaatattccacagctacaattgcgaatttatacccgtttcgtgccactgggaacggcccaatgatgtctagtccccatctggcgaagggccatactggcgcaatgggctgcagatcatactggggcgcggcttggcttcggccatgacgctggcaactttcgcacttcttgatttgctcaacacagactttcaacacagtgggccaataaactccttgtctaaatactttggaggccactgttcttgcagcctagtgcgcgccgcatagcccctggtgtatctcctttgccatttcttcgccttcggcaaatgagatgcaacgaagtaagggttgaagtacccctgtgcggtaaagctgacccgaaaccatcttatacttcgtggctctgagctgcaaatgcttcgcttctgcttcgtctaccagaagccagccagttttaaggtgtttcacaaatggggttcgccagtcatgtgggtcttcaccccatttctccttgtcgattgccatgacttcggagcagtccatgggcacacttggagcatgcaggacttcgaaaaagatgcccagcgaatatgggccgccttaagcagcggatttcgccaaggcatctgcctccctgttctggtctctaggcaagtgttcgaccattatgccggtgaagcatttttccatggaccgaacagcctccagatacctcttcattccctcttcttttgcctcgaaggatttgtcaacatggcctgctaccaacttggagtcagttcgaattagcaggcaccggactcccaatgctttcgcctttctcaggcccaggagaacggcttcgtattctgctgtattgttggttgtgtcgaactgcaatcttgctgcgtaccgaatcggcacaccattcggcgaaaagaggactgccgcaacgcctgcccccttgtgcgaccacgaaccgtcagagcacatcacccagaactgctcggtgggctcagggtcgggggcaaatactggtgtccattcagctacgaagtcagctagcacttgagacttgatagcagagcgtgcaacaaaatgcaagtcgaacggggatagctctaccgcccacttgctgagccggccagtgacttccttgcctcggagtatttcgcccaaggggtactgtgatggcactatgactttgtgggcctggaagtagtgcttaagcttgcgcgaagccatcactagagcgtaagcgagcttttccatttcaatgtaccttgtctttgctccttgcagtgcttcgaagacgaagtagaccggtttctgtccggactctgtttcttggaacagtatttgctcttcgcgcctgttttctcccgagccgaaggctatcagcaaaagtgcttggccaagaacttgcactgcctctccgccgaacccccggagcgacgttggtgccggtgtaagagcttgggttggcaagcccatcttagcatatgcttcggcgaagatcacgtcggcctaactccctccatcgaccaggattcgtcggacttcaaaaccggctatctcagctgagattaccagtggatcttgatgcgggaacaggactccttcagcgtcttctggctcgaaagagatcagctggttcacgtactgtggcgccccctcacccgccgaagtgatgctgtggaccatgcggatctacatcttcttctgccatttcgacaactggcttggcgggtcagctcttgtaatcacttcgattacccttcgctgtgcatcttggcgttgttcggctgggggtgtttgctcctgaactgcttcacgaggtgcttcgacagttgttccctgctgtggccttaggtcttgcgcgttgccatgttgcctaatgtttcagcattgctccgtggtgtgcgaagagcatccgtgaaaggcgcagtagaggtcttttcggaccttcttgcgggctggctgctgatggttgcttgcttgctgggcgtcgaactctttgcggagggcttgcacttcttcgacagccatcacagccttgcccgcccgatctgttctgaactttctccaagtcatgggggcttggccttgccttggcggctgtccctggatcgccggctgagactggcgaacagagaggggaggtggttcggcaacttgaacttgtgcttgagcttgagcagcggcgacgtatagcttgtcgtcgtttagaatcctcctcactccttgtgaacccgtcaatgatgcgaagtaggtgctcgagcatctgcggctccttgttggcgatttttcttgttagttcgccctcaagcagactggcccaactggtggtacttgctgagccgccacggatgggtcaaaaattggctgcaaccacatcatggcagcatggattggtgcttggtttgttccgaagcctagagttggaacttgctgccgaacagttggcacctgagcagtgttgacgaagtcgaactgcggtccttgattccacggcgaagcttccaagcctggctgaattggtggcaatcaattgggcgcaccatgacttgtattccccaccgggtgagccgatggggttgtgcttgaaatgtagtggggttggttgagttgctgaaggaaagcttggagttgcgcctgcagagccgaagccccttccgccactgattgtggcgcttggccaggtggttgatgctgcccggcgaagttcaccggcgcctgtgtggctagtggcggagagggctgggtcaccacttgcggccggacttgaggtggggcatagcctgccgaatactgaaggattagagccgacgtggccttggtccgccttgccgcctcgtatgcttgttgttgttcttgcatttggcgaagcatgtcttggagccgtgtcatgttctgccgcatggcttccatgtcggcttcagcttgcgcttcggggtccaggctgatttgggcctgtataacggtgagcgcagttggggccgccgccggctgcgatggggcggcttggggcaccaccagttggtttgtcgaaaggatctccgccctagtctggagtgcccttccgccgtagccgccttcgccacgtcggccgtgttcggcacttgcactgacgttgcgggggccgaagacggttctgatggcgcgggggccgaaggcggttgtgatggcgcttgtgcttctccatcttcggccacggacgccgaaggctctgctccttcttcggcagccatgtccggtccggcgtcgctctccttccgcctgataaccttctccttcacgaccctcttcggtggcattcgctctcagtggtttcgctcggagtccccacggtcggcaccagctgttgtcaaaacgacaactgcatacgtcgaaagacgtggttactcaacaatggttggaaaaatgaagtgtactaaattttgaatttcccttggggatcccccattacatggccctaggggactatttatagccccattacaggttcttattactagggtttaggttgtacaggggaatttacatgattacccttaccaaagaggcatttacaggggtacataatgttataggggctcatgggcccctgatgggccgtctggcgatcgccggcctgatgggccaaaaaggcttcctcggccctcgcaggggcgaacttgtcaagacgaagtcatcctccttcggcagatagtcttcgccttgcacccttcgtctgagacgcctctggcctggcgcttgtacgactcttcgccttgcgccgttcttgctctatagccttcgccatgggtttcggcaggtttggttgaagagcctcatgccatccgccaacagatattacatcaaattgcctcataaactcccttaaataagagtggttgaagaaacacgtaaaaagatatagccaacgcacatgttgataaccggaagctatatgatccaatcgagtgggagtaacaagattagttgtaagttgtcctaggaaagtattcctccagataactatatttgttaaacaaatggtatcttgagctacacatctacccagaacattaacaagatcttcacattttgcatcgtttgatattccaagttgcctaagagcaattttaatagttggcaactccctccggttaattatgacgttttgaataatgatatggtcttcaaaatatatcattgactatacatagtcaaacatatattttaaagagcatgtcattgtttaaatacaataggataatgtgtgtgtgtctatatatatatatatatatatataatagaaaaaaagtaccgtactaaaagtaaaaaaatatttatttattttatatattataatagaaaaaaacaatgtacttctcccccgtctagtaacttagaatgagataagacctatccacattttgagacggaggtagtaaaagttataaaagttgcacgtcaactttccagtgagagtataagccaactatagcttaggtagaaaggagatatatataaaaaaaaagagagaagtgcaagttttcatgcaaaatatagctctacacatggtccaaagcccatgcattagttacactagccgctaacccgtacgatgcacgggtattatagagtatagagatatattttaaattttaatcatagcttaaatatgtaggttttatattttttttattatactgactctagctaaaagaagcgcacacgttagttacaacttcacatttgtggtttcaaaatttcaaattaaattagttatttcaaattaaaaatggaaagtccgtaatttcagaattgtgtattatcaatttcgtaaaaactaataaagaatccgattcgtatttgtgaaacaaattgaatcttgttcgacctagacatctacccaaaactctgacaagttgttcccattttacaaagttcgagctgccatactatcactgatattatctcaaattggctaataaactaccttgaatatgagcagttgaagaaatgcgtaataaatatatataggcattgcgcatctgggtaacgtgcaaaggattcttgcatatataaccctgttttttaagcaatggaatcttgagagctacgtacgttcacatctatccagaactttgagattcctagaattccgtaataaacaacgacgaagagaggtttgaaaacatgcgttaaaatcatgtggcggtagctcatcaattaattgtcatttgtccttgcaagtagtgatacccggagacaatggcatcttcagcgagtacacacctacccagaactttgacaagttcttcacatcttacaaagttcgacgtaccatactataattgatattccaccaaattagctaataaactggcttgaataagagcagttggggaaatgcgggaaaaatataggcaaaatgcacatgtagataacggggacctatttgattcatctggtggaggtagctcacattgtaaattttccttgcaaattaaggccttgtttagttccaaattttttcttcaaattttcaatttttttcatcacatcaaaacttttctacacatataaacctccaacttttccgtcacttcgttccaatttcaaccaaacttttaatttttgacctgaaaacacactctaagaattcttgccgacaactatgtttgtcattgaatcgtgagctacacatgtatccagaactttgatattccataatccctaatagactacaataaataagagtggttaaagaaagcgtaaaacttataaccaatccacacactagagaaatgatctttaataccgattctaaactctttttaatctcggttatagtaaccgagacttaagatctaaagatgcatactaaataaaaaatatataggatgtgggattcgaacttaagatctcgcatctcaaccattatctgtgttaccatcttacctactccacacgtttaacttggataaaggtattttcattttgaactaactctagaggcatttttagtactggttggtaacaaccaacttgtattaaaaatatctttagtcccgattgatattatcaaccagtgctaaaaatatctttagtatcggataacagtaaccaagactaaagatccacaaaaattagtaccggttggtgctgcaaaccggttctaaagatgtatttttaatatcagttggtaacaccaactggggctaaagatatatatttctaggtacctaggcttttagaaccgattataaatagctttagtaccggttcttaatgcatcggccggtatatttgtgatttggggtattggataaaagttgatgatggtgaaagtctgacgagagtggtgatgctatcgccaaaggggccacaacaacagtttcatgtagatgcagtgccaagtaagcatgagcagcgataccacgcactataagaggtgtgtggatttttaacattttattatgtcataatatatgaaatcagttgacgtaattccaaacgtcaaaaagccacgtcataaatttagtatgtgacgtttgtacatttattgtcacaagcatttgacaatgctttattgtcataaaatcctggggcttgccacgtggcagctgacataacagttgacatggttaaaaaaaaagtcacaaaataagattcggcctgctaaagcccatgtagctcatgggccacaaatatattttttctggggttgttgctagctggcccagtatattttttgcttgtttgtttatgaatgcagcctgtacaaattttcaacccacaccaattcggcccatatgatttttccaacccgcacaattcagcccatatgatttttccacccccacaatttagcccatatatttttccagcccaaataattttttcagcccacaaagctcaactgatattttttcagcccatacaattcagcccagatactatatttcagcacatacaaaatcagattcaaatgaattaacattccacaaatgattgcaatgtcacatgcatttcacattccagaagtcttgaaatgcaatatcattacatccatccaccaattcagtacatatccaaactctcaaatttcatattcctgctactgcgagagcaacagcagcacatctgcaatagcatcacagcagcagtagcgcaatggccaaaagcacagcagcaacagcacaacggccagaagcacagcagcacctaaataacatcccacaagcacaatggtcgcaagttcagtgtcaccaaaatatcatctggaacctaattgagtaggagtgcttactattcagcatctgatgatgcaaaattgctgccaaacaattgagtagtttcttattgtacttgaattacatgtaccccagtggcataatgtatctatgaatcctataatacatgagtaagcaaaatttagtagactcaagtaaacccccgcggggcattgcatttacgttagaaaacattggccgcagtttcattgatagaaacagacagagttgtccgaagtccagtgcaaaaaagaacaagtaccttacggcatctgacttgaatcccatcaggttttatagtgctaaactgatcctcaaattgggtcattgtgcatttaatggtagaatcctcacatgtattgtatgagcagcaactataaaataaagataataaatttcaggacaacaacaaaattatcatgtctggactaaagcctacgattatagcaaataccttatgttcatacgtattgctgctccagcccgtttatctgccgcatgacaacgcacaggtggacaacgtgcatgacggcagcatccgtaaggattcatccttaatcaaaagtattatttagccttagccttagtccacatattgcacacaaaaatgaagagttattccatacaaaatcgaatccagattcatccttaatcatacaaaagcatctcttgctctaagattaaaaggaatgtgacatcaagctatgaacgagcagaaccgttcagctttctttaatacaagaaataaacaagctcaccttgtgcccattgtggccttggtgttgcttgtccgttcagagatcttgggcttcatgccaagattcggcacagaagtctcggccatatcaaccaccggcgcttgatgcatcacagccacaccagtggcggaggacggaaaaaattttaggtgtggcctacgaattaccacagaagttagcacataacgaaaaatctcaatgcatgttattatacgatgcaatattatcacaacaagtctacattaagcacggtaaacaagaactaattataagttgatgattcatcatctatttgtaaactagatagaagagtaggtactcaaaaaatacctcaacttcctaagattcatgctttcaacaatacatcacaaataggaagtacagtactgagtatagatagatatagtaccaaagattgattaatgttcacatatgtaggcacctgttgatggagtgatggatgcttggcttgttggcttgtcgcttgcttgctgtcgtcgctgggtgctgcacgcctgcactgctgttgtgccattcatcccaccctgcctctgtctctgctcttcctgcgctgcgcgcctgcccatttgggccatggcggctggtcgtgctgccgccttgccggagcagatgccacagccgcagctctggaagcctggtggccgcgccctcctcacctcaccctgccctcccgcgcggcgcgcaccacagcagcccccgtccgccgatggggattggggatggggattggcggaggttggaggagatggtcagatgactcagatggggaaatttgggtctcatttacactaaacaagcctaatgggcctactagctatcagcgtgaggaccagcactggcatttgcggacgcgtccacgccgtgtcggcactctctctgacccggctgctgctatgcgcggaggagcacgaggaagggggggtggtcagcgggcggcgcgaggatgctgtggccaacgtggtttggaatcggctagcggttgggcccgtcgatgcagccgcacgccgtcctcgagccgcccggggattgccgccgctcgatctagccgccctaggcccgggatctagcagatccaccgctcccgagcgtggtggcggcggagatagaggcggcgtggtaagcggcgaaggaggacgccgccgcacgctgtcatcgccgatacccaccgccggagaggagaggagaggaaaggagaggagaatggatgggagtgtggcggctgagggtggagagagagagagagaggaggggtggagaggagggttttatatagggctagggttagggacggcgatcagaaccattagatcgaagatggacggtcagaaatagttgggccatttgggccgaaacaggaatgatcatatgttttttttttaatttcaatttatgaaaacattaaatgtaattttaggtcgattttttttgtttcaaatgaaaaaatcataaataataaaattatagaactaatcgagatctacaactattgtattagtcctttttacaaataagttcatttgaacaatacaaattttgaattttcaaaaattgataatttcgaataaaaattggggttaataaatgatttcaaatggaaaagtcaccaaaactaaagttgtataaatcatcgagacggaaattttttatttttgtcatttctccatctgactctatttgaacaatttgaatttgaaattcaaagtttgagaacttcaaatagaatttttttattagtgaacgacttcaactgaaaaattcatcaacaacaaagttgtataatccatctgaatctacaatttttattttggtcatttgttcattcgacgaagcgatagtaagattgttcacaaaattttaatatggttttataaactataagagagatttgtaaattttgtgaacaatgttaatatcactttgccagatgaagatatgaccaaaataaaagttatagatatttatgagttatacaactttgttattgatgactttttcagttgaaatcatttagtatttgaaaatattgtttgaagtagtcataatttgaaattcaaattcaaattattgaaacaaagtcatatagcaaaatgaccaaaacaaaagttgtagatcttgataagttatacaaattttttgttgacaattttttcatttgaaatcatttactacacaaaaaaatatatatttgaatttcttatattttaaaattcaaattttatatagatcaatcaaactcagatggagaaataactaaaataaaattggtagatttcgataagtcatataactttgtttttgacaattttttcacgcaactcccaacaatttttagcttgcgggttcgactcctaactcctaacattttttagccattttgctgagttaggcgcggctgctcggcctagcgcacgggttggcccatttcgggtaagcggctgttgggctagcaccaggttggcccatctgaaaatgagaaaagaaaatctgatgtggcaataaggcttgcctacatggacaaaaatatttaaaataatacaataaataatttgtgacacataaataggtcttatgacatagtaaatattgtcactggatgacactagactagctatatgacacttattgtgacacacaactttttattgtcattaagttaaaatgcttcaaataaaatgtcataaattagatgatatagtgacattataacctgtgtcatataagccacacataacttgtagtggcggtccgaaggggacgacgcatgcagctagcggcaacccg

SEQ ID NO: 75114 - DNA, 16606 bp, Oryza sativa
acccatgtggtcaaaaaaaataaaaaatgagtctgggcagatcgtccaccaaacgaaagagaacgttggagcatgagccaaaatttaatccatccccattaaaatataggccatctcctcagtgccatcaatttttgttataaaagcttggtattcgatacatgggaacgaggactaaccttgaccttttcgattgttttagtcattgatcactcaagatatcatattacgatataggagcacacaatatttcttaacgaggttcagcccaaacctatatccccggactttgattatgggtgctcctctccaatcaacatagcacctaatcgctacgagtcaatgactgtcagggttatggataaggcatacctcctattcttgaggttacgatgtatatgaatgcggtatactctcaagtatatggaaaggttactttagtcttaaggaattaggccaatgtataaggaaaccgactcccgagtagaaggttttagagtcctattcagatgagaagcagactatgtcatctcgtacgcgtaaggtactctccgagttctacttggaagctaagtcacttaggggtataaatacaaggccccaggtggtatgggatcatcgaatcatagcattgccaccaaccatggtagaagcaatccgaaggactcgaagccaagtcggcgattgatctcgtcgagtcgttctcgacaacagtctaatcggtaactcgttgcttctgttgttctctattgtgaaatctattgttctgttcataatcgcatataaactggattaggtgggctattaccttccgaggggcctgaacgagtataatccttgtcttttgtgagcttgatatcgtatcatagacttagaacatgcagtgtgcaactcacatctctcaggttctcggataatgtttggctttccttacttaaaacttgagcgagtacttaactatgaaccaatacataagagatacaaaacagagcaaccgttcatcattttgaaagtgcattaattcccctagtgggttttggtgattaatgacaaatgtggttaagggactaatgagttcattgagtaactttcaggtgcattagtccaaatgtgtggaagatggatgcttgaagacccccccaaaagtacaaaatcaaagcggaccggaactcgagaagtgcataggatagtttatcttttgaaatcgagtttttagaaaaaaaccatactattaagaggggttccaggtgatgctctgagatatgtcaagtgctcttagtatgaaccaagtgtcaagtttccctaggagtcttttttgcatatactccttctgcccaaaagtgcaagtccggaacttcctgtcttccaggtccggaacttcctgtctagtttccagttcaaaattgtgagtaacggctagatgacgccacctagccgttatacatatacagctcgtttccagctcattccttggccattccactttcacttttcaaacctagagctgttgctagtctctcccaagtgtttgttgccttctccactcaatctagagcctaatacttgtgagaaagagagattgagagggagagaagaagatttggagaggtgtgaagactcggatcttgggtgagcacttggaatatctcgtgggttgtcatctcgttgcttattactcttggagatgatctcctagacggttaggtgtcgcccgcgagaatccgttgcatattgtggatgtcccgggtaagtttgtgaaggatctcctctcctccgaaagggaatgaggtaagttaatgaagttcttgtgctgagattctagaggttttccaagtagagcaacctacacttgtggtggatttctagaagtaggttgagttggatcttggtggtcactcaattctagaaatttgcctaggagtgtttgggttgaaggctgtggattttctttggggtttttgcacaagtgaggcaaggggttaatcgagacccagctctttggagctcctcaacggagagtaggatcgcaagatccgaactttggaaaaaaatcgctcttgtctctttctgtgatgtttctgtgatctatccaaaacttgaccaaaatttaaagtatacatataggattactaatatgtgctcatgcgacaaaactgaaattaagcgtgagctaatataccaacatctgagctgttaagtaagcaagaacaagaagcacacaaacttgcaattaacaaatcatgaagacaacaaaatggccattagctgtcacaccacggtgtggcaagggaatccatctattcgaaattagagacaacgatctgatcgagcaagcaagcccagctgcctcgctggcaccatctgcattgcacgcacgtccatcgcctagcacccactgattaattaattaatcaatcaattaattagtcctaacaacaagtaaatttaaaaaaacttctctgatccgttcatcaaatttttaatagacgcacatacactaatccagatctaatgtcggtgtaatcaagcaaatccagatctattaactaaatgtcgggacggtgtcgcctggtgatgaggataattacaagagttcttcaggttacgaagctgtataacttaaattaattaacccaagttgattactcctgcttcgattgcttaattagcgagcagagaagagccatagctttaaaagacgagacctcgtgcaaccattatattcgtacgtgtgttcatgtacgtcatgggcaagatctgacggcttcacatacctgttccgtttgatccgttcgccgtcactacggccggccttgatcgattcatcgaccggtttagctggcatcacattcacacacacacacacacacacatcactcctcagatctgatccaattcaggacagctaaggtagagttaattaggacaacattatgaagttaactagtgataaggtttatccaaaatatttgaattcaaattcaaatttgaatcggatataattcaaattcaattttgaaacgggtatataaacttttgacttataaactttaggtgtataactttagatgtatagaaatactatatataataaaatatttgaattcaaattcaaatttgaatcggatatataaacttttggtctctaaactttagatgtgtaaacttgaggtgtataaactttaggtgtataaatttactaaaatagaaaagtaatgcgatgccaaaaaaagaaaccaggtggagggagggagaggggaggggatcgatcgctgcccccgtctcggggcaatcgatcgctgcccccgtcccggggcgatcgatcgctgaacagcattctcagtttaagaagaccgaactttctttagaccaaaaggactagaactctctttcctaagtaggggtagtttggatacaggactataactctctttctttagtgactgtcatatcggttgtttggacactaatttagagtattaaacataaactaattacacaaatggaggctaatttgtaagacgaatatattaaaactaattagtccattatttgacaatgtggtgttacagtaaatatgtgctaattatatattaattagccttaatagattcgtctcgtaaattaaccttcatctgtttaattagttttgtagttagtctatttttattactccaaattaatatacaaacatcggatgtgacagtccgccattggcccttggcagtccgaggatgacatggggcaaggagcacgcggcgaggacgaccgtggcgtcagcggctggcggggcgcgcggcaaggacagcatgggcgacggactggttggggcggtagagtagtgttggtggcgacgggcggcgaggacgggaaggacgaccgcgcgtgggcggccggtggccgggaggacgtcgactccctggcgcggtccgtctccgctcccgtgtaccgtgtacgcgcgcggattttcggacgtcgcggcggtgctcgatcctatggtccgaagtgtgcgcgcggcgttgcgcggcctaatggcgtggctcggcgatatgcaaagcggggtgctgacgcggcgagtcgagacgcgtcgcgcaggccgcacgtctcgtcgtgatgcggttgggccgttggggtagtgttgcgggtagcgcagcgtggccagttcgcggtcgacggcggcatggtgaggatggcgtgacgtggtggtcgcatgtggcgcgcgtcggctcggagacaggagctgcaaggacggacggcgaggtaggcggggacaaacgtggcgtcaccagcgtcgttgtctgcgcacgccggtacggcgactcagggcagggcgtggccggcatcagcgggagaagttgtggggtggttggcaacggcgacagggcgggcaggcggatgatgccagcagctctccgtgtactggcgatgttgcggcgttcggaccagtggatctatgatggcggcggcgtgcggtacctttggcgatattctgtcgagcagttggcgggcgtgcagcttggggaggccaagtctggctgggccagctgggctgcggcccgggtggagaaggaggaggggaaggctagaggccgcgggagagagaagaagggaggcacaacgagctttcccagtaggctcagcccaacagaaggggatgggaagggagatggttgggccggctgggattggcgcaaaaggaggggaaacagacttagtgctaggatttgaattctagggagatccttctctatgggttgaatgatttgttgtttgactataatgatttgagtctcatgtctcccatttaggttagagtgattccaactcttgtgataaagtaatatccattacaatcaaaatgttggtcattataatatggattgttttgctttcactttgggaggatatgtgaatggttgcatttatttattatttggattctcgtaacccattagtagttttgcaatttgtgaattaaatgcgcatccccaattccagggcttttattaccgaaatatatttttggttgaatgcctgcattatatctggattggaaattaaattggcatttaatttctccttggtagcattgtatatgcctcattcgaggtttgtaaaataattcattcagtttacttggtatatttcgggatttgattattcgtggctttgttttagggtggatttccacacaaggaaagcaaagatgactgcatgatgcaaaagtttttaaaagttcaaaattttactgatttttttcaactggatttttagggtgttacaatggtggagattaaatttctataactaaaaaccgtgtatgccaatatgtattttggttccaagtgagtgttgatatggacaatgtgtatgatcgatttaattaacagaactacctctctatctacgtgattgttctgtgagtgtgaatgtgaatttgtttgattgatgtgcatttatgctagtaagaaacatactaatgttttatatcggcatacattgttacatggctactggatttttgttttcgctataacagaacaatgcatatgtagttctgtctgctaaaacggttacaagggcggatgtcttcagtaacagcccttgaaaaacctacaccgcatgtgaaatctgaacatatccacccgtgaaaatatgtttttgtaggcggtgtttgagtgcgcctacaaaaatacctgatatttacatgccccggctagaggcaggttagaaaacgtatgtgcaaagaacgtgtgctgtctggacacatgttttctacgacagtgatataaagtcttataataccatacacattaatttggcctatcaatcacctctaagttaattttttaaatttctttcaaccacccaaccaccctaaactatctctcgtttagtgaacgcattaaaatctttttttatataattttggaatcttctaagtaacttataaataattatattttggaactgggagaatatggtatttttccaacagagaaaaatgccaagtcgacagcagcttgccattaattatctcaggtcaacacaattaggttgaggatcggccggctctgccagctcgcctgcaactggatgtgcatatgaccttgcaagttgcagcgacagacatagtatttcctttatctaatcgtaagcctgcaatataatttttagtcaattattggttcatcgccccttgctattagcatgtcgatgtaacccattaaactaataaatcctagactaaacagatagaagatgctcgcgatgctaccacaccccctgtcatcaccatatttcctttggacaagtggactaacaaaatcattttattttctttcgaagggtccaattaatgtaatacaagtggaaccaattgtcttgtcaagtgggatatacttcctccgtccctaaataaatcaacttgtagaattcaaactttgtcccaaaataaatcaacttctatcttctcatcgacactcggttcgcaaatcgaaaaattttgttccttcaatacctctacctccctatccaccaatactaatttgctattaataagtgatattttggtcatttatcctcttttttaattttgcattgtgaagctagaagttgcctctttttaggacagagggagtatgtgtttatcactgacgttgacattttgtcctaatgattctctccgtttcatattaaagtcattttgactttttcatagttaaacttctttatctttatctttgattaagtttatagaaaaatatagtagcatttttaacactaaacaaatatattatcaaaatatattcaatactagatttaataaaattaattttatgtttaaaatgttgctaaatttttatgtaaacttagtcaaactccgttcgaggtggctgttgtttggatgtcctcgaatagagttaatagtagactctagtactcatcgtatcttatcttctaaagccgacggaaccgcgtaatttgattggtacaggtgatgcagtaattcacaaatcgagttagcgcgagactctctcgtgcagtaaccgtcccgatggttcggcctctcgacccatctggagctctgggcaatacttggcatcaagctgggctgcatagcctaattacgtgcgcttaggccaagcaaaataggaggaaaggaaaaaaaataaaaaagatatacataaaatcactgctgcagaaaggggcataagtcccgattgataacccccctatagtcccggttgtgcaaccgggaccaagagtccggtattaaagatatccatctttagtttcgggtgaaataaccgggattaaaaatccatttttagccccagttggtgttactaaccggaactaaatatcgaaccaggccagatccatttgctagatttttcctttttttcattgtttttaacatcgaatattgatttcacttcatccccaaatcgtgaaatcctaaatcgatcatcacagatcatagatcaaaaggatatctccaaatccttaaatcgatcatatccaaacacatcacaaaatcttaaaaaaattacatcacaagttctaaaaaaatcatcacaaatacatcacatatttacattacacacaaatcaaatacatctcagatctgaatcacaaattctcaaaaaaaaaacatctcatatcctgtagaagcgcaggccgccgcccgccgccacgcaggtcgccgcctgccgcacggccccgtcgctggttgccgccttccgccagtcaccaccctccatgcggccagccaccgcctttcgccggcctcgctcgctcgctctcgctaggtctgctctcgcgatagaggaggaatagaaaggagaggataaggataagacagaggaataggaagatgaggagtttgggaggataagtcctaaggattatatattgtatatggatttttagtcccggttggtgttaaaatgcccagccccctaacagcctcgtacagaaaatgaaccgggacaaaagatcaccttgggctgatagagttttaaaccgggataaaaaaatcatctttagtcccaatttctattcaaacagggactattgtggcttttgtccaacccattaaagatggtttctcattagtgaatatattttgattaaactagaaaatgaaacctgtatcctggccacatatgctgatgatactatcaacttttttagagtatgatttacagaaagctaaaaatataaaattgattttagctacttttgaaaaattatctagcttgaagataaattttcacaagagtgaattattttgctttggccaagcaaagaaatgtcatgagcaatattcaaatatttttgggtgcaaactaggagattttcatgttatatatcttggcattactatgtattttagaaagcttagtaataaagattggttaacaattgaacaaagaatttagaaaaaaacttagtagttggaagggtaaacatatgtttgtaggtgggagattggttttgattaactctgtgttatcaagtttagttatgtttatgatttcgtgttttgagattccaaaagggttcttcaaaaaaatgattattatagatcccattttttttggcaaggtgatgaacataaaaagagaaatatagattgacgagatgggaaattatttgtcagtctaaatatcaaggggaacttggtgttcataatttacaaatccaaaaccaatgttttttaagtaagtggttgtttaaattaataaataaataaggtgtgtgacaagatattttggaaaggaaatattttgtactaaatctataactcaagtcaagaggaaataaggggattcccattttttgtcgggtttgatgaaggttaaaagttcttttctaaatatgggtttttgggttattaataatggtgagcatgttagatctgggatgataagtgattaggtaattcatctttaaaggacaaatacccatctttatattctatagttagaaagaaaaatacatcgattgcaagggttatgagtgctgttttaatgtatcttttatgagagcgttagttggtcaaaacttgattagatggcacaatttgtgtgcttcaattgtgcatgttaacttaacagaggaggatgatatatttagatggaatcctcgtcaaagtggtcaattttcagttcgaagtatgtatttggctctaattaataatgggtatatagacagaaataagtttatttggaaacttaagctgcctcttaagattaagatttttatgtggctaaaaaatctggatttccttgtcgctttagaattggtggttcttacttgacggttggccgccaagatatattgccttggcggtttttagattacccttgacagtttttggccacaaagaaaactacggattcttgtagtatgtacatattgggcttactggtgtcacctttgctatactagcacttctcattggggccatcattttggacatgaacttaaggtaagatgtagtacgggctcttagttaaaactagtggataccctatgctttgctatgggatgtgtggatgagtgcatgttattattgatgtgaaaacacggcagcttggaagatctgcttaactccagtgcaggtccaaggctagcctggagtgtgtcaagggcataccaactgatttgatcctgcaatcagcaagaaagaataaaaacagaaccagttgcccgatagtcgatcggccgataggccgatagcatatcattgatggtgtcagccgatagagttagaccaaatcggctatggactggatatatcaaaaaataataaactctaaacacgcccaatcggctataacactatctatagagtttaacaaattgatttaaaacaatattatgaaagtagccgatgtacttatatttagagcaagagagataccgtactagctaatactctagtacaaacttatatagacaaattgatccatataaacatatcgaacataaatcaagcatgaaggtgtagaaatctagccgatatgcttatacaaaacaatctatctatgtaaatggcgaatatacatgaaacatgggatgagacatgcatattaggtaagatcgactgaaagcccgatactatccttattatgcctaattgtaggctagtttgcatagttctaagcacgactagggatgatgcatctcaaagtatgaaaaaaaacatgcagtctagacaatcaagcaattatacacttttcaggatggtagatgccttagataatctaatctagcaagataatttaatcgaacccagcataaaccctaaagcgagcagtagctgatagagctaaattgagaagctaataatatattaactaagacatatgatagcaatgactcacgatatcgagcctaacaagtctaaaacggcatgttagccccagtagcacgaaccattgagacgagttacctcttacgaagaactcaccggaaaacaagaaaagtaaaatgggtggcgatgcattgaagctgtatttgagttgctcccgtattacaatgctatggggttcatatttataccccgagtataaacttagtcctttatggacgcactacaacaaaaaccttatataaagatacttttgtaaagatgttttgcaaattgcctcttagatcaggagtttcatattgtaaagacattttatagaggcactttttaaattgcctagaaaacttttactatatagacattttagaaatatttttagcacatttattagattttatcttgtagagacattcttttggcactttaaactatgtctgatatgtaaagacattttcttgagacactttaaactctgtaaagacacttcttagaataaaaatatatactaaatgactaaatataagtatctcaaggcaaaaacatacaagtaatgacttgtggttgagtaagttattgccttgaatataagaatgatttgtgcaattgatcatgagttcaaggattggcaaacacaagagaaaatattttatttttttacattggttacatatggttgtggtacaatttaatgtctctataaaatgactctaccatcttatagacattttataaaatgcatttttgtttgtagagacaattcaccgtaaggcacttattaggcatatctaaaaaaaattaggcattttttaaaatacctctatagtatcgtaaaggcatttgaaaagtgtttctatatagtactagaaaaatgtctctacaaagcatttttctctgtagtgacacgactcaaaccttactaaagttaagatacaaacaagaccatatacgacggtctcttaccaaatctctaacaaaccaactcaatatcttaattaataaatacaattgccttaaacgagctctatctcttattggcaatgacggttatcccaatctagacccatgctgagcccaagtcacttcatatcggccgcatcggccatcggcttcatcaagcttcaaccagcctcgtactctgtttcggccaatatggtatccagtcgatgtgcaatcggactccaagttcggttcgattcaacaccaaatccgcttcgattttcttccttcttttccgaatctgatgccaaattccgttgttaacagttatacattataagaatggtagatttatatgtttaaataatgtgaagataatgatttgacattgcttgcatattgagttctaaaaacataacaaaactgtaaatgatatatgatgtttgcatgacatttaaaataattgctagtgggtaatgatgtgacataattgcgtatgatttaaaatactctagataagtaattgctagtaagtgagcgatgtgacgcacttacatgttaaactttagtaggtaatgagcatcttatagtaagatagaatatgtcacttagagcaggtacaagagcaggctataagctagttataaacatattttaaagagataaaataggagagagaagagcagcgggctacagatctatagtcaactgcagcacggactccaaaacgtaatgtgtatatgataggtgggaccaggtattaatagtatagtaagcactattgtatgaatcgactattaaattggttatagataaattggagcttgtagttggctatagtattaaacttgctcttagataatactcttgcactcattgagacaacgagacgttgtagtcattaatgtaccaatatttttttattattatcgttagttctttttctctacaacatgcagcaaacttgtatcatgtatacttgcatagcaatgatattttcctttctcccttctttctctttcacgtcatatatgataatagagagaggacgctaataaacaattaatgttacatgtgctaatgttcaaaggtgaggaatagagcagtcacatgaaaagaaggtatatataaagttaaccaaaaggttgtcttgaggcacaggctaagcccatataattaatggatgcataaaagattaaaaaaactgtagtctgcttgatttggcagaataggatcattaagagtactataatgcggcatatgttgcctctaaaaatgccacattagattaagtgatgagatggaggagagaagtaaggagagagataatgagccaccattaaatcaagaagcaacctccacacaaataagacttagggaaaaaagaatttggtgggtgagagttgactgtgagcttctttcaagtctttaaactacaggaagaaaagcatcgacaaccaataagacacagagaaataaaaaaattgataatggaggaggttacaatagaagcaaatgaaggcgttgtacctattttagttctaaccatgcactggggattgtacaataccaaaacaaagagaggagaaatagcaaagaggcatgcaatcgatctagactgtttggtgaagacaagatggatattttccgcgtcgttgagtctatccttacgaagatgtgcagtgtgattgaccaagattgggagctgggaggcaaattgaagaatgatctgatatgcatcaaggaagaaatgggcatgatgaatgccagcatcgagcaatgggaggggaacatccaagggccggtgcagcagcaatgggtgcatcagcttcaagacttggcgtatgatatcgaagacttcattgatggccaccggattggacctcaagagccgaatcacttcatgcctcgtgctgcgcgcatgatttttgggacggatcgacgtcctcagcaagtcctggacgtgaagatcttgaaggaacgtgtggccatcttacagaagtggcaacaaacgtttggatctactcaagccgtcggcggtgcaggcaacggtagcccaccatccggtggcttcggaggctgtgaggctgatgagcagcttgtgggcatcgacaacgccaaaagggagctcctatcgctgctatcggcagccgaatcccagccagatcagcaaaacaagctgaaggttatatccatcctgggaagtaacgggatcggaaagactaccctcgcccgaagagtgtacgacgagggcgatatcgtcgagcaattccatcgccgtgcttgggttgcgtcctgggcgtgtgaagactcggctagcctcctgaaggagatagtcaggcaacttacaagcgaggaagacggtgcgcagggatcaactagttctaccgagcaggccggtggtgccggtgcccccaatgttcgaaatctccgacaagatgtcgcggcacacctgcaatctcacaggtgagctttttaccagagcaatagttattcgcctacatatgcaagctaacatatggagatctgatctttatctattacttctgggcaaaatgtaagtatttgctagctagttgtatactagtatcttgatctataaacataagtaaaacggtcgtttatctaaatgtagacttttcttctttcaaaacgaaaatggactctgcattttaatgcttagattaacaggaaaacaaaaactttgaggtgtacaatgattttttattttgtatctgaaagtttagaattggagctgtaaaaactaccggtttacaacaatagtttggaagctttgaggttgacaatcatatttgacatttgattatttagactgttattgaaccatatatataggacctaaatctttttttttacacaatcaagcaaacttcatgttcattttttttaatcttatgtttttgtatgtgagtaattttacagttcttaagtatcttaagatatctaaaatttacactaagaattttgatgccttgagatacctagtactgcaggtatcaagttctacacttgaaaaatatggtacctcataatatcttctaaagaacagtaaaattatcctttgtgcgttgtggaatatccattgatatatagttttccatgtctgttaggtacttaattgtaattgatgacctgaagaaagttaaagtatggtcagatatagcatctgcatttccagaaaataacaaaggcagtagagtaattgttactacaagtattctgtccatcgctactacatgtgcttatggcagttgggtgtacaaaatgcaatgtcttcaaaaggatgattctgaaaatttgttctggaatgaggttttcaagggtgcaaatagaatacgtacacctgacttggatagaggttcagtaaccattatcgacaaatgtgatgggctgccgcttgcactggttagcgcagccaaatatttgaattgcaagcgacatgctcttagcgggagtgagtgcaaaaaggttggtctcaatctaggtaatcacctagcaagtgaaggttctttttttaaggaaattaagagagttcttgcggaatgctacgacagtctacctgaccatgggcacaggatgtgcttgctatccataagcatgtttccgaggggccaccggataaggaggaaaagtctgcttcgccgatggttagcggaaggattagtggtcagccagatccagttgaatgaggaggatgcagaggatcgtttcaaggaatttattgaccggaacataattgaagcagttgacattggcaacgaattggaagctaagcactggcgagttcatggtgttatgctggagttcatttcccataagtccatctccgataacttcattacattcattggaaacgaccggtccacaatgagcagtaatggccgtgtgttacgtcgactttccatttacaatagaactgctaaagacacaacaactgcagagaaaatggaagtttctcgtgaggtctctgacaatacgcaatagcagcgttccgaacttgaaagaatacaagtcactgagagtactggatcttgaagaatgcaatggcatcgatcaaagggttgtcaagaaccacatatgtgagttgctctttctgaagtacctgagcctcaggggcactggtgttcgccttattccgagcaaaataaaaaggctacggtatttggagacgctagacctgcgggagacagaagtggaaatgttgcccctggaggtccttaagctgccacgtttggcccacctgtttggtagtaagctcgagatgcctcaggagctctctaacgatgcagacctcgacctgcagaggtttttccaacacgaatctgaactgcaggttctggcagggtttgtcatggaggataacaaggcgtttgtacatgtgattcgtcacatgagcaagcttaaaaaggtcaagatatggcgcaaagccaacgctgctcctgccaaggacctaactgaacatttagtcgtctgcattcagaggcgtttacagggcagcagaccccttgaatccttgtcaattgacttcggcgatctctccatagacttccttggtgatctggcgccgccctgtgccctcgagtccctcaagttgcgaggggctatgaccagcttgcctgcctttttcacatcaccggaaaatcaactaagggagctgcacctttggtcaactggattgagcgggaagccctctctgccctacaaaacctgccttaccttgtctatctgacgctaaaagaggaccgtcgtggattttggagcgacacctttgctgtgcagagcggcggattcccaagtcttcggcggctgcgctttcaggccgccatgcttccaaaagtagtattcgaacaaggatccatgcccgatctcgccgatcttcacctgctttgtccagaaatttgcagctccatttttttctatcgttctttcgatatgccaaggaatctaaggcttggtgtttggcacatcgaaaacctcgtcagtcttaacgacgtggtactccatcattctgctagtgagcaacaattgacggcttggaaagatgcagcaagcgcacacaagaacaggcccaatgtgaggaggcaaccgcaataagggcattcctagatatttgctactttctctgtttcactttaatacgttttgggttttgaatacgtttattcatggatccatatatatatatgtgtttcatatatgtattcaaattaatatggatgttagggaatatagacgagggatggaaatgtcaaaatgtgtgaaacc

SEQ ID NO: 75115 - DNA, 11426 bp, Oryza sativa
taccactcgacgcgctgcgcggtggaagaaaacgctgagaagtcgaaggaactctcgcgaagtagcgcgcgtcgatgtagatgaagtagtcgatcgcacccgctcgaccttctcctcctcgtgcattctcctcgccgtactcccacaccgatcagcaccgcaaaccagcggcgcctctaccggtatccacacgtacagggacggaacgccacgcgcaaatgtgctagcacccgcgcgcagctagggttttgctcgaggagggaagtgacggctagggtttctcacgtgatgcaatgcctccgccggtcacaccctcacgaatatataggatccatcactcgggcctccaaggcccgtaggactcctattcggatccctatccgaattaagctcatattggatctctatccaatccccttattccgacccattaagcgtgcgaccctgtaggttcatatatactcgatcggctgtaacccgaaaactccttttcggtccacgcgtcaacagcggcccctagcagaatgtattgacccaccgggcatacataaagatcatatcggttgaacctctagtgtatacttgtatgaacccctttgcttcacgatatcgattaagctcaaggctagatatgtgccatcctctaatagctcaatcattcactcgaacctgttgatagattatataacttatgattggctcatcaatcacctttggcatggccatgcacttccataatctacaacatcgaggggcccagagatatctctccataggaggggcaaatcccatcttgattattcatatcccactacatgtttcatagcatacccgaaaactacttttataactacccaattacggagtagcgtttagccactggtggagaaagggtttttactcccggttcgtaacccccctgtagtcccggtttttcaaccgggactacgaatccgggactaaagatctttagtcccgggtgaaaaaaccgggagtaaaaatccatttttagtcccagttggtgttacccaaccgggactaaaaagactagatccggttgctctttattattttcttttcttcattgtttttaatcaaaatcacaaatcaatcccgtgcccaaaatcacaaatcaatcattcttaaattgcttccaaatccacaatcgatcatctcaaatactcaaatacatcacaaaatttcaaaggaaaattacatcacaacttctacaaaaggatcaaatattcacatcacacacaaatcaaatacatcacacaacaatcagatccaatcaaatacatcacacaacaatctcaattcttaaaaaaaaatatccgccgcctcgccgcgcgccgccgcctcgccggccggccggccctccgcgccccgccgccctcgcaccggccgccgctgtaggctgccagccgccgccgtgccggctggccagcctgtcgcgccccgccgccgcgcggctgccggccgccgcctcactgcgcgccacgccggccgggcctccgcgcccgaccgccctcggtctgttagagagaaggagaggagaaggagaggaagataaggttgaggagataaggttgaggagaggaagagataaggttgaggagaggaggagagaggagttaaaagagaaaaggaaatatctcgatccgatcgcgcatgcctattcgatctccgcgtcgatcttttttcccggttggtaacaccaactggaagtaaagcgtatggcgatcttttttcccggttggtaacaccatccgggactataaatagatctttagtcccggttggtgttaccaaccgggactaaggattgaaaagtagcatggagctttcaaaccaggactaaagatgtttttagtcccggtttttaatacaaccgagactattgtgaaatctggtcgaccgaccaaagatggtttctccaccagtgagcagtccctaagtaagctactacacatgttgagaatcatgataatctcaggtctaaggattcaacaccaacacacaatgagatcactgatgacacaacacatatggctcttgtagtgtctcatgttgggtctatccaacaacatgttcaccaacatgtgtccacactattaatttggtatctctataccatgatccatgagacatgatcatcaattaatacatgtgctgatcatataaacatatttgttccacatatgatatttgatcagggatcctttagaaatagtaacaaacaacataaagagtctcttgaaagaatcacatattcattaaccaataaagagttatctatttcaaggaacaatgtcggataaatatgtaaacatagtatgtgatacaatcatctctatgattgcctctagggcatatcattaacagtctagcacggtcaggatgccatatgacaagcactactacggaaaccatctttcgaccatcaatataactaaaataaatgagaactagctatgcttgcaatgtatatttattttagaataatttatttccacttatacttggattttatttgactttaggaattgagcaaataaaataaagagaaaatgataaaacctcactcctaagcaagcttatggataagatgccacatgtcaggtataaccgtcccggaaaccgtcatagggacccacatgtcagcgccccggagaagtttggaggcttgcagggccagcccaggttcggccaagacgcgttgagtgctcactcgtccgtcgacatcgcaatggaggatgcagagttcacaccaagattgttgagtgacttcgacctcgacctcactggtgaccaggagatgcaagcctaccggatgctcaaggactggatttgttggaggtatgtcacgagggcctttggccaattcttgaaaccattagagttatcaaaatgtcggttaagtcccttgggcgaagccgttgggcaaaaccgaaggatgaggaccactgggtttgccatcaagtttgggcgaagccaggtagtgaagaccggtggattcgcatgttagggaaccttatgcatctaggtgattgatatttgagatatagtttagatgaaggaaattcttgtgttctatctcatggcaattggggatttgtttttaaaatcaaaaattcatttgaaagcttaatcctcatatgactttattcctacctaccaaggtcatacaccaaaatattaatgatgaaccttattaatgtgtatgacttcctgtcattatattgagctttaccaaattattgtgactcgtgttagatctctctcatgctctctcgatcaaggttgcacaaccattatgctaagcttctacattgtaagttggcaccattccatccatttccgttaccactgaaaaaaatatgatgaataaattctccatccaatttatgccttcttctcctagaaaaatccttggaaaagaaaaagtaacagaggggaatgcatggctatgaaaaatattgctctttcaaaaatatggagcaacattgaaaaaaaattaaaaaaaagaaagtttacaaaggagaaaattggagaagaaggcatatacaaaggagaagcatcttctttatttcccattttttcacatatatcatacactttccaggtgcaatccttgatccgagagtatgatcgactatcttcttgagtccatttatttggttttgcaatatatatatatatatatatatatgatgcaggtatgtcccgaaattatccctaccaaactccacataaacggccttcagattagggaataattttggcaaaatatgcattggtaaggatccacagacattgcaaaatatttgagtgattgagggtaagtcattatgaggagaaaagctgatttgtgaaaatttacaaaacccaaaagtctgagatggagtatgagaagaccggattcaagactgttgcatttttcaatcgcccaagatggtaagtcggagtaattccagagttgttggtaatcctcttcttatttcttttgctctgttaattactctgattataatagaaatatcttttgattaacttagttttgcttcatgagaattatctcttggttagttcctaattagcatgcaggatcatcgttcactataatccagtaaaatatagtgattgctttagtgtgtagctaacattaaagtaagttattaactgcgtagacacagtgtctaggtagttgattttcggtgtttgctccgcatcccacggtaggtgtgaggtgggtgtagaggtggtgatagccctcgagatcactgaagtcctccctgtccgggtgcgtaatagagcgatatctgggagcggcgagctggccagtgcccgagcagtggttctacacgaaccgggtgacagttaacacctgggacagatgctccaccacgttcctctccaaataattcccaatgggcaaaactaacgcccttcgcgagagaatatcaagtttccagcagaccagggatgagacgtttcccgaagcgtggaaacgtctgcaggagtatggagccgcctgtcctcatcatgggatggatgactggctcatcctgtagagtttctacaatggactcactcccccgtccatggatcacctggatgctactacttcgggtgctttcttctcaaagactgatacgacccctgtagggggatgtcccgatcttcacggtgtaggatcaagaaccgataactagcctcaaagagaccaagataactagctgcaaacagccaagataacagtgcaacctaatgatcgtactcgaagccaaccaccgtctctattacggcaacttgaatcgagagtttttccaaccacactctaagttaccaaccaacacaacctggaatcaatcaaggaaaaacctcgaagggaccaggagcaccaattggggggcgtcgaacgccacttctataatctcacaaggaaatcacaagagcaaaggggtagagatctctctctgaatttgttagcacacagctgaacaaaaggggttcatattctcattgtcaaaagtcttccaaatgataaaacataggggatatttatactaggaaagcccctcctagatggggataaacatggcttttgaaattcaaggtaagtgggctagctcaagtgtctccatgagtcattcccgagcaggttcaatagagcctttcagcttttgtgcagcctccactaaaatagacattactctctaataggaagtcgaaacgatgagccgtttattggaagtgaaactagacttgattatctttcgaaccatatatattatgcatggaggaatttgactggctgggtcacacacccccttagaagttgaagcatctatgcataaccggtctgctcgttgtcgttaaccatctccacttgagtgagtgccactccatcttctgtgcaatacatctcatcctttatgcaatcattcattgttgtagtagcgaaatgatcctcggacataaaccttaaaaatgcaaatgtacaccatttagatagtataaaattctcatcaatagtaaaaaaccgatagcacatccatgactcgcatggaacatgaataattgaagccggaaacaaagaactaaattgaaaccatattgcacatccatggcaagcatggaacttgaattatttaaccataaccagaatccggaatattgatacaagaataacgtcgtaaacataagataaacttgaaatctaaatggcatgaacaaccgtttgaacataagcggtcacatatcacatagaaatataatggaaatagatagatagagcaaacaatccatgaatcacacaattaattcgtcatgcacttgccttttaacctcgacggcaacccgacagaccaccctccacaccagatatctccacacctatggagcaaaactacaaataaaccattatattcaactaatgatagttgcaagggatatttactaaaaccgaaacctagaacatagaaactttgactgatttgtattaaacaacctacagcaattctgttactgttttatacataactcacaaacagtctaacggaatctggcaaataatacaactccgatcatctagaaaaaaatgtctacaactttcatgatggacgaaaaatcagattaagcctctgaaggtcttagattaaggaaaaacgaattgatgtcctcgtttccagacccggccagcagtactgttgattcaaacctttatatctcgaaatatatacattttggaaatcgacagaacaagacctacaacttttatgtagaaagcatatttttattctgccatttagatggtctaatttgcgcttgaatgcaaacttcagaatctgcccaagaattcagactatccagactaaaacaaccataactggagttctactcgcccaatcaaagtgtactttaacaatatggaaagctaagaaaaacctctacaactttgtttataggcagcctgactaattccgctatttagcccctccgaaaacagttcaatctactactatctagattatgaaaaaaaaacaacagtcatactaaaaaaattcatatcgcctaaaccacttgagataaaataactccctttggtcaaaagatagatcactacatgatctacaacttttatatggacactttgatcagaataaatcattttgaccacgaaattgatggaaaacagaggcgctataaatcttcccacgcccagaactacccatccgaatcacaacgcccaaaacgcttctctaaccctcctcaaccacaaattgaaccactaaaaccaccctagaacaacggatacatcaaggggaaaagcctcacctagggtttgctccggagaacttgtgagattatgatgggaacgccaacccaccactcctcctgcttccctcgtcttcctcgatccgtttttccaatcagattcttgattagggctatggttcttggagatccatggagtagggttaccaggggagaaaagaatatgtgagttccattggtgccaagggggagggtgtggcggctagggccgcaggagcgatcccccccttttttatgttggttaaatagagaggctactaaagatcgaacgaaccacattaattcaatccccggaacttcgttcggactccgattactataagcttatagtctatttcgcactacatgatgagccctacgcatccacggttcctgatcgcctattcgaacaacggtttaaaagttgaacttttgcgcgtttgttctaatttttcccaaaatacactaactcgaaactcggggtattacaaatgttaacttgtatatgcatatttcccttcttgcatgtttcctttccttgcatatttcctttcatgcattgcatttataacttgaaaacaacataaaaatttgcaaaatagaaactaccaaaaaatataggatagattttattatgctaggtaagacaacctagttctccatgttgaaatgatgaatagttgctctgttttatatctttaatgtatgtgttcatagttaagtactatctcaagttttaagtgaaattagccaacaattatccgggaacctgagagatatgagttgcacattgcgcgatctaagcctaagttattgagagatatgagataatgaaatagagttgctataatcttgatccaagcttgatataaattcctgatgatttgttcttcaaaatgataaatttgaaagttcattatttgatataaattcctaccatagccaaatatagattttactattgaaaccttatacttggttgcttgtatttccattgaactttgtcaaatcttgtgacttgtgtagatgcttttcatactttatgatcaagatcatacacccacatatacacacatgctaagctcctacattggaagatagcatccatgtcatccaccatatccatgtcattatccacaaataagccctacattcattcttcctttccaaagaaaaatcctttgcaaaagcaaaagaaaaaggagggaaaggtatggctataaataaaaaataaaataaataataaactcttgctcttccaaaagtggagcatgatgaaaaaaaatatatagccatactctctctatgaaaactaaaggatattttggaggaaaagcataagcacaaaggagaagcattttctttatccacatgtcattttgtaccatatattccacacacactttgcatgatcttgatctaagtatgacttgctatatgctttaatctagatttttagcttagtgatatatgtgactacaagtatgcctcatttgatccttaccaagctccacatattcaaccttagtataggaatcaaaaggcaatttttttggtgatgaataaatattcaaccacttttgagtgattgagagaatcacttgaggaatatagttttaatttgcaaaatttttgaaaaccatccggaatgaaaattaagcagggagatagaaaatggtactctatgatttgttcaatttctcaatctcttaaggtggtgagaagcgtgttgtcacgcccagaaatttagcccaaatttctagactattttgtgtattaaatccctgtctaggaccagccagggtagacaaaacgacaagtaatatatagttccaaacgtacataaagcgtaaaatacttacaggagaggctcttagtcctcgcaccgaaaaggaacgacagcagcggaaaaaggcgatcctagcggggcttcagctccactccacaggcaaaactcaactggggtctgagccttgggcttctaactttatcttcaactcagaagcactacacttctgaaaaggggaataatagcaaggctgagtacaaccaccgtacttagcaagccacaccaacgatgcagacgtgcaaggggatacaaggatggcttgaggctatttgcataaaggcggttgtaaaacattttattgagcaaaacagtaaagctattgagtaattaaggtaacattaaatctccactgatcaacgctacaccgcgttgaacaggcccaaccaactcacctgaactacagtgcattgagtcgatttattaaggtgagactaatcacggtgaatctggtcgatcgcccataaccgcgggcacggctattcgaatagttttactctggccagaggtgcacaactgtacccacaagacacaatccaccggcatgtcaccgtgcccggccggacacgccaccatgtcgagtgattgtgacaagacccttcatataacccgctctgaccaagcacaccacacctcaggtttcacccccgcccccagcaggcagcgggcagtcccctctcctgcctagatgaatccggaagcgataaagaccgtcgcagggcccgccccgctccatcatgcccacccttgccaataccggcagaaaccctaaagcgagaagcagccgatagaggtaaattgatatgctaagactagattaacagagacatatgataaataggtagacaattatatcatccaaaccggagcaatccaagaggtcgaatgtactgatgcagccttgaacgatgctgatgtagattagacaattgcctgggccgacggaacattggacttaccctttagccggagattgaacactgatgcagccccgcgtcaggtgccaagtcccgccggatgataaaataaagtagaaaaggtaaaaggtggcgatgcgccgaattgtattgatcgtagcgatagattacatagacctagagtgtacatatttatacccatgggttgatacaagtccttgtcagacaagaaagaaactttcctaaagataaaaggaaaagataaagtccttataggacactaaacacacttttctaaagataaaaggaaactaacaaactattcctaattaatatataacttgccatgccgcattctctttgaactcggtcttttctggataagcttcctttagtagatcaatttccttaaccgaatatagcaagaatccgacaactgacgacatgacaactctcatcggctaatctcaggacttcgaagccgatgctgactctaagccgatgactactctgggcttaccaaatttcactgttaacaggcccgtcctccgcctactctttattctaaaaacaaacataactatcgttggaatttattttttattttctaaaagtcccatcaaccgtcagcggctctgcaactatactactatacacccgccggctgcttctcctttttattgtcattgacattttaaaaattgaatatgattatcattggggtttacttcttttttactttctagaagtcccggcaatcgccttcctcatttgcttcacggcctcctgttgtccctccttttaaacatcattaggattctattcggtgttttattaacaattttatatgttgtatcaacagccactgctctactcctctgtaggccatttacttaagttatctcgtcatgtgttttagatggtcttttctttcaatagtatttatttttatcacaaattttagctatttataaattgtattcctaattgaaatcttatttttccttttctagtttcataaattttttttcaaattttaattaatacgtattgtgctcttttaatatttttattttttattttcaatttcagttgtttcaaaattatattcctacttgaactcttttttaatttttctaattttgggtattattttatttttttctgaattttaattaatctcatattgggttcttatatggattatttttttaatattgcttatttttaattccgaatttcagctaattttaaattgtattcctacatgaactcttcttttattttatttttttggctaattttggattttattttatttttattatgaattttaattaatctcatattgggttcttatatggaaacttacttatttttaatttcgaattttagctatttttaaattgtattcctacttggactctccttttcttttctaattttggattttattttatttttattttgaattttgattaatctcgtattcggttcttatatggaaacttctttcaatattgcttatttttaattccgaattttaactatttttatattgtatttctacttggactctccttttcttttttttctgtttctctgattaatgtgggaatttttagcccccacagcgaacatggtacctcctttcaaagttattttaataatataatagatagatactcttctttatacatcttcggtactttgtttagtatgagtaatgttcttattttatatttgtgtcatattgattgtgtgggtagcctaccagagaggtgcgggtttaatgtctgatttatcagttgctctatgtcatgtgcacgggtgtagagtaatat

SEQ ID NO: 75116 - DNA, 4343 bp, Oryza sativa
ggtactgctttgtatttagccccggttggatgggcataacaggttgtcgtaaggaactcggcaacccatggtggtctctcgaagtaccaggaggacactgttagggggtattggccacacaattgtatactagcagatgtaaactaggatttgagtgtatatcagaagtataggaattgagtgctttctaattcttcttccacttagttagaattactttattatgaggatttgattagctttgtttcgtgtcactctacccctatatattaaacttaactcatacttagactttgacaattacaagtaatatatgtataaaatacgttagcaaagtccactcttattatcttcccttgggattaaaaatacgataccttagaatacttccgggtgaaatgctacaatggtatatccgtgcgctcgcggattacttctgtaatcataaatataccaggactatttctgacgccattgctgggaatgaatatctctagtaatatcgttaagaaatactaacagtgcactagatgctagaaagaaatggtgacatagtgatttatactggttcagcccctcgggatgaggtaataccctagtccagttgtttggtgcctaaccctccaggggtgttgccaatacccagaggatgcgatatcccttataatccgggtacctgccatccgtcatgatatgacggaataggtttctatctctctattctccgctacttatagtaacagattatataggcctgggcccatatcacgcaagagatccagcctccgagtaccatgatgggctatcctggtacgataacttccacacaaccatcggagggagcaaatatcacgagtgtatacagtcctcaacgaccaagggcgtccgcacgtggacgcagtcctcaacaacgtccgcatctggacgctataaggaagagcgtccttcctatttctttaattttgaaactatgtttactacttatttaattttagagttattaattattacaaattacaattaattttcttgttatccatcgatacgtaatgggcagtgcttcgaactttatttaaggaactgtctatatgagattcatatgattttttaggcttccatcatgcactgtctcaaccttcccatttatttaagcaaactctggaatgaattacattcgatgcacagcataacgtggcttagtaggtagggtatgtataaaggtagagtctaatataagctctctatactaattaatattactagagattatctataatagtagagacaataagatttctataaaccattaatgcaccaaatatttttattattatgcttatttccttttctccaccctcatgcaacaaattttccattaataaatgctaagagtcgactttgagctgttatcatgcgtagtaacgatgtttcccattacttccccctcattcttccacgtcactaaatttatttgaatgacaatgaagagagcccgttattagatactaccatttgtacatgccctaagcttatttatcgggaagcttatttatcgggaagactgtaagccttcttaggctgcgttcggagataactctttctctccgcacggaaaacggaatgatccattaacgcgtgattaattaagtatttgttaattttttttcaaaaatggattaatttgatttttttaagcaactttcgtatagaaattttttgcaaaaaaaacaccgtttagcagtttgaaaagcgtgcgcgtggaaaaagaaggagaagggttggaaaccctgagtagcaaacacagccttaattaatgtcaagttgttgtcctacaatactccctcggtccctcccacctatcgttgacctttgtgattactctatggtaatggcacactccaacactccattatattatcggtctgatgaggatgaggtgttagcttgttcgtctcacccatatcatttcttgttaggggagagaatcagatgctaaactgtgcgcttcaacggggatgatgaactcccttatacggaagctcgccactgtgtcgagcgaggacatcgatgtgagacccttggagaggaagatcatcagaattaactctgatcgcttgttgaaggtgatccatcatgtgggggacgcccaagccatggagtggatgcggcaaatcctggaggtggcctacgacgtggaggattggattgatctgtgcatccatctccatgggcgcgttagagcagatcaactggaacggatagaagaattcattgtccggatagacaacgtggaagaacgtctgagcaggtataatcttttatcatatattggacgaatttgaaccctattctgattatcctcctctgagccaatcacccatcggtgataatcctcacatgctctatgcgatggaggaagacttgatccatcactgtgaacggaaagtccggctgagaagggaccttgtcttgaatttgatggataagctggtggtggattccgaccagcagctgaaggtgcttttcattctcggggataggggtattggtaagactacactagccagccagatttatcatcgtacaattgaagaacgatttgattgccgagctttcgtttctgttggtcaatatagcctgtcagatcaaccatactgaactgtacatcaaatcaggcggcgatgagcaccaagtcattgataacttcaggaatttcctcagaaataagaggtaactgtttcacgacttgttttcaatcgggtcaaattttctcctttttttttctgctttctaaaattttctgcagttctaacaatgaaatcttaccgaagatttgggtttgtggggtgggtccgtgggtggtgctggactgctggtggtctgccggggtgggtgggggtggggtgaggggcggttatatgtgaggggatcatttttttctataacgcaacccatgtgtagtatagcatggatgtcagtgaatctagtcgagggatggagaggtcaaaacgccttataatgtgaaacggagagagtaattgatttttctctaacccttaacccaaaagcagccttatgttgataacctaaaccagtcttaaggaagcctccaacctcgcaatcaccgcgtgcttatctatcctatcagtgccatctcgatcatgcagtcctcactgccactacccacgctacttcaccaaccccaagcccccacttccctcttcagcccctcatggtcgccaccatcctcgatgccctagatggccagctcctaccagccaacattctggctcaagtcgccaccaccaccactggccagtactagggcattcctctcactaggcggagcttcacacgtgtcggcaacaccaggtccgcactctgcaagaacatgccaccacgttgagaccacactccttcaaggagctcgtcgcagcggaaactgttggatttcaaatcctctctgcgccatctaccagctcacaacgccttcaagacgacctttactcaccccagtcagagctcaacctgagcttctccccgcgcatcacctcagcaccagttctactccatggcctataaagctagcccggtgaaggggatggagatgcgacacatccaaggtactcctgccacggatgactttaattactccactcgaacctgtgtggcatcatgtaagagtgcgccattggtggcgtcgggcaacgcattcaagcgagctcgaccgcccaaattcaagttgatgggatctgaattcaaggcgaccctccccgctccttgacaacgccttctatggcccatgcccccaaatgccccccggctgatctccacgaatccccacgcctttcgaaacgtgcatctcatggaaaatgaggacaggatcacttggaaactaataaatcagaacaagtaaatggcagcgttggcctacaatgcacaattcctatgctcaagaaagtacaatttcaacgtcatcatctgaaaaccttgggcaccacgaaaatgcaagatcttcacatggttaatgattagacatgctctcaactaagggatagccaaacaactctctgtcccacctatgccaccgaacacaagagacggccctacaccttctagcggaatgtagatacataaggagagtatggggggcattagcagaatggataacatgtcatgacctaaaccccacccagtgggaatatgctacaatggtgtaggagtggtgggaggtaaccgcaaacatgagagaaatgccaaagcaagtagtccgcagcttaacactgctagtcaactgggagatttagaaggaaagaaatctgatgacctttcaatacaaggag

SEQ ID NO: 75117 - DNA, 1400 bp, Oryza sativa
ttctcgatgattggactaatcgctaaaaacaaggagaaggccaaaacgtaggccctagtggggcctagaatgttagccgattggctgcctagttcctagccaaccttctggtcctaattgtacattctttcttgctcctttttctttccgtataatttcctcccgttctatccaattttgctcatcgattcatttaaaaaaaacaaaagtaagaacagatcaaaattgtactaaaatctccaacaaaatcactctgcaacttcacgccataatatttttttctctatgacactgtgaaagaaagggggattgataaactcatattcaaaatatgtgaaaatgaaataaaaaaggattgtgattcacatcaaaagatgcaagaaccaccctatgcattttttttattttactcaaactgttgatgtttctgcacaatttggtgcctagccagatttaaaaaggttgaattggatttttataccaatcctaccatttgtcgcattacagctgcattttgtatacaactataacaatcaacatgcatcgctataatttgaattcactacaatttcagtgacatgtgattcaagtccacttaatctgaatctactcaaaggataaaaagtgaccagaaagtgcagagatgaatagtgtccgttttatagtttatggattttttaccaaagtggcataatacttagattttaacaagtcagattgaatttgatgtaaaataattgttctgttcattcacaagaataattatatattgtggttgtgggagagcaatataattattcctatactgatactttcatcaattcattaggtacttcattgtaattgatgatatttggactacaacggcatggaaggctatcaaatgtgctttcgctgacaacaaaaatggaagcagaataataacaacggcgcaaatcgacaaagtatccagattatcttacaggcatcacactgatttggtcgttatgcttgggggtctcagtgaggaggagtagagaatattatttgacaacataatatcagccagtcaaagatatttgttgcctcattatcagttacatattggatttaatgcacataatgatatgctaggatgcacgcctttggccataaggattgcagctggtctgtcactgtcagcatatcctcctccttattcatatacttcagctttcaagcaatatcccctcttacaagggataaaaagatgctgcacatcagttatgcttatctgtctttgccattgaagtcttgccttttgtacttgagtctctttccagaaaattgtaccatctcgaaaggtcggttgatacggaggtgggcagctgaaggttttattgatgaaagagatgaaggtagcatctgggaaacaggggaga

SEQ ID NO: 75118 - DNA, 2138 bp, Oryza sativa
aagtttttcaaaaggaccaaaatgtgaaaaatccagttttctggtgagctccagtacgggctcgttggggttatccttcactagtgatgtgatggcagcctcggcttcctccacatccacaacagtcgcgtcacgacagtcgacggtgacatggactcgcgtgagggaacggaagtcgcgcattccgaaatagttgccgtgaagccgaagtccattcgccctcaagtaaagcctgagccttcggaggcgcggcatggctgcaccccagaaccgtagcctgagccacccgtcatccaaacacctgaaccagaacacctctagactccgaaatccatcatcatatatgtctatgtggcagatcctttgtgcggaagacgccgaagtcaaattgagaacgataagactaggcattcttccgaggacttcgaaatcactttcgttcacctcaaaaacgctgatatgcaggtgggtgagttctctcatcccgacaaattctcctggtacccttatgaggttaccacgcaagacaattctcaactcaggtgttttatatcctccccaccgcaacagcagtatttcaagtagagcaattggacaatcaaaaaggaataggtacttaagtgtacctctgccgaggatgatgttgtcaatgaaagtttcaatactacttccataataactttaggatgttttactgtcaccatctcctggaccccactgtaatcccagcttcctcagcccatctttatctattatatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgtgcatctgtttagtacttttttttttcgtttgttcctttcttttctttttccaatcctaattaaaattgaacctatctttatagaaaagaatacccccacaaatagacatcaaacgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactccaatatataaccgttgatttcattatatttgatggacccattatttacaaccattaaatttatcttatagaaaaagttaaccacccaaacctaaccccacccagcgtacgtacttatatctcatatacaactacctactatatatgaaaataataataatatacctcatgtattattattattattacaccaccctcttcctagattaactcttccttctcatattttttacgctttattagttagaaagaaaaatcttctattatatactaaaagttcattaaacttcctacgaacgctcctcaattaccatgtggcatcctacaaaacgtttctaaaccgctacgtggcgttctaataaatcggtggatccgctatttgtttaataaattgctagactcactattttcaactattatatttatctttataaaaaaaaatcccacaacccaccccttctctcctcagtacgtatgtatgtacgtaatacaatgccatgctttctcccctcttccaatccttctcttcctatttctagatgaaaattttaacatgaaaaaatattataataaaacatctaacctttgcttttcacttaaatcgatcggtgaaccaactattttaaccattgtccctaaaaaaatattttaacgattatttaaaccggtgaacccattaatctatatataaaagaaacacttccctaaattttaccatagaacattgtgctttgcatgaaaagcaaatataaacaaacattaaaaccattagatttaggtatatagatggtttaaaccggtgaacctatcaaatctatatata

SEQ ID NO: 75119 - DNA, 5773 bp, Oryza sativa
aacaacagaatatctacacacagattgcagatcttccctcctcaatagttcttccacaaaaaacttttaagtcaacaaaattcagaacacattcgattgttctgaaattttagcatcctaaaattatttaactaattacgtttttgacattatcatggaattgccttttacttttagaacaatattattaagtctagtaagccatgaagaactccatgatttttcaaatccatttcttttatcctgcacccacaatatcattgagctgcactgtatagctaatgcaaagtctgattcaaacaacttttagctaaaattttcctcggtcccaatagctccagtagataaaataattgtgtaagccaaagagagcaatgcacaatatatcagtaaggcgcattgctctttgtgtgagggggcagaatatctatccatatcaaacctaactcctccatatatacaaaagaatcaggcattgtctttgataaaagaggcagatcagatttcacttgtacacttttggaagcctataaatagcaagccagaaggatcatagagtattgcagaacacagaaggcaaagtcatatggatgactgaaatcctacatagaagcggcagtcgatggcatgcatcatctagtggtgcatatcctagagaagttccgagagaagtatagagagactatttggtgcttgttatcacccaatgctaggtatgagttatggctatcagtggccactcgtgaaatgagatagagaacggaatgcagccaaggatgacttgccggtacgtgtatgcatgtttcaaggtactatatgtgcccccaactgttttagatccatgctgacattttccggcaagttgtccttggctacgtcttgttctttttctctcacgtgaggccattgcatggtttgcatttagcttccaggtcatgcatgtacagtgatgtatatcaatgtaaaccagaaatatattgatgggattaaggattagtttagttgtgaaggtgatgcacttctgattgctcacatatagatatccaggcaacatctgattcaacctgattgatctttccggtatgatgacggcttgttcagagttggatatgccattgatgtaaggtgttgcacctcatgttcagttatgttacctcattcaaacacacatgccgctggatagatgtttggacactttctttttattttgtaatttaagcaaacatgttgattataggtgtagtggcccatgctcaacaacattggcaatccaaggataaaataacttgcagaggctataccttgtcataactaactagctagcattatattcaaagttttccccttttaactaaaacccaccgcttcaaatgtttcaaatgatctgttaaaagaagcatagacagtcaagtttcttgattactcaaattttgaagtgatgcatgcccaagatatagcgacagctgataagatgggaatatatgttttgttgtttgaggttaatggaagttggtaatagccgataagatgcaggatcctatgtttggggtctgagtttaatggaaattggtagtaccatgatgcgttgtgaggtggagtgacagcagtaatcagcaagtctttcttcattggtggagtgacagcaggaagatggtgcctagagctaagggacgtggttatgacacaatcatcattctcgcagcttggccgatttggaaagaacggaataaccacatcttcaacaatcaacaagaacatggatggaggtggctgctgcagctgcagaggaagctgcactctggcattcaaccggggtgccaatctggctctcgctggcacggaaactgtggtcacaaaatagatgccgtgagaattagacctttaaccgcataatcagtttttttttcttttgtttctcattttagggatttgtaacttgagctgctgtacaaacactccatcttaatacaaaaatacgcagttcttatgcgtattcccagggaaaaatgatgtgttgtgagggttgtccaaactcagttaactcctgttgatgagaagttagctggacaatcatcagtagctaagagggaaaaaaaaagcactggttctattggtcgacactagattcaatgctactatccaataccaaagtcaggacatatatggtctagtagcaatatcaaagtcaggatatatatggtctactttttttaggggatatatggtctagtatttgatatagagggaaaaaattttccattaaaaatctacatgaaatgaaagaagcagtgatgattgaaatcccccatttggccactagccccaggaaacccaatcagtcaatctaagtgtcactactactagtagtactaattagacctgccctagcaatagagcaactacgacgagctcccaccgtagtcagattcgcaggcactagggtgtatcaatatcaatcaaatcgaaggatcccacggtttcatcggcgatacaatttcgcagcggagcttcaatgcttcatcaagatgtacactacaagttggttacctctcgagcgcccgtggtcgcgtcgcgtcttcgcgcgtggccccgtacgtcgtacgcggcggcggagcgcgccgcccacgacgaccagcgcccgccatctggcctggggttgcctcggatacgacgccgcggcggcgcggctcgtcggagaaggggaagaaggcgacgccgcccgcttgcctcttcgtgggcttcgagactagtatttgctttggattctcagtcactcactaggcctggttgagagatgggctggtcgagctagtgggctggcatgtgaggataggttggttgggtagactattccatcttttaattcttagggtaattttcgcaaaactataggtgttttaatcaagttattacaaaactatgaaactaccgatttaacactaggtttatcatagagctataaaatatcgcaaaagtacatatttagtaacaaagttatcacaaaactacaggttttatatcaatttaatcataaattttggacatttataactcaaacataatattagagctaggaattaaaacgtaaaaatatgtactttttgattattttattattaaatttgtagttttatgatacttagccttaaacgtatagttttaagaaaaaattattgttaaatatgtagttttatggtacatcaactttttgcaataatttagcttaagtatctattgttctgtgaaatttactataattcttataaacaaaagattccttcgtttcttaaaacaagaaaaggataaaatattccaggaaaaacttggagtggaacttcgtacgaatttggaacaaattaacaataaataaggtaataaaataactaaaatattgttcaacaagaagaaatcgtccataaattcaggactttttatagattccaaaattgagaattcccattaagttgcttgaataatttgttcttcttcttcacctgtacaaaagcacaaattttactgtttaaaattatccaaggcttttatggggcgggctttctttggtcaatggtcactaatcaataaaatgttatttggtttacaatagaaatttgatctttaacaaatgaaatactttaatcaataaaaagtgtttactagtgtcactataataccatttattgtatagattaatttaatcattttgatgttaccatgtcccaaccaattggttgacagcatcatcaccaccaccactcatgacatgccacaatgaaaaaaccaacagctaaagcaacacaaaatcaaaccccaatcagctgcaaaacagaaagacaaaacaagaaaaacccatagattcaaatttaaaattcgctggaggaaaaaaaaacaaaaaaaacaaatcggaaaacaaaatccgcttatgcagtcgtggcccccttccccatcgcgtcttccattccagcccagatcgagcgagagagccgtctccctcttcgcttctcctctcccccccgtgatctgaccgccggggacgaccccctcccaccacccgccgccgccgccgcgcccccgcccccgccggcgacgaccaccatgtcgtacgatcgcgtcacgaccttcgaggactcggagaaggagagcgagtacggctacgtccgcaaggttccctcacccctcatcgtcttccttcctcttccccatgttggattggatcggtcactctcgtgcgtagatgcggcggctctgcttcggattcggcttgttccggatcggtggagttttagctgtgagtctctgtggattttagtgctggtctcgaatccccgatcgcgagagtgtgggtggcactgctgctgactggggaatcgtcaggcgatgcgactgtgccgagagcctcggactcgggtggtgtttggatcgagttgaattgatgcgagattaggttgataggacggttgaatttaggtttctactggtgttcggatcacgctggctagactgcgtggatcgacgtttgatgcgttaacttccaaactcatatgcgggacactattgtgatggggttggttagtgaaccatccccgatgtggagatgcgctattatccttgggagtttagcccgtttggataatatgttgattgtctactattggcacatgatccatcatttcatccctcttttttttttttgtattgaacgaattgtttcgccttcatattgcattcttctaggtttctggacctgtggtcgtggctgatggaatgggtggtgctgccatgtatgaacttgtccgagttggtaatgataacctcattggggaaattattcgtcttgagggtgattcagccaccattcaaggtataggacggtgaaattctacctcacatatttgtggtgccttttccccacatgacatgtacaatataaatttcaccaattttttcttgtgattaccgtttgcagtttatgaggaaacagctgggttgatggtcaatgatccagtgttgagaacaagaaaggtgtgatgcattgttaaattctatgtgcatttcacatatggttttcttacccttttcatttcttttataacacattgttgctattttcatcagcctctttcagttgaattgggacctggtatccttggaaatatctttgatggaatccaggtgagacaaatgtaataatcggacatttattaggctgatatgaggactttatgctgactacatgaccttttttcctttctacactttgcagcgccctctaaaaactattgctataaagtctggagatgtgtacataccacgtggtgtttcagtccctgctcttgacaaagatcagttgtgggattttgagccaaagaagctaggtattgtgcctgctaacctgttataaaatctgagcatgtctcttttcaagttttatcctgtacatagataaattacattggtcatttgaataggtgttggagatgccatcactggtggagatctatatgctgtaagttaacaagacagttcccttttttacaagttattatcttgtgttattgctagcgatcttctgcaatctgcagatccctgatgatgttaatctttttatgtgtctttgtgttgcctaactgcctcacagactgtgtttgagaatacgctgatgaaacatcatgttgcccttcctcctggttctatggggaaaattagttacattgcaccagctggccagtatagcttgcaggttagtatgtgttacttaaagctgcttcttctgtgc

SEQ ID NO: 75120 - DNA, 8181 bp, Oryza sativa
atagaataacccaggcctacttccagatgtatgagatttatagctgaataaatcatcatgatagggactcatgtcaggcctttcagcagcttgttggtcacactgcacaaaatggtacgaatcttagacaggtagtgtcaacagtccattggttcatttcagcagacaacttaattgcgaatgtaagcttcagcaccactgaacaactaactactcctggtccctggagacatgaatctactacatgatataatacataaacattagcactaacaaaaagagctcacaggggcaatcaacgacagaaaagacaagtattcttccgaacaattgatattgcacagacagtatggtacaccaacagtcacaacacacattcttctctgtttaacccaaacgccgtttcatattgcatcagatgcccccacattattatcgattttactatgcatctggtgatctggaacttatgaagaaatctagattattagctacaactaacagcctcagtttttccaaggctgttttacttatagtctcttcaagctcttcttcctcgcatcaatcttcttcttctcaaccggagctttcacagcatgtagcccatccttcttgggtactgctgatgctcccaaggcaggatcagaaggagcagcattctgatcctgcaaattagagccaaatgctttatttgcagtggaggtagataatgctgctggacccaatggtgtgttcttgctgacagcattgtttgactgatccacatttagagctgtggttgattcagaaatagtcccgctcttggtcttattcttgggtttaagtgcatggatgctagtgtatagcctggatatgaagcaacatgaaataatcagtaactaattacagagccacatgaaactttagcaagtgaaacaacatagcatgctacagtggcaatcctaatatggcattctttgaccagtagagctctaatcaaggtttgatattacaacgctaaaaactgaccttgcatgccgtgcatactcctcatagttctcaagcaacaatttcccagcttgctcattaagggcagattcaggaaatggttctatcagaaggcatctcactacctgtcacatgccaagaaagaactcttactcgctgttgtgctaaatcatagctcagcaactgcttacaaagtaacattactggaataatatgattctggttaccagcagaacatgtcttaatccaaggctaggattccaatccttcttcagtgtgttaacacatatttcaccactagttgctatatttggatggaaaatttttgtcaagaagaatcctgcaaatcaaaagggaaggtcaaagacttacaaccaaatgcctcacttgaagaactaaagaagaacattactgaaagttttgagggatagctacctttaggaggagactgagggaagtcacgagacaacaatagcttcatacggaatactccattctcatatggagttccagctgcaccaagtcaagattcagattttcagaatatggtgtaagaagtacaacaggaaaaataatacgggttctattatgcactgcaagcagcagaacaatgtgctagaatggtgcaaagcaagcacaagagcatatattgatatatcattaccaggtccctcaatatcagcaaaaatggtggtgaagtcatcgtcattaacaataactttaatcccttctggaggtgactcatcaagactcttcagttccttagccaattgcctaacgacatttggtgggaggttctcgttggttgccttggtaatgcagacatacaattagaagttagaatcatgaaagagagaatagctactttgaagtggtgttctcttgaaaatgaatgaggtcccaaaattattaaatacttctgatggcttaccatggaagcaataacagcagataggtaattgtttggcaacttcacttggaatttgatttctacagtgtgatcaatcgccaaaacaagcctacaagaaaataaatagataatagttagggatgtgtgattggattgatatagaatgtttgaacaaaaaaattagcagaaaaaaaaacagtacagcactcaaaatatttcaattgatatctacggagcagcaaaatgaagactgtatcaggtaaccaaaaattaaaacgtggcttgcaaaactagaaactattgttgcagtaatatgcaattgtgcatgcaccaagcaaatattatatccaatacactacaaatgaacaactactatatgtgctaggggtcacttaatggttctagattatactgctatgaatgatacatacaatgaatattttaaaaaacagtaagtggtttcgtgcagtcatcccacgttttagtattttgtgcagcataatcggtcgcttatccggtataattggccacttgtgtggctttagcggtacaaggctggggcacctgttttttagaaataaaaactcacgatgaatgcaaaagtgactggatagcaacacattgcatatgccatgcaggagagatcgatgttatcatacattgcatttgtcgtgttatcgcacaataatcttaacctaaaagccatttctgtgtactgatataccaactcgacgatttaacatcacttcctactgatataccaactctttccctctccacaagtcccctcacgcatgcaagtgcatgtgcacactcacaccaagtaaatttaagtgctaaattagtaatttaatcccactaggaagcaatgttctacttagtaacacttgcaaacatggagtacttcaacatagtatctgcaacatcgagaagctaataacactggaacaatgcactaagaccacaaaccagaattggcggtttgcgtaaataggctacgtacattatcacatgctactgcaatattgcaaatatggtaatgagccatctccgagcgcttatttattactaacttgaccaatcaagcgtataaatagtaactactactaaagtgccaattaacttttatagcctcgctccctccactttacagagagttttcgcgcgcgcaatcgcgcactcccgccacaccatgcaaatacaattcctgcatatttattcagggcaagtatattcaggggccagtgccctgcacccatgcatcatgtgtgaacagaaaatttaacaggaacaacacggagtgcttctcgctctagtgaacagaaacctaatcaacaatagtcctcttagaattcacaaacatgtcctgtcccccctgctcagagatgagattgggcgcaatgtacttccggattaatagatcgaccgatcgatcacactcgcctccactatcaacataaaacgagtcttaacaagatctcatctccatcaacaggacgaaacagacgccttacctgcgctaaaagggcaaagggaagcgtaccacgcggagtcccgccgctaaaatgccgcctccgggtgacccgcccacgagatcgacgcagcagcacgcaaccagccaacggtacgacgatcgggggggaacggcggcgccgggcgattcccttgcagcagcggcggaggcggcggccgggcaattggggcgggcgacgggcaggatgaggaagctccgcgccggagagaggatccccggaggtgggcggccgccggcgagaggccgcgaggggggagggggaggaaaccctaggggcgtggaggaggcgctcttcgatttggggggagaagggggggaggaggaggaggaagaggggtaattaggatttgagggcgactcgagaacctacggaaataaaaacgagatccgcgcggtgcgcggtggtgcgccgagcgcgagatccgaccgttgacgtcggggtgggccccacgtgcacggcgcgtgttggggggtgggtcccgctttgccgtctcgccgacgcgctcggttagttagccgttggggggtgggggagagggggctttggttgggccttgggccgggccgttttcacgagttcgaaatcgtcccggcgagcgtcgccggggagcggttggaatgagagaaaccaacggtataattagtagagggctcgaggctactgcttcattcgtgctagaatattataacctataactaatggaataacatagtaatccaaatctgaatatatttatcagttagtctctttaattataggttctgtttaaattatagtactaaattaagttatattcgattttaggttgtaatattcacatatggagggagtatgtgctaaactgcttatccatgtgtcgttggagtttggagtacggatgcagtataaccaatgttccgtaaagttcacgagaaactactatgggcatggtatatctcctgtgattcttgtattggcaagacaagactcgtctttttacccaagaagggtccatagccccttttagacagtggcgtagctaaaatttagagtaaaggtggtccattatacaatttttattatattatctagcatatatactatagttttaatctcgatcaaatttttaggtggtccatagatcatagtgccacctagctagctacgccactgattttaggccttctattgctgggcctaatgggacaacgccatattagctcaggttttatcaccagacgctatgtataaggtgtgcacctgggcaggcatcaacacgtgtagccaaccgccgcaaactaatcaaacaatagaattaaccacagctgacgatgagcagtggcattatcaggcagttcatcaccggggcactccattttctgcactgtgtgattattagtacacacatgttcctaagatcctagtcacaattgagtgtgtttctgatttgattccatcggggagaaatgacgtaaagccaaggacgaaggacatcgctgctgttgaagcatagcttcgcctgcttggcatcacagtgacaagaatcacaatcatgctgtacgaatttaggcctgctggatactgacatgtggcgtaatagtggccaaaccattgggggccaaatgtcatgtcgacatacgagatcataactgtaccaacacacagcacaggcttagactatctccaacaggctaggcatagcgacacccaaacccaaaatatgtgctccaggctactgtagcggaaaaaaacagggtccaacagagtacccatactaaggacctattttgggttccagccgaggcggaacccaaaaatgagcgccctctctcctcgaccgaaacacctggcgcaactgtttcgcgggaggtggagagaagaggaaagcgcacctggccccggcaatagggaaagctccgccgccggcgagatctgctctgagctaggcttcgcaggtatggatctctctccaaccccaccctccttcatccctggtcccatctctcctctctctggacgtggatttggccgcggccgctcgcaccctagccaagggcgcatcacgctgcatgctgtgcctagccccgacgacgccgctcaaatttttgttgaccgcaccctccccagcatgtttgtgccatgtttaattgaatctctgttgtaataggatgatggataaaagtattggtggctcaagtgctcgcgctagcgaatctgaagaaatatttgggacagatcagtgggcttttgggttttctgccgctttgcattcttttgatgttcctccgaacccccaggtttattgcagccatgcatatgatgattttctttatttacatatctatacatcgatgattaacagttcttttcatcactagttcaacatgcatggctcgtcccaaatgtcatgcccacctataaatgagcaacctagccaggggctctccattgacaacaacattggctctgaggaccctccatcattgaaatcacagagggctgcaaagaagaagaaggtgtccaggagaggaattgcattcaccaaagaggaggacatggtggtgtgttcagcatttctgaatattagcaaagaccctattacaggtaatcatttgcaacatcttttatgaattctttgatgcccaaataacatggtggcataacatgcaggtgtgaatcaaacttcaagtggttattacaagaggatgcgtgattatttcaatgagcacaaacctgaagggtccaaccgtagccagattgctattcagcacaggtgggcattgattcagaaagcgataaacaagttctgtgggcacaaagcagctgttgataggctaaatgagagcggaaaaaatgagcaggatcgggtatactttcactcatattatcctccatctatctaatttacatatggttactttctaaccggtttaatctattttttttatagaaggtttaatctatattcatatttgcagatagatgatgctgtacaaatgtacgagaagacataaccttttaccttcatgcattgttggaaactacttcgcaacgaggccaaatggaacaataagtttcttgagctaaacaactctacatcacctgatcgaatggaacctccttcaactcaaggccatactgtagccggccatgcagaatctgggaatgagaatatagacacaacacggcctgagggtagggatagtgcgaagaggcgtagattgaagagctatgcagagacatcatcatctagtacaacagttgaagtcctccagcggttgcaggagaaatcagagaagaccgaactgaagcaagaccagcagatggttgaaatccttagtaggaaggacgaaaaaattaaaattcagagggatcttttcaaccttcagaagaagcatatgaagatgagtgtgaagcagcacaagaaggaaaatgagattagggagaagcagactgaggctcaactgatgtcagctgagtctagtattatgtccattgacattgagaaggtccccccttatctgaagaactattatctaggcatgcaacgacaaatcatggagcgcagaggattcagtagtcccttgaacaacggagactaaggagcgtgtgtgttgaatatatgtccaacttggttcgcttgagttgaacttttctattgtgtgcaactttgtactattatctattggagtgatgtgtgtctgttcatgtagtgactattgttcatttcagcaacaaaatgtcatatatttcttatcaacaacaaaatgtcatatatttcttaccaacaggcaacaaaatatctttcagccactatagttcatgtgagcagccaacaaaatacaaaggtcttatgagtaggcagcaaaaaaactaagcctacaactaaagactagttcctgtgatttggagcaaagggaccagagcattggccatatggcatctacatgtgttccatcatgtcattttgaagcaatgctgttgtctctctgtcctgaatgatgttttgagcatcaacaagtttctcaattgccgggatttccctatcctggttaataggtgggtcggacactccaggccattatgatggatggacagtaggtagctgaaccccacgctcatcttcaactaccatgttgtgaagtatgacacaagcacgcatgatggaattaagtacttttggactccataaacgagctggcctatgcaagattttccacttagcctgcaggacaccgaaagctctctccacatcctttctacacgactcctgttgctctgaaaataccttttgtttgttgctaactggcaaagcaatgcttttcactagtgtagcccaatcaggatagatgccatctgctaggtagtatccaagggaatagatattgtcattgacatggaactcaacagagggtgccctcccgttaggcacatcatcaaaaacattggaacgatgcaaaacgttaatgtcattgtgagaccctggtaaaccaaagtaagcatgccaaatcctaagatcctcggtcgccactgcctcaagtattagagttggcttgcctttgtgccctctgtacatgccttgccaaccagtcaggcagctagaccattcccagtgcatgcaatcaatgctacctatcattcccggaaaacctctggccaaattgatgcttaatatgtgctctatctcctcactcctgggaggacgaagaaattctttgccaaacaccttgatcacagtcataataaattccttcagggtctttagggcag

SEQ ID NO: 75121 - DNA, 7996 bp, Oryza sativa
actcattagccggtcctccatatgctagcatctttagagccaccgtgcacttgtgaagagcagagaatcctaattgcccagcagcatttctcctctgtgtgaagaacctgttcttggctgtgacctcatccactattcgaaggaacaattcccgtctcatgcgaaacctacaacccaaaattacagttgtttatcaaattaattcaatatatctacaagaatagtgagcaatatacaattgatcatgaaaatgttggcatttccttcaacacaaatatgtcatgaaaatggaaactgggccaaagattctacctcctcctgaaatgttcttcattgtaaagtggacgttcaacgaagtagtcctcattcaattgccagtctgctgcaattcgatcacgcttataagtcttgtggccagggactgaacctccccaagggcgttttcgtggcgtctgggtgaggatgaccactgcggccatgatctcatcgtcctcagagtatgttgcggctgtcccaaacattgacattttgacgtaactccaagccatggccaccacaacggaagtgcaggtctaaagccaagccgatttagggacaaattagccacaaattaaaagggaatgtgacatcgaacaagcaaatgctagaaatcagattacttgtgttctgattgactctgctgcgccaacgttcggccttgtccgaacggttgctcgccggcggctacctcgctgctactgagactcccttctcacatgcagccagggcggcaaaacaatcccgccatcgagccaaccccgtagtcccgcgccccgcgcccggtatatctcgcacgacaccctccgtttcccgcgtaaaaatttcattgcgggcccgcgaaggaaactgtccgcattgcatggtttccttttgcgttcgctgttggagaaggcaagaaataggtgcgtgacccttttgccgcaagcgacgcataccgtccaatgggtctcctgttaagggtattattgttggagatagtcttatgagtttcgaatgcgtgcatggtcccttctgctggcagctgccgcctgccggtgtgtcccgtgaccaatcgagaaatcatcttcctcaccgaaagagaaataaaagtaaacagtcattttttttctaagagttggttaagaaaatctccagagtcctacaagtggtctcaagaacagggtgcgcgccatataatatgatgctatgtaaagattttaacatagatgcctatcttttggggtagttgtgttccagtctccttaggctgcgtttgtttgtatgggttcctaactcacattaatccatttttcaagttagttttagctaatacttaattaattatatgctaatgagctgcttcgttttccgaactggaaggaaaggctttattaaattttatattattaaaataacaagatttttgtattgtataccttgtggtaagaaatggcactacatatctatcattaacttcacacaggtccacttatcagtgtctctcctccctcctaacccctttctctcctccacgcacttagattccattacctcatcgctccctaccataatccccccccaaatcaccaaatgccatggctctctctttcttgttgcccaatgctgaacaccaagagttgcctctcctcctagtcatcgaacgctatgctaccttcacctcctccttgtcgccgaatgggatggaaaagaggaactcagggagctctacgtagcaaacacaaaattgttgtggatccataggcttcgtgcggctcagatcttgcagttgttcgtattttggcgatgacggaaagcttgaaggtgtagatggagcggtaacgatgagcttaacgtctcatggtgagttagagatgagcttgctcgtaactcatcggaatactatctttctcctttggttttgtaaggtgccacccccattatttctttccttttgaaccactcctctagatcattctttttttttcatggggcactcttgtcctctgcagggcacgaggagtctgacaaggttatttgatgggctgacatggagttaggacaatcttctttctagggcatcaccaatatttagggccaatttggattgctaccaaaaacatgccctatcaatattttggtaatttgaatagtacttgtgtttgatttggattgaagcccattcattggtaatacctaatctagatttggcattatctagaacattctttactacaatttcacattttgactctatgttggtagcaaaccaaatatgatcaaaaacaatcttaccttaccaaatatttggtaatattaaaacttgcctagattttggtactaccaaaaaattggcagggtaacaatccaaatagacccttactacctaatttatgggtattagttattgttgtagctataatggtgaaagaagaaaaatgaatagtaaactggaccccacaaccactggccatgatagagagataagacaaatgatttatttattccttatgactaggtagtcagcatatcacctgatatttgttacgtactactcccataatatatacaacttggtagtactagtattttattccttacaacccactttacatgcatattgtggatgcccgatatgaagagttgagccactcgctacctcatcacactaaatggcctaattaagagaatcctacgaacaacctcatatttttcttatgctcataagctaaaatttaaattttcaatcttcaatttagattaatgttgaggtttttcttatcctagtttattttttagtctttatttttagattgctaagaatacatatacaaaatttttattaataaattatttttcgtttgcaaataaggccgattttagtttcaaacttccaacttttccatcacatcaaaactttcctacacacaaacttccaacttttccatcatatttttccaatttcaaccaaacttctaattttaacatgaactaaacacaccctaagccaaacgatggagccataaatttctacgttctcggcacgtctcacggtctcacgccgtttgcacgaaacaaacgtgacactgatacacacgcgtacagcaacaaaccgaatacgtacgaaaactccaccttcccaagtcacgcacggagcaaagagacgaaagttaccgaaacagaacacggggacgacgagacgcaccttaagggtgtgtttggttgcctgcatggaacctggctcgcacacgtggatgcagtgggtcgctgtttggttgcctgcaccttactcccagccaggttgagcggatgcaaaaaagcccccacagccaggctgagcaggaacgctcgatttgagcttcgctgctcggccaggcccgcgcgatgcaacgcgctgcacccgcgtgtgcaagggcaggtgatggggtcaccaccccgccccttgccccctcctcattttctcccaacgaacgatagggcgacgacaagctctacggagggaatggcacccgacgaatctgacttactgctgcatccccctcctcttcccaccatccccccctcaatttctggccaccgctgtgcccagacatcctcgctaatggcgtgagcactgccagatccagctagtgatgaggaggcaaaaagcttgacggcgacgagctcagcggagggcgcggcgacgaggacagcggatccaccgtgctgtcgcgtccctcctcctcttcccactgtgcccccatcttcaatcgccggccaccgtcgtctccctctgtcagccagatctgatggagcggaggagcggcgagcagcgagcagcggacggagaggagcatgagaagatgggcggaggagcagtggacgaagagaagcgccggaagacgggcggaggagcggcgaacggcgggcagatgggcgcacatgcggctgtgggcagagaggagttgatggtgacgaaggcagcaccgatccccttcctctatttctttcgtttcttttttttttgcccctcgttttgcgttttctctttctttctttcgtttttcactagcaacagagaagtctgtatgtagaattactagtagtagattagtttcaccggttcatccaccttaagaatttttttaattatttttttatatattgtagaggtaacctcacctaactatatgtatacgaagagataaccacactcacatcatgcaaccaaccaaacaaaattccttctaaacagtatccctcatacaggcaaccaaaacaaaatctcatgttagcctggctagaccaatacaactaaccaaacagctacatatgtattcttctggccaggtcaaactcagcctagatgagagagatagccaggctagggtgatacgggtaaccaaacacaaccctaaatttctcgcgtcacccccccctgctgaaacgcaacacatcccgccaaagacgacgacgacgaaataccagagacgccatcgccacggagacgtgaacaccgagcgagcgctctctctctctctctctcgccaaaaaacgtacgttttctggcgcattgtcagcgtgtgccttggccaaatttacccacgcaagctagcggcatctgacgcgcgcgccgccgatgaaacgggcctgccgctttggcatcgtgcggtgccacggttaaccgcaccaccaccaccaccaagcaccaacaacaacaacaaaaaaacgcattgattgcgcggcgacgcgagccacagccacagcccccaccgggtttaataccatcgcgttggctggcctggcatccatcggcagtggcagtgcagtgcaaaacgagaattaatctaggctagctactaccacctgagtttgctgttgctgttgctgttgttgcatgcggctgtgacggcggcggcggagatgatgtgcgggaaggaggagaagctgctcggggtgcagaaggcgccggggagttgcccgtactgcggcggaggggtggcggcgacggacgtggaggccaagtgggtgctctgcttcctcccgctctgcctcaacaacaagcggaggttctcctgcaccgcctgcaaccgccgcctcgtctcctaccccgcaattgtccatgactagtagtagtagcgacctctctttctcttctcttcctttttcttttcttttgttttattttcttttcccctgattcggagatttgtcgtcgtctatcttctccgggaaggtgatttgataaattctgttctagatctggaactagctgcttctttcccagcgagaagaaaaatagagcatatgtagtatttgatgagttggttcttgttgcgtttattttttggttcgtccatggatggtgaacaaggggtgttattgccgatgctgcgtgtacgacgatgtgttggttccgtgatgctaggtacctaaaagaaagaaaaagactgcgcgaagttgagttctgcttctatgtgatactccctccgtcccaatatattgcaacctaggatggaccaatatattgggactgagggagtaatctgtttaactgatacgggtgttgtttgtactactctattctaaaaagaaattcaatattagcaacttgcgtattcaggtttattgttaggattagatcattttaatagtgggggtagataattattcttttattaatagacgatacatctattgatagtgtggtgtttatagtgacttcatcaagattatatttttcatgtttttgaaggtgtttatataggtgagatgtgcgaatgtatttataaggacaattgtgtatgtattgagtgtctacgattatactgtttttaaagttatgccgttcttgtgtttataagtataggatgtacgtgtacgttttattagagtgagtgtatgcatgtcaaacgtcatgtttatattactctttctgtctcaaaatataacaattttgggtggatgaaaaataacatagtactatgaatctaggcataacctatttataatattagaatatatctcatatagctagaagttcttactccatattttaggacggtgttatatcttaggatggtgagagtactgtttttcttttgaaaaacaaaagggggaaattgtcacaaggcgataaggccttggtgctatcagtcgcggcggcgcatcgcgatcatgcgggtagttcggtcggtttgctggtcgagaaagacgtgtatctcccctccctcttcgtccgtccgtcgcgatcgtcgttggatttgccgatgatgactcgcgtgtgcaccaggcagcacaggtagacccatgaaatcgagctagtgtgtggcattggtttcccattcaatctttacacggggctaaaactttttaagcccgtatcatatcggatgtttagacgctaatttagagtattgaacatatactaataaaaaaactaattttataaatgagagctaatccgcgagacgattttttaagcctaattaatccataattatcaaaagtttactgtagcatcacattgttaaaatcatggcgtaattagacttaaaagattcgtctcgtgaattagtccaaacttataaaataggtttataattagtgtatgtttaatacttcaaattagtatccaaacatccgatgtgacaggtacttgaaacaagttcgtgaaaaccaaacagcccctagtactacaaactaggagtagctattgggtatttgcctccgtgcctcacggtatctggtgactgtgagagcgatgagatggacaatgtttctgtgtcatcagacatgaggtgacagagttggtcggtgcgctgtccacaacaagctcaactgagattcgtacttaggtttagtttagtttccttcaaactttcaaaaatttcgtcacatcaaatatttggacacatatatagagcattaaatgttgacgaaaaaaattaattacacagtttgcatgtaaattgtgagatgaatcttttgaggctaattacgctatgatttgacaacgtggtgatacaataaatatttgctaataatagatatattaggcttaataaattcgtttcacagtttacatgcggaatttgtaatatggtttgttattagtctacgtttaatacttgaaatttgtgtctgtatatgtcaaaaaaaaattggaggagggcctaaacacggccttactccctccgccacatcctagtacaagtgtgtttagatcgaggggtgtaaagttttaatatgtaatatcggaaattatatagggtgtcgtatggggtgctcgggtactaataaaaaaactaattacagaatccgtcagtaaaccacgagacgaatttattaagcctaattaatccgtcattagtaaatgtttactgtagcaccatattgtcaaatcatggagcaattaggcttaaaagattcgtctcacaaattagtcgcaatctgtgcatttagttattttttagcctatatttaataattcatacaggtgttcaaacgttcgatgtgacatggtgtaaaatttttgtgtgggaactaaacagagcctttgtaataggatatgtcacatccacccaaaatcccttacattataggatggagggagtactttatccgtcctatattattgttattcttagtatatagtactagcatagattaaagtttgagaaaaataatactataatattgcttgttaaatgacatatggttgaatatgagaagatggctacgggtagaaagaaaaaaaataaattataagtgattaatagtttaagtagtactttattgtaataattattttgaggtaaagtttaaattcaaaagaaataaaggacggatgtactaagttcaatcgattgctaaatactcactccattttaaattgatctacatatagtttttttcttaaatgatctacatatttgtgttcattcattaagtactaatcgttatttgttcattggagtaaatggacattgatgcatgcatc

SEQ ID NO: 75122 - DNA, 2492 bp, Oryza sativa
ccggcatcatgccggggttcggggcgggatacgacggcgggaaggcggacttacaggaggcgaactagttggtgacctgctcgtcgaggccctgggcgcggccgccggcgccgccgtgctgcgccatggggctagccatctggctggccatcttgctgcccggagaacatggcgtagaagtcggcctggttgaagctggacgcccgcggcgtgggctcgcgcgacgtctgcagcgagtagatctccacgccggtgaggttggaggcgcgcggcgtcatggcgttggacgcgccgtacgcccgggacacgccggagcgcgccgcgccgccgccgccgcccgtggtggaggccgaggcggagcggcggatgacgacgtggacgcggccgtcgcgccccacctcggcgtccgcctgcagcgcctccctcccgttgagcgagacgacgtcggagtcgacgcggaacgaggcgatgctggcgccgacgtccggcgggaactgctcggagatgagcgccttggcgccgcggtactcgaagaggaagagcatgagggtgtaccagatgacgctctggagcacgacgatctgcaccatgagcgagccggagaagtcgccgtacatggcgcggagcagcgggatgcccatgaccagcgtgttgggcagcgtggacagcgagaagagggtgatggtccagtcgagcgacgcggcggcgccgccattgcggcggtagcgggagagcaggttgtgccagacggcgagcgcggcgaggatgacgagcttctggagcgagtcggcggcgaggaagcggtagttcatggagtaggggtcgttggtggagatgaagtggaaggagaggagcggcacggcgaagacggcgacgaagcggttgatgccggagcactggtccggcgtgaatatcccccaccaccgcaccgacccgtacgccaggaacatcgccacgtacagcggcacgatcgccgccagcacgtcgtagatgtcgcgtccggtgatcatcgcgccggcgacggtggcggcggcggcgagctttttctttctttttttttcttgacacaagagaacgagctaattaagtgtggcaagagaggcacaaggatggttatatagctggagaagatgccatgacgacggtggcgatgacgcagttagttaatgggagtgttagattgacaattagttgtagttaatcaccactagcagtgttaattaagtggtaaatactggacctttggtaataaaaatggtaaacactgaactggttcaaattgaaagacaacggccataaccctaaaaaggaaggagattcatgttttttttcctcaggttaaacttctggtgtatgaacatctatacttttcttcttttaaaaaaaattaggaaaattggaactatgccattataattttgtaaaatttgagatatgtcatcctgatccacatatcattgactcgggtgggtcctacatgtcattgagataccgatggcatatctcaaactttgcaaaattataatggcatggttccaatttaccctttaaaattacagtaaaaatatagacgttcataacacgcgcacactcaccccttatatatacacgcacaccctattccataaacacatttagaaaattgtaaatgcaagcgttcgtatcaagtctaggatttgaaactacatgaaataaaaaaaaaggttaagttacactcatttggcactattcataaattttaataaaatatttagtttgaaaacatagaaaatgatatgcatagatttatcttaaaaatattttcataatcataagcttaataaaacttttcagccaaatgccaaagactgaaacgaaatcaaacgacatgcacttatgaccggagaggttagcagtgtagtagagctgaagctataggtattaattcgagttgggctccattcatataggtgagttgggctccattcatataggtgaagctatgttaattgattcgatttccatagtaacctcaagcctctacctgcctaactaagggggcatgacattgacttaaccagttaacctatatatgtagctaaccaagttgctcagtacgtaattaaggccacgccttttggtaccaaagttcagaggggaaaagtcgaagggcgaaaaactatcggccccatcgtttcggcatatttgcaaacgaaaagtgatctgtgaataaaacttttatatacgtgttcttagcgatctaaaagcatagagtgaaaaataaacttcgatgaaaaaaactcaaaatcagcttcaaatttaaggttaaaaatttaaattttaagtgataaacataaatataagcgaaaagatgaggtcttataattttttaaccgagtcaattactgtttaggacgattgacgaataagcaataaagttttgccttttcagtatacttttgaggaaaaaaaggcaatcataagagttttatgtgttatctcattctctattt

SEQ ID NO: 75123 - DNA, 685 bp, Oryza sativa
aattaatcatcatgcttatctttcaaatttatagaaatgttcataaaaaaagggtgacagttattcatagtgaatgacaataaatgcgtttatctaataattccataataacaatgaaggttattttgtttgcaatcaggaaaggagagaatgtttacatggccatggggatcgatactccatacacgtgcagtatgatcaatagagcctgaagcaagcttcatgcctaggcagttccatgctacagagtgcacctaacagtaaaacaaaagatcagaattatacaaaatttaaggctgattatgtatgtaagatagataaaaaagaaggcaaaaagcgacagaaccagttaaatgctgcacctccatgtgtggaaggattatttagaaaaacaagaaacagaattcaagaaagaaacagagaaatatcgttgtactatgattctttctgcaagtaagatttttttttccctttgaattcttcccctcagaggagtagcaactttacaaagtcagacaagaagtcccttttcgtgaaaccaaattccttcaaaaattaggagtaattatgaccaggaatcatatttgacaatgcgctcattcaccagctcccagaaggaaagcaaccaaccaaagcttcattcaatctcaacatggcttagccctagagcaaaagaatcagcata

SEQ ID NO: 75124 - DNA, 4195 bp, Oryza sativa
  unsure (1)..(4195): unsure at all n locations
gcgaggcgtcgcgctcccactcctcgtagcgaaacagcagcgatctcaccttgtgtacgcgcgcgtatgtttcacagctttttcggtgcatctgatcagccctacgattcgaaagggacggaggagatcttccgggtatgtgaacgtgtgagataatactgttcagtgcgtgtaaattaattttcttagatttattaaaggaagggaagggttgtggtgaagtttttttttttaccttttgcatacgtacattttcacaggtgatatacgaagattgttggtagaaagagagaatccattagagtttgtaacaggtatacaatttacttttgcatatgccattgacttttttcttaccttctacgatttttaccatcgccgtccggttagtctatgtgtactgtacaattttatctaaatgaccaaaatacccctgggacaaaaacttctaaagtttgataaaaaaattctgaattatcatattttaagtttttgacaaaaattggatgtttacaatcttatgtttataatattgatatttcgaaatttttgtccaaattttggatgtttttgttccaggagtattttgatcatttggataaaaaatgtataatactagggaaggttaaccagacggcgatggtaaattgtagaagttaagtaaaaaaaaagtgacatattgtaaaacgtgacaaaatcagtggtaaattgaagacatgtaacaaactcagtgacatataatggattttctctagaaatattgtgaaagtatagtggtgatatgagtgagcagatgaaaggccaagggcctttgcactcgatgaatttgcatatcatgattgcattgatgacgcagtagttacgacagggactcaaacaaaggcatgcagaaactgctgactttcgtatgcatttaacacatcactccttacaccactgatctttgctcgggcgtcaaaatcagcaaatatccatgcaaaaaaggcaatattgcaaagaaaataaaacggtactccgtacttcattagtttggaactcggctagccactgccacttggctataattacggtgacaatactttctagacaggggttggtaagctgctgctatgtactgatcatagccttgcaagtactaaaatccaacggtggcaaacaatcttgatgacgtgatgcaccatataggatgaaatggaattaactacatttagtatggaccaactgtatagatttataagattagcaccggccccatcttgtcattgacgctaacctatatccccaatcgcagagctgtaacaggccagcacctaagcccctccattgccaccatggtgccagaaacatcgagctgttgatggccctacttccaagtctacaatgtgtgccacacggtccgcccctatgtgccttgccatcacttccaaccattggctctaacaacacagccctctggctttcactagcatcttcatccctaattcgttcatgccttcgtccacatcctccacgaacgaaacataaggaggtgattaatattcattatttgcaagttaaaaaaagaagaagacaagagatgggacttcatagctgctttttgagaggtctgcatacgctacgcaagcgaaacaaccgggactatccaaatcacatatatttatagcaattgtataaaagtccctcggcgaaaaagtcagccaacgatctccatgctgcaccgtcagtccatgcctagttttcttgcccccctaccaccataaatacgcacctagctgtaagatggatcacaaaacacatcgatccatccctctaccagtacataaacaagaaagataacaccaaaaaattagctagctcgccaatggccttgttgtcctccttccggctcgccgtggcagtggcggcattgttggtcgtcggctcatgcgccactgaggtcaccttcaaggttggtgagggctctagcggaaaaagtctagagctcgtcaccaacatcgccatctctgaggtggagatcaaggagaagggcggcaaggactgggtggcgctcaaggagtcgtcgactaacacctggtcgctcaagagtgaggcgaccctcaagggccccttctccgtccgcttccttgtcaagaacggtggctaccgtgtcgtcgacgacgtcatccccgaaagctttacggccggcactgaatacaagagtggcatcaacatctaattcatagacatgcgtactcttgcattgggttgcatgggaatcattaacatctatataattttgtctaaaaagagatcgcgtcgcatgtgagcgagcaaacaattaatttcctatggttatttttttggtaataggccaatggcaaataaggcataattgcgtggataccaaaaatattgttgtgtagctgtatgtgagcacgattttacatatatgttgtttatagaagatgtatcgaaaacaatatatttggtcagctttcattaagatgattgtgtggatttgatttcccaaagtttgagtacatatgtatgtccaaatcaacgtagtccatttctcctttttagcttgtcaaaaatgttgtctgcacttgttttttcattttgtggaaacaaattgttgaatcaatcatactgtgaccagactataagcataaagcatttttacatcatttagcttatttagaggtcagaaaactggaagtcacgttatcccatctctagcatgaatatcatatagaagcacacatgtattgaagcgaagccaactttgagaggagctaagcttcatatcatatagttggccaagaccccaagctatagtcaacaacaaagtttatatagtactacgagaatatcaatctattgcaaaggatctaaagtaaatacacaattggttccaaactttaaatagaagaaaaatctttacactgctagtgtgttagaaggaacaagaaaacataccattagttccaaactatatatatgtaaagaactaataaatccttaagacctaaaaaatgtagtggtggtttatggtcccttgtccaccgtaagcccatcctcactcccacgccctctcgagcgagtcccgcacgcatgatgtcccttctgctgcacgaatggaagaacaccctcgacccccaccacctgatcaaaatcaatcaaccatcattcctcggcgcttgcccatggacctcctttcacgtctagctctcaacttgcatggacgtaacagcatgtgcacttgccaataaaaaaaaaggaaaaagtacgaattacccccccccccccccgaactatcgaggtcgaacgaattacacccccgaactcgaaaactagacattctacacccttaactattgaaaccggacaaataacccccctactcattccggggtggttttgggtccacatggcagtccagtcagcatttttttaaaaaaaaaatcagtgggccccacctgtcagttctccacccctctctatctctctatactctatcccaatctctccctctctctctctcatctcaccagcacggcggcggccgtgcgagggcgggagcaggcggtgctgccggcggcggagagcatcgggaagcgtcgaggcgggagttgagcatgcagttgacggcgtcggccatcgggatgcctaagtggagctcacacatcaccggaatattctgcgtgaaccccgcgacttgcacacagagacaaccaacaaggcaacgatttcttctgaaaatgcgaatcactcagctgctaatttggaaccaaattagaagattcaacaagtaaattctaagcgatttggtttttttaagcatgaaaaattgaagaagggggagattcgggagaaaaatccaattattgtagcgattggtggcgccaccgcgaaggtcaatcttaccacgtggtggcggtggacatcgagagcggcgagggaggcggcgaggcggaggcagcggtcccgcttctcctactaggtgcgcgtgagtccagaggaggaggcgacgatggcggggcggtcggggtagacgagggcggcccggtcgaggaaggtgatgggggtgagcggcncntggttggcggcgcaaagcacggcgccctccatcgccgccgtggtggccgtgggcgtgtccggcgaactcgggatggcgagatcaaagtcagagagacaagctgaggtgaggtgaaca

SEQ ID NO: 75125 - DNA, 6148 bp, Oryza sativa
cctcctcgttgacagatatttgtcacccacagtcgttttcaacacgagcacctgcatgggctgaccctgctggctgtccatcttgctgcaaacaaaaagctataatgtaatacatccaaaatctgtaacttaacgaatcaagaatcagctcgtgaagtgcaacgacgggatgcggatttcctatatccaacgggaatacaatcaataagctgctgacgctagtggccacaagtaaaattaagtaatatctagtctaaaaaaagtttattctgtcaaaacattcagataaaaaatcaacgggaccatatgtaatgagcagttcaggaaaaaaaaaacaatccatctgctttcttgaaccacaaaattcaagagaatcgccatcaagctccttgagttttcatgtattgaaaatttcagaaggaacaaaacaaaggagctcaagaaaaacatggctcagttgcaagcaaatgaacctctcaactagcggacccatcgtgctgcccgcagccccctgcccatgtgggatcgatatgccatcgacgaggctgacccatcgcaacagaactaaagcttgtatacccttcatcccaaaataagctcatttataggtttctgtatccaatcgagcttaaaaaagtagctcagttgcaaccccaacaaagcaaagcttcacatacacacatacgatgcgttaattacgtttctaaaattactcccgcatgacacaaccgtgattagatttgagaaagatagtgatgtgtgtatgtgttatattatttgttcaaatctgctcgtttaaactccaaaatatgcagatctgccattaaaaccacattaggagtaatataattggtattgcaaagcttttttgggggggagggagggggtggttggatgtctggttttattaatttttcctgtttgcgttaagtatgaggattgcatgccctttacattttgagaggtctacacactccatgacatgtgctaattttgcctgacagaaagacaagcgggactacctatcttagatctatttatagcaattttacaagtgtttgtcgaagaacaagccggccaacgatctccatttgcaccatacatccatagcttagctttcttgcctcgccacccataaatacatgcccacatatgcaacatcaatcaccaaaatcatcgatccaatggcctccttgtcatccttcctgctcgccacggcaatggccgcattgttggtcatcggctcgtacgccactgagctcaccttcaaagtcggtccaggctctagcaccactagcctgaacctcatcaccaatgtcgccatctctgaggtggaggtaaaggagaagggcaccggtgactggacggggctcaaggagtcatcggctaacacctggacgctcaaaaccggggcaaaactcaagggccccttctccgtccgcttccttgtcaagaatggcggctaccgcgtcgtcgacgatgtcatccctgaagccttcaaggtcggctccgtctataagagtggcatccagctcaagtaacgtacacttgtgctcttgcattggatcgcatggaaattgttgatctctaaataattcttttttaaaaaaagagagatcgagtctgcctgtgcgcaagccaataattattttttatggtccttcccgcatattgttgtgaagctatatatgtgcacatgattttgaatacgttgtttatgtaggacttatggtaaaaaggtatattatttggtcagccttcaccgagacggttgtttacatttgatttttccaatgttttaatacatatgtatatctagatcaatgatgttcatctatcatttttacatgtaaaaaaaatcctgtaaaattcgcatttacacttgtgattattattattatttgtgaaacacaaattgttcgacataccatattatgacctgaaactataagcaacattggtggttcttttagcttattcggaagttaaaacaaactatatatttgtggatgtcatgtgttctaatgttccaatggatgatggattatacatgaactaagtttattacaataattcaaggtcacaacaaaagaatagatattcattttcctttaaaaaatatattgtagtgagtgatgaacctatcaccacctactcccaccaccacctgatatatggggtccattgaatagtgaatcatgcagacagtcgttccttctcaaacctaaacatgttcaaattgtttgtagcaacgcacgagtatatttacctagttaacactagatttgaaagattgatttaaaaggctctctaaatattgatgaagaagacttccgtataaatcgtaccatttaagaaacaccatgggatattttggccatgtacaacactccaccgtgggtagtggccacagcactctagctaagcgatgggtaaattcccttaaacctactctattcatcatgcgctaatggcctaattcgttttacgtattttcacagccttctcctctcctcttcttttatactcccttagtttcatattataagttgctctaaactttttagtagtcaaacttctataaatgttatcaaatttataggaaaattgatcagcatctataacattaaattagttccaattaaactaacatttaatatttttttagtatgttcattttatattgacaatgttactatacttttatataaactgaaccaatttttttaaaaaaatgactagcaacaaacttaaaattaaattaaaattaaagtgacttaggatatgatgagacgaaagtaacagctctttttctctaacaacgaactggcgtacgtggaaggaacacggccacgatatcgtacagacaagagaagccgcttcgagaagacagccgctgtccatgccgacgcgactccacgcgcgccccgcgtctccctccgccgcagcagcctcgtcagctcgcgagatcaacgccggcccagtcagcccagccacatcaccgcccactccaccaccccaccccgcatggcccggatctaataaccaacggacgcggctcgcgggcccaccggcccacccacgcccgcccacgggatctctcgctgactcggacgacgacatcgccttcgccgctttcacagtgtgggccccgcatgtcggcgccacggggggccacgcccgcctgcgctggatccgagtcagcctcgcgtcgctgtcacactgacgcagccgcgtgttatcttaatcagccacaactttttaatgcctaacctttaaattaagccgcgacgagcactgcacggtggtcggaggaaggcgatgatgaagaagtgcccgtcggagctgcagctggaggcgttcatccgggaggaggccggcgccggcgaccgcaagcccggcgtgttatctcccggcgacggcgcgcgtaagtccggcctgttctctcccggcgacggcgagatgtccgtgttggatcagagtacactggacggaagcggcggcggccaccagctgtggtggccggagagcgtccgtacgccgccgcgcgccgccgccgccttctcggccacggccgacgagcggacgccggcgtccatctccggtaggtacacatgacataatttgagtttttttgagttacagagctattgtgcaaacagcccattttctatgcgtttatttggagttatgaaacacacccaaatttagtcaaattcatcacatgttgggttcattttggttgcagatgaccccaaaccaaccatcctcagcgtaaccatcgcgtcctgaacagcgacgtcggtactcctgattgcgaaattcgctgttagcaagcatgagagggagtccatcgtcctgcgtggcactgataatccacagtaaacataagcgatataagataggtaccatagctggatcgtatcaactgcttgattctctacgcaatatgctaactaaatttgtatacagatgaacgtcatctcttcatgatactgtcttcgttctgacatttcatggatgagtgtctcaactagggtagtcccgtctcgtacgtatcctggtatgtatataagctaggtcacagtttatcctgtaatcttcgaattcacaggttatttattaaatctctcataatgttcaatatttaccagtatgccgtctgatcgcaatatagtcatgtgttgattctgttcaggcatatcctatcttatgagtcaggttctgagctaatctcaaagggcgatatacttcatctcctcttttaagtcagtctctacagagtccagccagcagttcaatacagcggtcacggacaacaggatcctcaaatcggatgtagaggccttaagagtcaaggtaattaggaacccaaactgctccttcagccaccaattatcggcgcatttaacttttcgccacttttaagatgaggtaattaagaattaccacccatagtctatgacaacatatgggtctttatcactttatgtgtctatgacatgtgagtccaattgcaaattgtcactcgtaagagtggtaaatagttaattgtttctgatgatcggcttccggcatctctccaaacttaccaattcttggcttcgatcccaggtcaagatggctgaagacatggtcgcgagggccgcgatgtcgtgtggcctgggccagctcgggctggcgccattgctcagctccaggaagatgtgccaagctttggatatgctcagtttaccacggaacgatgcctgtggtttcaaaggcttgaacctgggtcgacaggttcagaactcaccggttcaaagcgctgcaagcctagagagcctggacaaccggatatccagcgaggtgaccagctgctcggctgatgtgtggccttaagacacttcatccgtgttcgagagagcttgagattctaagaagcagccggtgagaatctgaaaaggctagttgttcagtttcctatttttagtttatgtttgaattctctggctactaatgctcaaaatctgggagagaatctaaatcgtttgggacagataaaaaattatgcgagaaggtgtagctgacagaaaccttcccaaacaaatctccatcagaacctatatgtaaagtaatacggtatcctctgttactaggtgcatgtgcataactgacaagctgctaagtactaggtactacagtctgaggcaagtatttctggtgttttggtgctgaagaactatgttttagtgcgtttgatctgcggcaatcaaggccatctgatcgaaatttgattggtataaatctgatcgaaatttgattggtataagtataatagtttgattttgatcacctctagtcgtcagcgcctttggtgtatacgctctgtaacatctgttacgaattgatctgttcagtatacttcaacagtcctgcattggttcagttcttggcgtagctctggtgcttctggtgcgcatagcatcggtgtgaaatgtgccacttttcatggcagttgtaatagtaaacgactgcaaaattacggtgtactataattcctaaacaaatatgtgacaattacgatgaaaattatcactaagatgttattaccattatttttcgtacacaaatctcttaatttttacaaaatttgttactagcatgtgaactctctaatcccacactatccttattctttttcaagaaaagtacggttggtggtggggatggttgacatatggatcctctggcctcacatgtcctttccctgaaagttggtgatgggatggtgacagattaaccactcaccatcaccattgtttttttctttaaggaatatagattgaatacataagatttaagatttatggggaaaagtatagttcgccaatcttcaagatggttgtgtacaactgattttccaaagttttagtatgccccgaaccaatgaaattcgttcatctttttttagcatgtcggaaatgatgtgaaaactgcacttacacttgaggttttcttgtggatacaaattgctcaacaaaccatattaagacctgaaactataacatcaatcattagtacatcttttagcttattcagcagcctggactagctgcatagtatccacaaatcacatttgccccatccgcaaagcagaatgagcggc

SEQ ID NO: 75126 - DNA, 4726 bp, Oryza sativa
  unsure (1)..(4726): unsure at all n locations
tttcataaatgatgactacaggacaagcccaaacactttcagaatcttaggtgttctgtaaccaacacaagaaatgaatccaatttgatcccatgagaattgaccttatttagtatattttaaatacttggaaaaggtaactttgcaagaagtttaccacttccaaatgtttcagaaagtaattatcagaccgatattcagttccttaatcatattttagggacattagttgaatcctattctttgttctattatatcacacgagagtgataattcgaataggcagcaaaccttgcagtacaacttgaactttttgtagtaaaggctgtctgccagaatcagtagagcatgtcttcgtgtaattgcaaaccactattaaaacaacaaacattaacacaatataaaacatgtcagtttagaatcgacatgaaaaaataaaaaaccaaaaacaaaccatatactgctaaaagaatgaactgtaatgccaggtaatcaggtatgtaacacaacaaactacctgggcacccttcctgaagtctttctcctcaatttcagggagcatctcaggagaatacctcccgtttccatgagggccaggatcacggaaactgagaaaataacaatgaagaaaaatatgatcaaaatatacatgcaacaccatttccaagtgatactagaaagaatgaatcaacatcaacttattgatcacatgtcaacagaacttgtttcacctattactcttacttttacatttatgaaatttgaatatgaatttggtgttcttagcttcttaccaatcaatgaagctgatatttgttcccatcagataattatagacataatcaaatgtatgcagtggaacacagctgtgagaaacaggaagataacttcaatatagtgaaagaaaggctcaaaaatcgttatccataatcagagtcagaacctgtcagaaagcaacacatagaactggttatcaacatctgccagtgcattggccaatagtctcttctctgcatcaaccattgaaatggttccccatactacctgcagagcaaccacgcactttggcaaaccccagccaattttattatccatttgaaaaggcttctggaaaattccccaaattttccanaggtttttcaatttgcccagaataaaaaggggaaaaattaaccggttctttttggtatttccaccacaaaataaattggttcaagtggtcttaccattacttaatcttaccttattataataacccttaagctaaaaagaatgaaagaattcttattggcgtagataaagaaccttattggcatagaacctactacagcatgatctactactgatatagaacatcctgaaaaatgaatgctaaatttatgaaaattatctttatcaaatatatgctcgttatgtgctcgtcgctatagtgctatgtcctctggtgtgtaaaacaactatttgtccatcactactaccttgctagatagccaaacaaagaagtttctgatggaaccaagatctaccacttggtcattaacacatccatcagtcatttggaatgcagagagatagacataagctttgaaaatagacatattttgcaggtcaaatccttaataaagaacataatcaaaggaaaggcattaaatacagaatttctgaagatgaaagtaattaccgcgtcactgtgaatatcacgaccaacaaacaaagaactagtatgtacaggcttttcacgtgatgcatgaacatagatggagtatcttccctcctgaccctgtttggagaagtcaaaattattaagattttttaggtttaaatgaattataaaagcaacaggcattatcacaatatatatatacttccagaggttcaggagagaagaggggggagattttttttttttgaaactgggggtagattgtagtaacttgtaaagtacacttgttagttattgcggacttgcggtataatatactagttggtttgttaactagtataaggaaatatccactagtttgacttcttgtgcagtaatggaaatcatccttagcatttctctcaatgatatataatgacccttgtaagatgctagctaagacattacctacggattttattatgttagttcagtatctatcaaatttaaaatgctgttcataatacaatagtgaagcactgctacaagtctacaactttcataaagaacagcaacatattgattaagtgccatttttcagtaatatgtatctaaaaacaatactagagcattaaccactgaaacaacttgttgtctgtatttatgctgaaaagaaactgatgttgctttgcagttaaaggaaacgacatgaccattgaatgatttatactcttaaatagcacaaatgcaacaaatatatctttaccaacctgtaaaaacttttcccataatttctcaaagggcagtgtaccaggtgtcaggaacataagagcgatctttggatttttcgacactggcatgggcattgcaaggatatccctaagaactacagatgaaatgatctcctcatcagtccgctccctgcgggttacagatgggagccaatccttgaaagttgcgcatgcaccagaaccgaagaggtagcattgcgaataccgccgtggtgggaaaacatatgccccaatcaatacaaaacaaaccagtgacacaagaatgattatccatttgggcttcttggcgacagcccggtggcgcagagatggcatgacagtcatgtccttgctgtcctactgcaacactcaagacacttctatctcctctccatatgttcagatcatctagaagttaccaccatcaaagtaatcaaactctggtaattatgatgtgaagttactacaccagggcccaatgaaatttgagggaactaacaaggtgacaccttcctgcaattgcaagtaagcacaacattaatcaaggaatcaagaaagctcctagataagggacagaattcagccgcacaatcacaaacaacattccatttggccaatgattgtttttgcacaaatcttgatgcgtctagtacgcgattcagctatgaccagctgtgatgcgagctaccagctcccatactttggagatttctaaactgctcgatgaatctagcaaaagctggcggttgcaattggttggaaacaggtgatctacgcgttgaaatcaggtgatttccacaggggcaggcagcgttgctcaagtccatggtggcggctcgcggaaaaagtcaaactacgaccaaatcatcccgatccaattcgctaacccagaacgccatttccaactcgatccaatccacagcttcgccaccacaagcaccaaccacgcccacgctaaatcacacagcctaagccacaatccttaccaaaaagaggctcacgtaaaaaatcggaaccaccaaaaaaaatcaagctaaatcacgcacggagaagaattacccaagctatccgagcaaccagaagcccaatgcgagaggactcacacagcgccgcacctcaccgcagcgcaggaggcgcagctcttggagcttagctcgctagctcgcacgcacgaatggcgcgaaaacgggcaccgggctggagctcgcgagcggccgattccggcgaggaggtggccgcggcgagctcggcggcgacccgggaggtggatctggagctcgcgggagatcggattgggatggcggaggtggaggtgggagtcgtagagagagagagagagagagagaggaggaggaggagggagatataaacaaatggattaattaagctggaagtggcactaattggttgggttaagtgctgggagggagtcgcctcttgctgccgtgatgggcttcaaaactggaggagggatttggatttaagtaatcaatttttggcgtgtgctttttttttgcacctgggtcccttgaaagtttctacctttcgaggtagtcatgggctcttcttaggtttctagatttgggattatttaagtcttgatccgtttgaattggatgctgtttatgctttgtgttatgcttaggccctgtttaagataaattattgaacagattattatcacggattatcggtttgattatagggatacattaaatattttgaaaaataaacttagcaaatagaatagaagtaagttctttttagaaaaacgtgttttccgaagtgtagagcaaattaccggttttaataatccggtgaataatttaaaaagaacagggcctaaatctatttgtttagatttttttcgaaataatgtggtaaagttgcaataatctagaaaataatccaaaagagggatacctttgattgaatatacatctacctttggtatcagagtgcatatgcatgtgtggcacaaaagtaatgcagccacccacaaaaaagcacattagcaccaccactacatctttgctggtgcctttgggatcagatcagacccctgtttggatgttggagcacaacaacaggtcaacagcaattttctcgcagaacatttcagcaaagattcagaggaattttacagagtttgaaactcggaaacggtgccaaattgtttgttgactggttaatgctgtgggttggtgactgggtgtacaaatgtacaatactactactacggttggagtactcgcaacgcaagtaccgtacctagaaatgacaggtagagagatctggattctggatctaccta

SEQ ID NO: 75127 - DNA, 12022 bp, Oryza sativa
tgggtaggctgtcgctagttctctgctctttaaaccggcccaagcccaactaagccaaagcccatagagttctgctcgaaaatctctctaaaaaagggctaagaagtactcacaaaccccaaaaattgcagagcttcatttattgcatcttactccaatggttactcttaaaaaaaatctaatcccggagagaatttgaataagagattgttcaatttgtctttaggattaattcagatttgaccatctatggttgtattgagctaatacttcatttaccgtgaacgtgtttttaaaacagttaaatggtttattttgtgcgaaaattttttaaataaaattttctataacaaaaaaatgtaaatatattttcaaaattataatagttaatgtttactacctccgtcctaaaataaagcagaatctgaacatatatagttgtctagattcatagctaaaaatgtttttattttaggacgcatgtagtaattatttatacgctaacaatgtgtcttgctttacgtgccactaactagctaagcccaacagctatatcaaacttacccgaagccttcttttaaagaaggatcatgtgcccaaatttggggttggagtaacggataaccagcgttcccagtatttgacaaaaaaaaaggcgctcggttttgtgaaaatttggtgcttcgagctggatcaacttgacaaaccatttcgtaaactggtctaatgatgaaaagatattaaatcaaagtgagtttcaattttttgacagaactgatcaaatttcacatgttttcaacagttttcacaaaaaaaaaaacttatgagcgatttacaatcaccgaacggtttacgcaaacactgctgctaactgtaaattgttctgcccgtcccaacactgacaaataaattcccggcaaacaattctctaacaaaaaagcttattaggcatttccatgttgatttaacctctggttatatatatgcacttcatgcaacagtaaaataaattatgcatgcatgcaccagtagaacgattaatacaactgaccaccagcactagcttaataaattcaacagagttaaaaagtgaaaaacaatcaataaacttatataacttccaaaaaagaccatctattgtgccaaacgaaggactggaatgtaattacgtaaaatcaggggggtcacggaaggatatatccttcctctcttcgtcccgcgcgcgcgggcaccaaacccccctcaaaacccctcctcctcctcgtcgccgtgtgcttcttcctcgccttccccctaacctcttccacgcgcatttcccatcgccgaattcgcgatcgatctcctcctccgccgccgaggaatcgatcggaagagctccccggaggcgagccgtacgtcctcctcctcctccgtctccggcggccacgcgcgcgatctcccccgacttccgcgcgccgcgaggtaagaggtatggttcccccagcctccattcctcgccgctccgcacgcacgcacatgacaagccctaaccctatcccgcgccgcatcaggctgtctccccgcgccgcgccgcgccgccatcgtcgtcgaggtcgatcgacaccgccgctcacccaggtgtggtctctctcttcgcctcgatcgatcgcgatctctctctctctaccttgtttgcgccgtgatcgatctctcctcccttgcgcttgcaggacagatgcatcatggccgccgcagccggagaggtgccaggccctcccgaggccgaccccctcgaggtgaagtgaaatcgttcgacgacatagctaattgctactagtagctttgcaactggatcggagtactaggttcgcactgttgcgttgcgatgtgttgattgctggtattaagagactgattttgtgccgagtcatgagatcgatgttagtttagttgcaacctgccccaaattaatgttgtttctgaatttctcgattatatgctaatttgttctaggcatctgcgcagttagttcacatatgctggctaagaatttatagaacacattggtgcaaaccaattatggcatgcatacatacatgttgcatgtacggatgaacaaggataggcattaattggagaatctagagtctacactagggggatccaggaggattaggggtgtgttatgtagtactcccaatgtccatggaagattacaatcgggaagaaatggagacatgagcagctagagcctagaggatgatctaaactaagatcaagttcttttatagttttatgaactagattggacatttaattctcactaactgtcattatccttgaaatatgttattcttgtgtggaacataatcaaattatttgtaaatcatctttgtcttacatgcatgtaattcgtttgtgctctgatctcttattacagggtatcataacgtttactctcaaccttgcggacgtggacaaagaacaacttacactgattttgtatccgagttgcgccaatactctgttgagagggcaccatttacttgtagaaattgccccaccacacccgtcgatggttatttatcatccgtttttgccccaccatgcccgacaatggttactttatcatccgtttggtggaaggagatcattctatccggctacttatccaggaaaggaatggatatatgatatcattctagagaggggatcattcctggttccattttaagggtgaaaccctgctagattttattgttcagtcttcagaggaaacaaaaatcgaagcaagttatcataaattgattcccagtggaaggtatgaagttacattattcgctcattaatactctctatactctactcatggctatccattttatacagtatatatgatgtttcattgtactaacttttgtttcgtcgtaaacatgttcaagtcactgttttcatacaggccctaagccattgcgacattacttccgctgcattttgagctataataatgatgcggctttgggtactacaatgatgaacaattagatattgctttggccccaatgagtggtactttggctttgggtactacggtgatgaacaattagatattgctttggccccaatgagtggtactttctgtaaagaagacggcttagaccagtaaagaggtttgcaactcaatatgtattactttttgtgtgcctaagaatatatacataaaaactgctattataatcaggatataagcatacaaggaacatgacttcaaagtttttgacaaaataaactagcaagactatacagtattactagcagtaacttctgttatcactggagtaaagtagccgtttcctactaagccagaagaatataaatccgcgcctgtctatgaaaaaactaatgatatcaatatatagtttgactaacacatctatttctattgtgtaggttcattcctaattgtttcaggaatcatgtattattgtgtaggttcatttcttagtgtttcaggaatcaggtttccgaaagactcacggaaggtttgtgaaaatatatccactcttacacaatatcagcattcatcttgacctatcacgatgaggatggcaatccgctgccgattgttcctgaagatccaacttatcattgaagctgtttttactctggatgaagtgctagaacttcaggaacaaggatggttcaggaatgaatgtttaggatggttcaggaatgaatgttttgaggagggttagagtaagggagagtaagttacttcaaacataaggcagaatcagagagaaggcaagcaaccagtcaatgaggattgtgacatggatgcagtaagtctgagataagagtaatatatctcaagacaggtggttggctataagattgcaaaaggcagaaacatgatggagcagctaggaagctttgaataagcagaaaataactgaaaatatacatatctatatgcaagataaaatggaaacacaggggcagatgcatgttgagcaaggaatcagtcacaggacatgatgagggttttaagctcagaaaaggttctgaagatgcaggagacacacaatgtcacaggacatggtgagggttttaagctcagaaaaggttctgaagatgcaggagacacacaatataaatattgaggttgctgactctgttgcgaataaggaagacagagagaaggtagattttgggggagagtaatgagtttctagagaaggtagattttgggggagagtaatgagtttcttattcaaaagtgtctgaagatgattttgtaaacgagtgtagtgatagtagataattttgtaaataagtgaagtggatgtagtaatagcagaggaaaacactggagtcaagaagaaaagaaaagaagcagcaagaggctaaggaaaaagaagacataaatctagaggaggtggctattaagaggaagctaagcccaatatgcttttattaataaatgtcagaatcatattccatcctttgttcattattccaatggtaaaagatcttgcatgtgctagaattaatttcttcttaaaagagtaggaagtttacagagatatagatgtgaaaacaaatcagaggatgattttcatctgaacattgcctttctgaagataatgactcagatttagatgatattgatgttttgatgaaaactctgaacatttctggcaatagaaagaaaaaaaaagaggaaaccttgaaattgtaaggttacttctaaagttgttaagaagtgggggaataggaaaaaaaaagagatgaaaggtaatattagagaaatgagtgctatagaaaaggttagaatgttacaagatcttgttagagaaaataatgtagaattaatgtagattttgtatcaaaacagtaaaacaagacttttcctctagaatgctgaggggattagtggtcataaatctttgtgctggaactggatgcctccttctggaaaatctagggatactctaattagcattaatactgaaaaatttgatatcttggaagttactaaaaacaaattctgtgtccaagtgaacctgatgatcaatgggacttgatggtaatttatggagcaacctagaaagaggaaaatagtagtttcttaactcatgcaaatcttttacatcaacaaaaaatatcctttggtgatgggaggtgattttaatatcttaagaaaataaagtgaaaaaaaagctggtggttataacaaatagagtttcattttcaatgcgattattgaacaagctagtctaagagaactttgtttgagagggagtttcattttcaatgcgattattgaacaaactagtctaagagaactttgtttgagaggaaggcaatttaattggagtaataaccaggacagcccaaccctaaaaaattgaacagagtttttataagcaatgaatgggaggttcaattcccactcactgttgttagatctttgccagtgggcttgtctgatcataaccctctgatagttaccactggagaaaacacaatcagtcattccatttttaaatttgaacagtgctggttccttagggaagacttgaataaagtagtggaggaggtctggaacaagagttattcttggaccagtatagaaaaatggcaattgaggcttaaagcccttaggaaaaaaactaaatgggtggaacaatgtcacgcccagaaattcccgaatagaattgcaagcagaatgtgcataaaaattcctgtccaggaccggccggggtacacaaacgacaatgttgacattcagatccacgtcttacaaccatcataaaagtcttacataaatgcagcggaaaaacgaaagacaacaggagctaagccttgactagatctgcagcgggaacagcactccacaggcatcatcgacggcacggacgaagcctactcctcggagaaacctccatctgacacatactcgtactctggggttggaaaaaaatagagcaagactgagtactacccactgtactcagcaagtcataccggaataggggtatgatgtagggaattatcaaaggagagctagagtggttcatttgcataaagcgagtatttataaacagaagtttaaagaagaaaacggtcgtaataattaatcaatattaatcatccactgtccaacgctataccacgttgcgacaggcccaaccagattgtgccgtgttcatcttcatggaaatcccgggcttttccgactctcatgttctttttcagctctgctatttcaggatcatttacttgagctgctctgacttgatccacgagcgtaggccgtgcctccagaacggctacgaacccgtgttcaacaattgccacgttgagatgctcaaactcctgccgcaattcctcacacatgccctcgatgcatagggcagtgtagtaactcttcctgcttaatgcgtctgccaccacattggctttcccctggtggtagtgaatgctcatatcatagtctttgattaattccaaccatttttgttgtcggagatttaggtccggttgggtgaagatgtatttcagactcttgtgatccgtatatacttcacagcggttgccaatcagatagtgcctccagatcttcaaagcatgaaccactgctgccaattctaggtcatgagttggataattcccttcgtgtggacacaactgccgcgaggcatacgcaaccactcttccctcttgcattaggacacatccaagtccgtggcgggatgcatcgcagtagacttggaagtctttcatctggtcgggcagaatcaaaactggtgcggatactaatttctttttgagctcctcaaaactcttatcgcactcagctgtccatttaaacttctcatctttcttaagcaactgagtcatgggtcgagcgatcctggagaagttttcgatgaatcggcgttaataacctgcaagttcaagaaaacttcgaatctgcgacaggtcttaggtggggtccatttggtaactgactccacgttcgatggatcaactgccacgccctgagctgtaatgacgtgacccagaaatttgacttcagacaaccaaaagtcacacttgctgaacttggcgtataactggtgctccttcaactcctcgagtaccagacggagatgttgctcatgttcttcttcagactttgaatagataagtatgtcgtcgatgaaaacgacaacaaacttgtccagaaattccatgaacactttgtttatcagattcatgaagaatgcgggtgcgttggtaagtccgaaagacatgaccgtgcactcatacagcccgtaccgagtggtgaaggccgtctttggaatatcctcttcccgaattctcaactggtggtagcctgatcgcaggtctatcttagaaaacactttagctcctttcagttgatcaaacaaatcatcaattcgcggcaaaggatatttgttcttgattgtgacctcgttgagtgcgcgataatcaacgcctcctcttcgtcttatccttcttctccacaaaaatgaccggagcaccctaaggtaaagtacttggtcgaatgtaccctttctgcagctgctcatcaacctgcttcttgacctctgctagttcgttggccgccatcctgtacggtctcttgtaaattggcgcggttcccggtgccaaatcaattcggaattcaatctctcgcttgggtggcatggtagtgaggtcttcgggaaagacttctgggtactcgcaaactatgggaatctcttccaatttcctcggattcttctcctcggtgaccactgggatttccgcctcaatctgattcaaggagacccgttgctttggtgagactagtgatttgtacactacggtttctcccttcttgttggtcaaggtgactgtgcgattcgcacaatcaatgactcccttgaacttggtcagccaatccatcccaagaatgacatctaggtctttggattcaagaagaatgaggttggctagaaatggtgatctttggatttctattagcactgaagggctaaaactgaccgaggttgaactatttcccagggtatgaaccctcattggtgtattaagctcttctttccttaacccatgcatccccacaaatttctttgaaatgaaagaatgcgttgcaccggaatcaaaaagtactgttgcagggattgagctaacaagaaatgtacccagtacgacctctggtgctgcttgtgcctcctccgcagatgcgtggttgacacgagcctggacaatccttggcccggcacgcctaggcttcgggcatttgtcagcgaagtggccaagctcgccacagttgaagcaggaccctggttttgttccagtctccttcttggcttgcgcggacgggcctgactgtgccggtgccactggtgggcgtggagctgcaccgcggttgggctgacctccatggtggttttgactgccactggcgccctggtggaagttgctagagttgaacgggcggtactggcagatgatcatggtggtaggtccaccctgctgcccgggagcgaagcgcagtcgctgatggtttccttggttggaccggaactgtgccgcctttctcttcccgtccatcttgttttgctgatcctcctgacggattgccttgtccaccagcctttcaaaatccgcgtagtccccagatatcagttggttggtcagctcgtcatccagacctgccatgaacttttcctgcttctcggcgtcagtgcggacatcctccggtgcatatcgcgcgaggcgatggaactcatggaggtactcggtcactgtcctgttgccctgatggagtgcctggaattccctcttcttttgtgccacgaccccgtctggcacctacgccttcctgaagctacgacagaactccgcccaagtgacttcagtgcctggcgggcgggtggccatgtgattgtcccaccaagctgacgcaggaccttgaagctggtgtgtggcgaaagcgaccttctcctgatcattgcactgcaggagatttagcttcttctctatggcatggagccagtcattcgcctccatggggttggtggtgctggagaaagtgggtggtctaacgcgtagaaactctggcaacttggactgagagggagggggaccaaactgctggtgctgctgttcggcgtgctgcagcatcctttggtgcatctgctggtgctggtgctgcatctgctgcatcatggctgccatcatctgcgtctgatgtgccatcacttgggctagcgtcggattctcaggaagtggtggcggaccattgccagaatcactgttgggatgcacaccatcagcgcgctcttcgccgttgctgccctcgccggttgtgcggctaccattcctggtgtagaccatctggaggaaaagcagacggggggggggggaagaagaaaaacagatgctcaagaactaagctttattatataggaatttaaactgcaattgttctgatctgaattaaaacacttaaacagcaagcaaaatccttattaagacagccatatcataggcacatgatatcgaccgtcgactgaccccaagcaagcaacttaaacacacaaactaacaagcagaagctagacagtcgataagctaatggaaaacgagcctaatgctcggaacggctcctacggtcggtggagtcgaaggcgtcctcctgctcgtcaccaggtccctctgagcgactcctagagcctggcagataagtctcgccgctgcccggctctgagccactggagctgctgctgctgaggtcgcgactgccactgggagtagctggcaaccaacctccattgccactggcggggaccctgacggctaatgcaggcgcgaaggagagagcggatgcaggagctgacacgggaacgagagctggagctggtgctggagctgcaggaactgctggagctgtgggcggaactggaggtgctgcgggagctgctgatggaggtgggttcctgggcgcaagctggatgcacacgggtgtcgttgtcgacttgcggggcgtagtgcggatccggactcctcctggcgcgggaagaccctttaactgagcattctccctcttcaggcgcgctatcttgtccttcagagtgacgatcctcatgagcttcccatcattcaaggccttggacgccttgtgcagatccgagtgcatcctatccaatcccctcatcacagcacacatgtgaccaaaggtggtgtcgttatcgccggctgtcggacggaaagtactgacatcatcaccgctggctcgacgagggtgaaatcggtacgccgtgtcgtggaagatgtagttgtggcgctcccgtagtttggccatcatcaggtatgctgcctcctgacaagcgtgatctgctgtgtctccggacgcctcaaccaccatgttagcgaggcaggtgcccacatagccatggacctctaggcggacacggtgaggaagctcgccactgagtggtggaacagttgtgtactctggcgcgttggggtagcccaccaccagcgtcatacgtgctaactctgccacaaagtcaatcatgccttctccgtggtggttgggtgggtggccggctatctagagaagacaaaggagtaggatcaatgcatgctcaaatccaaatttaaataaagcaataaaggactcaaataagagaatcgaataagagcaagattttatgcatagatcattttgcatgagggcgaataaataagacagacttacataacgatacaataatggggaaattagatacatactaataataacaataaaagcagaagtaccttgcaacacatattcctgagctaggacctaatgcatttcacccatcaaatcccaactgattgacgaataaaactcaagtaattttactaaaaccctagactgacttgttttgacaaatctcacttaaacgagcgaccaagatttttcccttgaaccacaagaacagatcccaattttcccggaacaaatccaattgtaaagaacatatgcaatgaaaaggattcagagggctcttaggtttttccatttggcttgtcctacggtcaaggtcggctctgataccaacttgtcacgcccagaaatttccgaatagaattccaagcagaatgtgcgttaaaattcccgtccaggaccggccggggtacacaaacgacaatgttgacattcagatccacgtcttacaaacatcataaaagtcttacataaatgcagcgaaaaaacgaaagacaacaggagctaagccttgactagatctgcagcgggaacagcactccacaggcatcctcgacggcacggacgaagcctactcctcggagaaacctacatctgacacatactcgtactctggggttgggaaaaaatagagcaagactgagtactacccactgtactcagcaagtcataccggaataggggtatgatgcagggaattatcaaaggagagctagagtggttcatttgcataaagcgagcatttataaacagaagtttaaagaagaaaacggtcataataattaatcaatattaatcatctactgtccaacgctataccacgttgcgacaggcccaaccatccacctatactatccaatttcaaaagactaaactaggtgagactaattacggtgaatctggttgaccgcccataaccgcgggcatggctattcgaatagttttactctgatcagagatgtacaactgtacccacaagacatagccccacgacacgtttccgtgcgccgacatgccaccacgacataccggaaagaggccgtgacaggactcttcgcataaccccctctagccaagcacaccacacctcaggtttcacccccgtccccagtgggcgacgggcagtcccctctcgtgcctaggtgaatccggaagccgcataggccgtcgcagggcccatccaaactccatcacgcccacccttgcctggatgcgtcagctagagaaaagctacactgggtgcaggaa

SEQ ID NO: 75128 - DNA, 1666 bp, Oryza sativa
  unsure (1)..(1666): unsure at all n locations
cgtggtgttggcctgtttgggttgggtgttccatgagccaagacagagagatccaggtcgagacaaaagctaggtaagctggcctggtccgcaacgatgaatggatggatggacttggtaattaaaaaaaaaaagaacaaatggatctcatctcatctcatgcaccggcaggattccaaatgctggcccggatgtaagccaagaaatcacattcacaggtgcaagattgggcatgttgcgtgttttgtgctttgcacatggggggaacccatctcacattccaatggaaacatacaggaagtaaggtgttgatgggagaaaaatatatgatgttcaagtagatggtcatcgtgcttattcaactatcaacatgtgcacaggtatcttacaatataaataattgtacaccaaaaagaatgccttcatcgagcaccggaggtcaaacaggaagctacaaaaagcagcagcagtgtcgatgcagaaggaaaatatgatgattctgaaacgtaattcacatctacaacctcacgcgaagcaaaataaattgccccaactcgcttcgaatatctggtgatattttattgtttacacgaatgtgatcctcaatttacagcacttcacctagcttcatcttctaggttgcggaatccggttgtgaggtcatcatacaatttctggaattttgcgactaggacatcttcaccctctgcagggtcctcaaacttttgagatctgttgcaagagtgaagtattcagcaaacaggattaccaatgaaataaacccaatcaaatggtcaccatntgaggtatggaactgaaatacttacactaggcgataaantagatcacccatacgatgctttatgacactgtatgtattttttgtccatcagcattagctgcacgctccacagcctacaagacaagacagaaacatacaattttgttaaggtatgatggattcaaaccaagcacatttcacttatgaatactataagtttctttccagcaaaagaaaatagtgcagatatcagatgagtcttacaagaaagttcatacatcacaattaactaaaggatattgctacttgctacataccttctctaaaactaggtgaataaatatcaagtatttgcttggtaacttttcttattgacataatcattatataaacttcagcccgttgcaagtctagccaaagcttttcgagtttacacttagccctagcacctagtagtttgtgcaccaattgccaaaaaaaaagaaaaaaataaagaagtcacacactttcattcaaccagaggaatttgagcaaaaatggttcccttaaacccaaatccttttaacttgcccttgctgactcagttgaggtggacatatgaacacaatgtcatggtgaacccttaggcattagcacactagcatcgaagccaaccaagggagctagtgagagtggatgcaagaatgcaacagaactggggttaagtaagcgaagccattatttttaatcaacttttaatgtgagaattctgtttggctgaggatctgtgcgattggtgccaatacccagggttagtgctttaatgttttttgtttagggctagcctcttaaagataatgagcatggctcattgatatttaagacatatatcacaacacagttcat

SEQ ID NO: 75129 - DNA, 2499 bp, Oryza sativa
acatgactgttcgtctcttataggcgtgtgaagtgtaccatttaccaaactactggaactataccagatctgtgatgttcatcagcagtagattgcgtacctgaagtcgaattgctatcttcaaaattagcatccttggttctcgaaacatttgattcagtgttgggggaacttcttctgaacaaacctcttaccttcatcctattaattgaaccaccacttcttttctcttctgacatctggagtatcttccatgtctcttcccagtagttgggtggattcaagggagattttcctctgagaggagatgaaggaagatttgcttcaagagcaaaaggttgcaataatttggctttatcaatcaagctctttaagtcagtgtctccaggaaaatttaacaatcttactaggcatgaagttgcatgttcacttcctagcaaggaagatctgagatggagcatcattgaaactgccattgacaaaatcagggcaccacgatgagaacataaaatcttaaactgatagtctgattgattctttatgtctgcacaatatgaatggttaggagatgagaagatctcatcccaaataaacagaagattgtcaagtgaaaattcacgaccgaatagaactctcagccatcgtagcgcaaagtactgaggctctactcccaactccatcaaatgactgtgaagaggggaatccacactagcaagcaagtgatatattgcagatgatgcctcccttacaggtgttaaacctgtgcttgattctggtgcaggactgagagaatagaagtcagtaatagcaaccacaccttgtgcaccattcatcgaaccatgcatcaaactctcaaacatacaataagcgtcatgctccatgaacttttcagacaaaataatacccagctccccttctgctccataagcatcattaatcaagaaaaggtccctcgtatcagaatcaagatcatccaaacttcttattttagctgcactaccctcaattgtgtttgtcctgtcactcctgttcagttttatcctatctggaaatgtttggccatcaaaatcatcactaaaaagctcatcatgaagctccctgacttgtttgaagtaatgcacatcagcatggaggacatagagaagaggagctaagagctcatgcattcctgcagaaagaaggaatgtgattgatgtcgacaaatttacaaggacagatggatctttagtgcaattagaacattagtacctagtttcaagtgttgattattgatgaagacttatattcgcctatatggaagaaattattattattacttctatagtccaaacaaacttatgttcaacgtgctatgcccatggacttcaacaatattacattaccaattgccaaacctagtaaccaattcacttggcctatttcaaagctgctgcctcggtttaggaacatcatattgcaagattgtgtctttagatggaatctgtgattgttaggtcacatgagaagtgtacacatcaatggcttaccttgtttgtaaccgagctctgggtacctaaggctccaaactaacagtatacgtccaagcatggactgacatatggttgtttggaagaaatttcccaattcagggtagagccgagacaaatcttggttcaacattttctctagttctgcatttctgaaatattggccccaagtgctttctgcattcacgagacataatgattagaaccaaataacacaatataatgaaactaaatagtgatcagtttgtgaagaaagatgccaccaaacatgcgactgacgccactttattatatcacctaggatagtgctgaatcaagaaaatgtcccactgatgagttctgctaattgtgagcaatcagttatcacttatcacctgaagttgtgatgatgtagcaacaaaacaaggtttctggcagctcaacggacttaaaacaatcacctatgcttagagtatctgaattaacatattaccacctcctcccctcatccaccctgaccttcctatgttattctagcaccaactgtataaacaaacagttaataacagaatgtttggcagtattgtttcagcaatcactgtgggactaacaaaacaccactgaccatcttatgtaacagactaaatcaacaagtatttatgcctggtgatgcaagtaatggcaactcaaagaagtaacatttactgaagggcaaaagcaaacccacctgggttctgtgatagtggattttccacagcaaggtcaggagcgttttcttcatccttagagagatggggatctattaacagccgccgccgcaaattagcatacctacaacaaatacaaattacaaaaccaggagtcaaaacctccgaacctaacaaacttgaattcttttgccccccatattaataagtagagtaattcataacagtatactaccatacaacattcaccgctcatcgaatgcccagagaaatgaaacatcaaattg

SEQ ID NO: 75130 - DNA, 6124 bp, Oryza sativa
gtggcatttgaagcactggcattttgagagagtggcaaatagtaaattcatagctaagcagctcattaccattaagcgtaatccacacactaacggggatagatgatctaagaaaccatacatcgcaaaacgaattaaagaatcgctgcatagctaagcattccaagcaaggaaagcatcgccggggtcaccaaagcattccaagaacggagctggaattccccgagggccctgacctgcggcgggagtcggcggcggctcggcggaactcctcggtggacacggaggcgcagtcggggaggacgccgagatcggcgcgccaccgggcgccgcggagcgcggagaaccgctccctcgctggacactccggcattgccgctgccttttggcttccagcctccctaacaaatcaggcaaaaggaagcatgagaaggcggccggagcaaatcatcagctgggttgggtgggtcgatccgcgagcacgaggagggccaagcgaggagaggattgggatcgaggaggacacggggggagcgttcttgggagggattgggattgggagggaagaagggaaagcgttgggagaagaaaggcggaaggcgtctcgtctctcggtgacttgtgtttgcaggtgtcgttgggttgggacgcgacgacctgtttcctcgggcaaatggctgtgtcagctgtgatgatgccttcaattcctctcaatctcaggtatgtgctatgttcaccgacatgtgtcactatagcggaatcggatcctctgacgtaatataccagcgatttccgtttcgtattggataacgagttagatagccgaacgagctcgtgtttgactcataccaataaaaccgagacatcacatttgatgaaagagcttattgtaaaagctataattgcctatagctcgttgttgctcgctgtctcaggggaacttacgcaatctaatatatgtgcaagtcttaacctattgatcaaaatccaccataaagaataaacaactgatttaataacgaaaatgtatatctaagtatttgcctctttctcgttagtaaatggtagagctttaatgtaggtggtggcgaaagtatggggaggagggcgccggcaagggacatgggtgcaagggatgggaaggagggcaccatggaggggaggggcttcctcggggatccgctccaaccacgcctacgccggagaagacggcaagcggtaacgaactgtcagcagtcatggcttctgcaagcttcacctgagacggtgagcgacaacgagctattggtggctatggcttctaaaataaactctttattcaaatgggtcgtcttaattttgctgggggccagacacgagcatggtcatccgtcttgcttgttatatcgaccgatgtggaacggatgtcgctggtgcatccgatgtccctctgacttagcgagcagctatataagaggatccagttcccactacggtcgattgatggttccactgagaatttgaagtgtagatgatttttccgtttgtcgataaaatgaaccaatttgtataaagtttataagttttcaaatggtggtggacactatgtaaaataaagtgtagttgaactataacgcttattatcgattgtttggtcctggttcctacatatattattagactcgcacgctcgttgcttctagaaatgaagttgattcctatctcactctcagtgtgttattgccaacattatcttctacttgctcgccacctgtgatgatatatttttagaacaagctatttgatgtatgagggtgaaggcctgtattagtttttgttgggtattttttattccaatattccaaattcgatgattcacgtgtaggtaacctttttttttaaaaaaatcaacactcaaataacccaatatgaaatttgctcataagaagatttcaactcgggatcttagggtgctgttcaggtcactgtaaccattaagatacataccctttcataaagttttactaccaggaagtttaaagaaagttggtagtttaaaaaaaaggagttaaaagttcatttacgtacgaaagtttttgatgtgatggaaagttaaaagttcgaagttggtggagagaaactaaacatggcctatattgatagagaactaccagcactggcaggatgagtggtatggacgtatgttgtactaccgtgtacgagggtatcctcctccgtacgtgtgtggtccggtccccgccagagggagagaggaaaggaaacgtgcgtgcaaaactgcaaaaagcccacgactccaccaaccccagcccaccccacgtcacgccgcacccgcaccgtatcctgcccaatctcgttcaccccttcacgacccgtgaccgtgacgcagccgcacggcacttcccactcccccgcgcaacgcatctcgacgacgtcgccgtgcaccggttcgcgtcccgtaacaatctttactatcaacggccccggtttcgcgtgcgcacgcacgcacgcacgcaaccgcaaaaaagcgcccgtcgtctcgcgccgcgccgcgcctcgcgggtgatgccgaccgccaagagccagagcccaccccgcgtcgcgcgcgcaaaccaaaccaaaccaaaccaaaccaaaccgcacatgacacacattcacacaaccgcacgcacgcgaggcctcctacctgccgttctttcccccctctctctttctctttctctctcgcggggcgctgcgtgtttgcgcttatcttcgccgccgcctcgccacggcctccttctcagctcgcccaatctctctctcgcccgccgcataaatatagcccttgcctctcctcccctctctcgcctcgcgagcgagcggacgaacggacgagcgagcggggagcgcggcgagccggaggcgggggggctgtgcgcctcggtgtctcttctcccctcctccccaccctcccctttctccgccctcctctcgattcccgcggttcaggtcagttctcttgcgctcttctttgtaggagatgagatgagattggtaaccaatctagttgctttgcgtggggccttacgcctcgtggttctttgtggtttctttccgtggatttctgtagattaatctctatgtcgccgtaggattgaggtatttcggggtgagggttcaaatctgtggggatatgttgggggagaaaggcgcgaggttcagtttctgcggtgcaaatcaaaatcgccagattaaagaatcttgcaccgacgattttgtgtataaaagtatgatttttcttttagggccttttgctgtgtgtgtatctggacctatcagaggattggttgcggaatattgtcacagaatcttacaaatttctcatctttttggatctatcccatgatgattcgtgggctggtgaccttcgacgaaatccgcctttgctccagtggccagcaaggttaaggtttctgggtggtgggagccctcgctaagagggaacacggggccggtgaggctgctgcagcagcgaaatgggaatgggagcattgtcccgagggcctcgctggtgtctctgtgaggcgaagagatggcggcgcatggagcgggggcagggaggtgggagcggcgggttcgctggtgaggttgttgtgaggggagatcagtagggttgtctcttgtctgatgtgcaacggttgatcttaattgaatggtccaaaattagcaagatttggagtgaaaaaaatcttacatatatggtataggcaatcaattcccaattcacctaggagtatgtgtttattagaatttgcttctgtagaagagtggtttttttatatattgggcaatgggcgcaactgcgctgcattaaagatttttgcatttctcatgacaactcctgattaagtaagataaaatttcttatattgtcatacggagtacatgtgactcttgggatgaactgttcctatcagagatattgtaacttttattggcatgtaaaaatacagtggaaaaatattttcttaagtcctattgattatttgatgttaatgctgcaattagactcaaaagtatttctttactcttgatttattctacattttgaggaattattgattgtgcagggactttgctgatcttaaatcttattcctgactgactgtcatgggcatggaacatctgctgaacaccgcgagtccttcatcaggttctagccatgctttaacttggtatgcattgtttcaatgtacaaggaaccactactgactgctcatactttggttacatcttacccaaaaggctttattgaggaaatgagggagctagagaagctgagaacagaaacaatgatgaaatcctgccaaagcactacaagcagggctggagcgataagatgtccagtaccacgcaagagtggcaggtatacttacaatccggttaactggttttaatatgattctaaatctaaatttctttgtccacaagacaattgtggtataaacaaacattgtcaaataccctcagggtgtgttcggatgcctctcttcccaacccctctccctcgttttccgcacgcacacttttcaaactactaaacagtgtgtttttttaaaaaaaagtttctatatgaaagttgcttaaaaaatcaaattaatctatttttgaaaaaaaaagcaaatactacctccatattttaatgtatgacgccattgactttttgtctaacatttgatcattcgtcttattcaagaaatttatgtaattatcatttattttattatgacttgattcgttatcaagtattctttaagcatgatataaatatttttatatttgcacaaaaattttgaataaaacgaatggtcaaacgctggtcgaaaagtcaacagcgtcatacattaaaaaacggagtacttaattaatcacgtgctaatagactgtcccgttttccgtgcgcactgcgcacattcccatcccctggtagcgaacacaccctcaatattctaatagatcacatgttatcaaattcatttcatcatagtgtctaattgtctattgctgcgttggattgcttgaatcatcttgctttggctgagtacattgccgtttgtgttctgcatgttcaatttgactctattgacacactcacttctcatctggaatttttcatattcagataagttcgggtattttgattttaactgcatagcatcggtgatttattttgctgttcaggtcatataaggagtatgatttaacacaggatctttctgatttcattatgagcaaggttagcttatctcttttctctttaccccatattttttggctgttgctcaaatgtgcttccaaattaagctagaaatgcaatctacaggcttctcctccatactttacgggatctccaccagttcgagcaagcaatccacttgtacatgatacacagttctgtgcatggaagctgcaaaacgttgatcagtcgcttagcattcctataccaacaaagggttgcaatgttcgttactgtgtgagggaaggatctattacaaaggcttgaagctacatttatgagcttcatgaccgctggcaaccagacctcagaggacatgcttggttaacattccggcttttgacattagttgtagttgtaactttgcttgcctcttcaaggccaatttgtacatatgagttatcaccctctagaagctgccgttttcaagttttgtgccgttgtcatcggcagtggtgtacatatcttttgtgttcagttttgtcgtctgtgaagttagttttggcaaataaagtctgtcaaacctatgttgctgagaaatgaggtaacctgaatgaaagagaatttgttttcctttagtttctgattaccatgttgacctgtgctggatttgttaatggatgattgaatgttttggccttctatttttgagtgctgcatttgttttgaaaagcccctatactggtgttgaggagagctacatcagtcttatatatgttctctgcaatgtttcaggttcaaccaattgatttatctccattttaaaagggttaaagggggggtcttattctaatcccaaattttgcccagtatttctaacttctgagctcgcaaattaaacatcaatca

SEQ ID NO: 75131 - DNA, 4334 bp, Oryza sativa
catcttctatatgcttaagtggatattccgatgctgattttggaggttgtagaattgataggaaaagtactagtggaacatgtcattttcttggtacatcattgattgcatggtcttctagaaaacaatctagtgttgctcaatcaattgctgaatctgaatatgttgttgctgctagttgttgttcacagattctttggcttttatctactttgaaagattatggtcttacttttgagaaagtacatctcttttgtgataatacaagtgctattaacattgctaagaatcatgttcaacactcacgcacaaagcacattgacattcgctttcactttctgagggatcatgttgagaagggagatgttgaattgcagtttttggacacaaagttgcaaattgctgatattttcactaaacctttggattctaattgctttgcttttcttcgtggtgaattgggaataattcatccttttggcatggtttgagggggagtttgtacctcatggttttatcaagcaaaaatatgacaatgagaaaaattgataaaaaaaaagagctttgtttatgcatattgtattttcttgtgcatgctagcaatactttgaaggtttatttgtctctagcatagtttgtatgtattctagtcttttcatgagacttagattttgcttttaagggagatgatgcatgacacttaaattctatacttgaattaagaaaatatgcaatgttggtgctagcatatggtttgatttataaatgctccatatatatgctttattgacttgttattcctcaaatagctttaattgctcattgtgaaaaagagaataaaaatatgaaaaaaaaaatgaataccgaatccttggaaacagtcttgacgacaaggacgtattcgatgtgagcaaaataatgggtgccgaatccctggaaacagtcttgacgacagggacgtacccggaataaaaaaagagaaaaatatgagcaaaaaggctcaagaaaagaaaaggtaaaaaaattctctttgttgttttgtgctaaaaagttatttgagaaagagtgataaatgcaataggtatatgtgtttagtgtttattcttcaacctatgtgcttgttaagatgttgcattataaatcgtatgaaaatcatgaattttgattgttgattcaagcttaattgtaaaatctttggttcatggttatactttaatgcatgcttgttatattatagatgggttcatcttctttttattgcaacacatgacttgatatgctatatgtatgctaagctcttgaacattaatgaacataattcctatgcttgatgaaatcattttcaaaagagggagaagtaatgtgaaaattttttggagcaaggtgaatttttggagagttgttgagaagagcatgttttttggttcaattgggaatttctttcttttaaaaagggggagaagttttcttttggatttttgagcacgatgtgtacgtttttacgaagtgtgctttttaccacttttgtttttatttttccaaacacaaaaacatttttaatgggtttgccaatgtgttcatcaagggggagattgtaaaatcaaaggtgtttattattattattttgtgatgaacaattggcatcggagattattggttttgttatttggaatttatttacgaagtggttttggagatgattggatttgcaggtgctgtgattttatgtggaccggttagaccgggcatgtgctgccagtcagaccggcgtgtatcgcgcggtcagaccggcgcagcccgcggtctgaccggccgactctgtgtcggtttcggttttgggttgtttatttggatatccgtgattatttcatgattatggcttctagatggatactatacgaatgtaatactgttgtttgctactaatgagtcaagttggagatagcttggtctcggaatatggtttctttgtttgttccatgtgtaggtgactcgatgcctcgggagagtatttgcggtgatagaccgggagtcggcttggggataagacgacgtccgtggtggtcagagatcatgcaggatacttaggctagagttgatgcacgtggttgatggagattccatatggcatacgatggagttattgtgtgcgtatgggatgcggagtcgaatttggaaggagtccaaatttggtacgattggttatgtaaagtttctttcttgtactagagggtttcctaaggtgtttaggactcctagtatgagtttggttcgtggctctaggctgcctacctcgggtataaatagagggggagcgtgaggcttcctggtatcgcttttaagagaaattgagttgagttttaagttagggtttcgagtttagtcaaaatttttgtaaggagtgctgtaggtgcactttgtaaacatagagagaagtaataaagtcgtcatccactttaagagttcttcgatttgtgtttcaccgggtttcggcggtctaaccggcgacacaccggcggtcagaccggcggcatcgcggcggtcagaccggcggcggcgacaggcgcagcagggatttcagggcggtccaaccgggagatctacaccggtcagactggcggctatgcttcggtcagaccggctaatctactccggtcagaccgatctcatcgaattcgagagtaacttttatttccgctaaaagtttttggtttttgggtatatcaaccattcaaccccccctggttggcttagttcttgctattcgatcctacacccgctggttcggttgtagagtgtgtgttcgtctcactgctgaaagcccttgtcaggccgaaatctgaaatctttgccttgaaatttgcagtaagaaggatgttgtgggccttcacatctctatggatcaatggtggactgcaggacctgtgcaggtattccagtcctacatgcatgaatagttaaaaaataaaacatcagatatggataaatgatcataatgctgaaaatttgaagtattattaagaggggcattcaggtcaatatacagatatcagcccgtattatcgaaagagagaaagaaaaacttcgaagcttgttggttaccattggcagagtccaacgcaatgttaaggcgttgcaaccaagtgaggggttcagtgtgaagatcttcttgacctgtgaaaaagaaatcatggaatctgcaatatgaggcttatctttacaataatgaaaaatcggcttctgaggtaaagttctgcaaacctctcaagtggtctgctaggcttcccccatccatgtactcatacacaagggctagatgtttcttatcgttgcaatagcctattaatgacaccaggtttctgtgatggaccctggctaagtgctgagcctgtaatacaacaaatgagaattccaagaaatttatgataattgataaattactatacttttaattcatcagttctaactacacacaattgtataatccaatgatcaataacttcttgtagtccattgtattggcagagtaatgtatgtgtacctcagccaaaaactctgttttcccttgattagatgtttgtgatctcatcttcacagcaacgggagttccattctctagatagccaaggtatacaggaccaaacccaccccttccaattatggttttgaaactatctgcgatgagcttgagttccttgtacttgaatctccggttctcaaatggattagttgcaccagtaacatctgctggtcacatgagtataatatcaactggaagagaagcatacgctacattctcatagtgaagctaaaattctcttctttatgtacattcatttagttacctggtctcttctttctgcagtaccaaaatatagcaagtataagtagaactacaaacacaagtacgactgggggaacaacctcaagcacaagttttgtctttctcttgctttgattcagaatcagatcgcatttgtcagttccacaaagattcggattattctcggtcctaaaagaacaaaatatattggtcagattgcaatatattggaagtaaggaattaggtcttgtcagatcccttcatactttcattgagttagaaataaggtacatctcagtggtatagcgcaaggcagttcatatgtcactgctcgaggcgataccatgatagtggcataacagggccttaggattctcatggttgacaaaagtgatttgaacattagtatctagcttatgaatgaaagacaagaatccattcaaacacaactgaagttctgagagacttgagtgatattttccatgaaagtggggtttcctttcaatattga

SEQ ID NO: 75132 - DNA, 28546 bp, Oryza sativa
ccatagactaaaattcgacactatgttttcccaacttctactaccttatttttcgtgcgctcacccctgaaatactcgacgatgtatattttgcaaaaaaaaaaaactatacaaaaattgctttaaaaaaatcatatttgtccatttttaagtttttaagctatcactcccttcatctcaaaatataagcgattatagatagataggatacatcctagtactaagaaactaggtagacttttgtgtacattcttagaactataatgtatatcattcatccaaaatctcttatattttagaacggaggtaattaatcatgcgcggatgacttaccttgttttccgtgccagagaccacaaccttgtctatatctctactattttcctcaaaaggtttctgtcccgctaatccaaaaggcaaaggcaaattcaaacaaaatcagtttcaaaccataattttgatgggatcagctgtatggactcaatatgtcgcattttctactagggagcacatgaaacatgataaggcatatgtgaaaaatcaaattaactactgccaataaaaccaagtgattcatcaagcaacagcataattatacagtatctgcactacattattcctacactggttatacaagatgatccaaaagggttatgaggtgaaatcactatgcttctccattgacttcagccctcgaatccaaatgcgacttcccgtcgtcgctgccctgcaatgattcgtccattaaacggaataaagaagagttcaacaaagaagttgagatgattctggtaagaaagtagatggctaacctttatacagacataaatatagtgaacatcaggttttgggccaagaagactaacaattgatgtgctatcaccatctaaaggcagtggcttcgtcagttcccatgaaggctcccgactcctttcccatctatctgggatgtcgagagtgtcaattcaagagtgtaaattaaatgtgttttagcacaactataatgagtggcaggtaaaatgtttactccgcacactaatggcgataccaattgccctttatagcttgacaattttgaagtaccaatgaatggacaaatggtttagctgatctcacggaaaaaaacttactaacctatgacatgaagctttactgtccaaagctgcaggtctttaaggagacgcaatcgataacttgggtcgccataagtgatctgcaacattgtgggatccaaagttaagttctagacactataaaagaacagcatgcttgtgtaaacaaataatatagttcctttaccagaatataaactcccttgtccttgagaattctgtagatagaagaaagaaatagaagctatagtaagttaaacggagatttcacaaacaaataaagtgcgtgatttacctattgacctcctctagcatctgagacgcattctcttgtgaattttggccacactgcaatacaagaaatgcaaatctgagtaccatgaaggaagaaaatttgagtatgttgtacactggcaaaaatgggctcaccattatagaatctagcgttcctgcaaacaacagatggggttagaacccaatgacatgttgcatatgcacatagcaaatgctcctggtaagactgtaaccactatatttactatggtacctttgtcaataacagcatcgaatgaacctgactcgaattcagccatgttccttacatccatcttcatgtctgtgtaaggtaggaaataaatagtaccacatgacaagataaactattacactcactaagggattcagcaaaaaaaggctggggacgaagagtatacatttaaggtgaggcttgtcacgatatttcttcttcatttgatcaatcaccactgatgatatatctatgttgacgatgtcttgataaccatcatcaaccatgttttcaccaaaaactgttcagtgtttaaaggcagattatttaaacaagaaatgccaacttaaaatagaaaaatccactaggcaggaatgcagagtaatatacagaactttggagttctatacataattgttttttgagattaatgactgaaattgagaaatatctcagtccccaactatcagcaatacaattaataacttaaaatagagaatttagatggtcatgtagttcaagatgttgaagatcatcgatggcattcctcgattttcatctgttatttaaactccacctcaaaccattgtcatatgttatttaagtcagataatagtataaatcaaacagggggtcttttctgtataaaagaccaatattatgatcaaaatactatcacagttttgcttatgaaggaatgtagtacatgaatttccctattgccactcaaaaaagttttccatattgacagtaatgaaggtttgttgattcaaattgctagctttctttgtcactttatagtacaaggtggacctgtcttgctgcaagtgcattttcatatgctgtggcactaaccagagcctatacacagtgctgtccatcattttgtgctatgtgcatttttagctggacaatgcaatgttgacaaaggacaggggaccataatgcaccgcattccgcacatggttctagacagaccgatcaaattcagcaggtatttcgacaaattgacaggccatgccactctaaacccatcgatcgcacccatgttgtcacgatgtgccaaaatggcaagttcttcgattgtaatgcatttcttcaagcatatgaaccctaatgtcgaacggatgcagtttaatcatagccttaatttctaggagcagcattgaacaaaccaagaaattccaaggatccatagaaaatgtctagctgcattacactccgcgctgatccaaacaagaaaacggcggcctgcgttgcactatggcgctgattcaaacaacaattttcgcccgggcctgatccaaacagtaatcctttcaggaatcccaacccatgtcgaaatcacacgaaacctgagtctgatttcatcccaccagcaatcccgcgcggaaatcccaggaaatggacgagacaccaatcaaagagccctcgatctagtagcggcggaggggagggggatgtatgatataatcagaggggctcaggggagtagtgtggcagtgcactaaccggagttgccgcagccggcgaggaggaggcggtggtggcggcggacgtagacggcgagcagcggcgcgagggcggggtacttctggtaccagtcgaacgggccggcctccttcctgtaccgctcgtcccagtaccacgcctccccgtacgcctgcgccgccgtgcctcctccaccccctccccctcccgtcatcctcggcgccgccgcggatctggccgccgggaatgccccgcctccgccggatcggtggccgcggggtcgcgtcgcgtgtccccttcttcgctggtgccgacgcgacgcgaaacggtggtggataaggatcgcctcgccggggggcggcgagaggctgagatgggccggaggacgccgggggtttgggcccagctccggagtggttcgaggtgggccgccatggactttcggcttcccaaattttgacgatcatctcttttttgaaaaaaaaaaaaacttgttcccaacttattttgaaataaaacgtaaacttgcacgctgaagttttggccgcgttgaagggagtagaagcggcagctcacaggcgtatggtgcacatctagctggagtccgactcactgatgctggttcaagctctgaaggaaggtaatctacaatttgcagcgatgggggtcttgtcctgggagcgaagaagattatagcttcgacttttatttcttttcgagttagctatttgtccccgtgaatataataaattggcagatgctatagcatcgtttggctgtaacagtccccaaaactctgttctcagttgggacggttcacctccgggtgtggaggtcttggttatcggcgattctgttgaaactatgggttaatggaaacaactagttttcctctataaaaaaaaggtaaatttcactacttttaccaaactatcagaaaactacatatttaagaatgtgtatcataaaactacatatttagtgcaaaatttattacgaaactatagatttaaaatattgtatcacaaattatagatttacagtaagacaaattttgctgcagggtattgtgactttgcgttttagttataggacactgtactaagtgacttttaagggaatacactctcaaagttggatatttactgctggacacctcacccattaaaataacaatttctggttgaagaagagataaaccacgtgaaatgtcagaaatgcccttagacccatatgttaactctcttatctattttctctctctatccccttctttcagcgcggcatcggatccccgcgagctaatgctgtaagtttggttattgtttgaggtgtttggtgagttttcctcgtgaagaagctaggtgttctcattttttctcataactatcttggtttttactttttcttattgacatatataatttgtactttttctacctgattagtttaaaaaagcctgcatatagcgtcacggcggtggtaggtcggcgccaaaacacccggcgttgagatattggatattagcactatcaggggtgaggctgtgggtagtttttcattttaagtttaggcattggcctattatttaaataagtttttttttgaagggccaaactctcaaatttggtgctttgcttcttctccttggcgtcctcgcatcatcccaggtgagtggtgagcaaccgttgcttccaacggaggcgacgtgccgtgcattgcaaaactggaggatatgtttcgcttccgtcgccggcgacaattaacgccggcaattacgcagcagctagctttagctctagcagtgacaggacaaaagacgcgccttttgcaggggatctgtacaacacgtacacgctgacgctgaaaagagagagcacgcaaatttggcaatgcgattgagctgaaccatgaacaacactctccaaatcaaattacacttatagcggtatattttaaagcaaagcgaacggctcaaaattacattgtagtaataatatataaattacactgcagttgcatatgagtcataatataattacattgtcattgtactgtattttatatctgttcaattttagaagaaaatttattgataaatatctagcaaaaatagttggacaatggaatatattaaatccagcctaaaatcaaatggacacttttttgtgatcagcgtcgtgtggctcgtgccgaatgagtccaagagcgtgtacttaattcaacgaataataaaagcatatggtgtaaggtagtagtatgcttaatttaatccaacttgggctgatctcttgtggcgtagcacaaaatttaggtgtctatctaatctaagctttagattagcaaggacagtcaaaaagggatgggcaatatcaaagagacgcgatcttgtggaattttgtcgatccctggcattgatctcagagggagactttgagtgattgaaaaattatatgctctacacatgctactagatagatacatgcattaattacatgagagaaagaaagaggaaaagaaaatcacagacaataagagcaggtacaatagtatactataagccagctataaacatattttaaagagataaaggaagagagagaagagcagcggactacagatctgtagccagctgcagcgcggactccaagacgcaatgtgtgtatgacaggtgggatcgtatagtaagtaactattatatgaattagctataaatgaattggagctagtagtgggctatactattaaacttgctctaatcttatagctaattctactattttcatgacacacatgagaagaaaaaagtgcaacatgcaatcaactcaaattttaatctcttctcgatacaccaccacagtcggcagctctacgacaaactcttcaaccttttaatacaaccaaatcaaattgttccaaaattatttaaccatacatttttgctcctggggtagggtgttgcggttccggatgacgtccgttgtgcctgtgcccctccccaatagttctacacgaccagctttgttgatgcagccatagcgccgcccacaaactcgtagacgtcgcgtctgtgttggagacaggcctataattttgctggaatttttttggtggtggggaggagacgagcgagctaggctggacaaaggcaggggcaggcagcgctgtggattgaaaaacagtgattaatttctatgtcttgggctctgctcgatgaagagggcggtaacgaccagggacagggagtgatctctgcctccacatctcggtgacgcatcgacataaacctctacagccgccttgaaccgtttgggctaggctgctagggttattgcccccggaatgaataaattgtggattacaccctctgttaactgtaaaattacaatagtatcatgaattccttttttttttcagagttgcccctctactacacctagtacactcgttacccccttagtagaaatcaatctcctccttattatcctatcttatgaacggctaacattcacatgtgtactttaaaaaattcctagttaggagttagctccactattaagggctcattcagattgaggggttttgaaaggattctcatgagagactgttgacagaaaacttttcctttcctcccatttggtggctcaaaacggtcataagataaatgaaggaagttttgggcattatctaaaaaaaatgaaggaatatttcatttgtcactgactcactgtccctggaggacaaccaagggaaaaaaaatctgcccaaatctcatgtgaaaaattctatgcaccacaccaccgacgagatcaatcttctttctttgctcactgaccatgtgacagtgctagggcccagttgtcagctggttttaaatttgtttgtcggttatttatgttgcattccttcaaaaaccattcttatgttttttcaaccatccaaacgcccatcccacaattttttttcgaatgcgcaaaagaattgcacgtcaatatattaaaagaaaagagttatagttacaccacgtaatcaacaagaccggcctatgccaggggaaaggaggaaaagcaaaaaaaaagaaaaaaaaactgaagcttagaaaaaactatggcggctaaaacaaaactctaaacatcgggaagggactgagccacgctatactcccaacaagtccccaaaagcggcaacgccagctaacgatcatagacagacctccgagtggatcaactccagaaccactgagatagaagagagctcagagtcgaaaaccctagcgtttcgctcctcccgcaactgccaagaccgtcccacaaaattcctatatcatcagatcctctgttttatctacgcgttcctatcaaattcctttgtttttctcattccttcatttttccaatcacgtattccggacaaaggcctaaacctgctctgatcgagatagaggacgaaagattatagccctcctgaatcctatgcacgcggtggtggtgtgtgtacaggcgctcacgcgcggcggcgcgcggcgcacacgaaacgcgcggggcgtgtgggcaattggcaaagcagcccgcagcagcaagatccactaggcgtgacgcgggcatgggcgtcggcgtggcagggaaagcgggcgtacgcgcgtataaaaatgaggcaccaccccgagacggaaggaaaggaaaggagcggaggcgagcgacgacacgcgcgcgacaaaatatagcagtttagcaatcagccaaaattaattaaggaagggggaggaggaggattacgttgccctcctcgccgctaaaccaaccagattagctgccgggaattatttcatcccggcgagacccttccgcccgctagctcccgcgcgcgctgttccggccgccgccgagctggtcggagtcggaggcgaccgccgatagccctgccggcgagagatcgatcgatcggcgtcgccgatccgacatatccaatggtacgtgtgttcatccaaatgcgcatatatatatatatatatatatgctctatctatctttcggcgatgaattcgccgccgtccggccacgcgccgccgtggtcgcgcggcggcggccttcgatgagattccgatcgatggttctttcgacgacggcgacgccgatcgacatgcatatgcctgccacgccacttggcactagctagctccatctatcgattctttcttttctttctccctgctttttgcaatttgcatgccctctctcttccgtctccctttccgttctcgcttttggccttcgttactttcaaatctcttgacatgcaaatgcattgaaaaaaaacatattctcaaacttcataactcatcaggtccatatgtcagcgacccacgttaaaaaattgcattcgaatcgaccgacctctcttactgcaagctctccatttttctcaccgtcaaccacacaagatagcacatgacggctacagatcgaaagcttacacgaatatatccattctgaaagaagaagaagaaaaaagaggcatcggttaatttgcttttcgttgcagaaaagaaaccaggcgtacgcaactacgcatacatacatgtcggcctcgatccacactccaaaacggaatatatttctttttcccctccttgtttttcttggcccgattggccggccattgcatcgctgacctcttctccacccttgttgataatttgatttataatcgagtcgtcgttctcgccaattggccggcgacaccttcagctacctcttagattcctttcctctcatcgttttctaaaatcacacgtctacatatatagtaccgaaagaaaaaaaacaattaaaaagttcagataaacatattctgtcacctactgctaataataatgggaatattatactacgtcgtgttgtacagaaaaattcgatcttggtcagttggtcagacgtttcgcgtccttttctcccctcccactacctcccgttcgttgtaatttagctcatttcttcgcgttgccgatttggaaattggaagtttcacacgcagcatcgcttgttcttgttcttaattggttatctgactgcgacactacgtacaataataattaaggtagtagtagcagcatatttttttttcacttgtgtgatttaattcgtctccttgcatttttctggttctctgttgctgttgttctcttgtgccagcctttcgttttcctctgtttgcttcgatcgatctgaaactctcccatagttttactcgtctctgtctgacaaaattactactgtagattaattactcttttgtattaatatcatattttgcatcgaagcatgcaactggggttgcttggtcattttctgagcccgtgactgacgacgagacgaacaaaaacctcaccgtccagctctcgccaatcgatgctgatgcaggttgagtcggggagcgaggcggcggcggcgacggcggcggcggtgctgacggcgccgctgtccctggagggcggcctcgcggcggagctccggccggcgaacctcgtgcagcgcgtgctcagcctcttccgcaacgtccgacccggctccgatctctctcactttcaggtaccaaatcatcaaactgaaactgatccccagctcagctgctagccattcttgatcctagctaggcatagcattgtgtgattaattgtgtgcatgcatttgaaactccaatctcgagagtgtttaaatttggatttactactagttaatctaatcacttcaggtcaggagcattatatcaccctgaaatcagcaatgattttggggagggagtgactagctagtggagtagtgtactctactccactaattaatcatgaggattagtttttgcttgtgggatatgaggagtagtagtaggtgttgagtaaaccaagagaacaagcttcaatacttttaagagaaaacaaaacaagcttcaatagttgaacaacacttccttgctcacttttataaggagtattttgatttcgagaaagtcaaatgaactttgaatattttggctaacgacggttagtaataatacaactatatttggtgcataaaagttgtgcctatatatttgtatttcaaatcaggagctttcacataatactgctctactaattaatcatgtggattagtctttgtttgtgggaaatgaggagtagtaggtgttgagcgaacaaaaaaacaagctgacttttcaaaaaataaaatcaacacaagcttcaagagttgaatagtattgctacttgcgtagttgcatatgtaagcatgatgaacggcatagtccatgggggcacgcctgtttttcaacaaaaggaactcaaatttcggatgtggattcgtgattgcttagtttgacagctttcggtttctcagtaggggataaatgttaactaatgtggtcaacactttcagtttcctggcacctagcctaatcaattactatcatctaatcagtcactgtctagcagtaatttcgcagtcaaaatgacgttaatttgactgaattttttcatctgaatttgtctgaatttttgtcatcatcagctgcctgctacgttcaacctgccgaagtcgcagctccagttatacggcgagggagtgtactgcgtcggaaaagactacctgcggcggtgcgcgaaggggagcgacgccgtcgagcggttcgcggcggtcgtcggctggagcatctcgacgacgaggcctcccatcttcggcttcgcgccgtacaaccccgttcttggagagacccaccatgtctccagcggatcactccatgttcttctcgagcaggtgattcatcacaatgtcatgcgttaaatttgtagtttcgcgataaatttggtgttaaaatatgtagccatgtatctgtagttttgtgaaatttacagatgatttgtttctgaatctctgacagaaaattgtggtctttttcaggtgtctcatcgtcctccggtctctgcactgcatgccactgacgatgacggtgagatcgagctcgtctggtgccaaaacccaatcccgaaattccacggtacgtaggccagattcagaatgaaattctactccatttcctgcccatcaatttccaagtttcagagtctgaaattctactccatttcctgctcatttctgaaggcacaagcgtggaagcgacagtgaaaggcatgaggcacgtcaagcttctgaaattcagcgagaattacgagatcgactgcccaaacctgctcatcaggttgctgcctgctccatcagcggagtggtctgggacagtcaggatcgtctgcaaggagtccgagctcgaagcagagttgatctactacaggagcaacgctttcctgggactaggtggcgatccaagatgtgttaagggtaagatattcagctcaagatcaggagagatcatctgcgagattgatggacattgggatcggatcgtgtcggcgaaggatgcgaagaccgggaaggtgtcggttctgtacgatgctgaatccgccattgctgacctcaagacacctgtggtcagaaaccaagaggtaacttctttctgacaatttgtgctcacaagaaatctgaactttgtgcattttttcatgctgcaagttcagatggcagtatcccagagataaaattcagactaagtccacatatgattcaattcaacaactgcaacgtacaaactaagcaggaaaaaagaaaaaaatatcactgaattaggaaccaaagatgtactaacttatgaaaacctcactgaccattgttaccctaccaattatgttcacaagaactctgaactttggccatgtagataaaattcagtctaactgatttcattttcagtcgttcaacaaaactttaacctacaaactaagcagaaaatcagtgaccaatactgaatttgtcatgattgtgtttcagggcgtgtcaccttcagaatctgtggtggtttggggcgaggtgagcgatgccatcctgaagaaagactgggagagatctagtcaggcgaagcgacgagtggaggacacggcgaggaggctagacagagagaggaacgacaagggagaggtctggattcccaagcatttctcgctgtctcaggacaagaacggcagctgggaatgctcgccgctggagaaatctgtgcctccagctccgatcattgtcccctcatgactgtagattacatgtaacagatgatcctatatatactatataaatctataacatagctgatgatttgattttttttaacttgtcaagtgaagtatggccgattctttgcgtttttatagttttcttcaataacagaattatctcaaacagtagctactcataagatcgggccgcatgacatagcctaagattggttgagctacaaccggtaagcggtagaaatatgaaaaaaacgatcatagtaatttatagggaaaacttttatatttatattatgaacggtctaaaatacaatggtagattacactaaattcggaaaatagactatgatgaaaaatcacaagatcagctttaaaaacaagtttaaaaaataaaaaaaattagctgcgacgatgagagcatacacagtggcaaatcatcgatctccgctgaaacagttagggagcaatttttttttcacaaatatgtgctatatttttcatttcttgtaatctatctacataatttcttccccacttgttaattaagttagcagtgggagaaacatctaggagtaatttgtaagcaagttttacaactgctatacatacacgaggagttctgaacttctgattactattgtcagtgtcagaaaatcctacaataactcttgcttgaaatggaacaagagcaatgcaggtagcagcagcagcagagaccacagctggttgtgccgcgtgctcgccgccgacgatgacggcatcatccgcttgctcgccgacgacggcatcgtcatccacgccggctgatcggcgctcccggcaccattgatgtcctccgtcggaggcggctggtagctgattatcccggcgccattgttgccagccggaggaggtgtgctgcctccggcgccgttctggccattggccggcgacggcgagctaatcagcggagtgacaccggaggtgttcgacctgtgcagaccatgggcaaaagatcgtcggaatgtgagtgttgagatgcgagctactcccttcgttttatattataagactttttcgaattgtccatattcatataaatgttaataaatctagatacatatatatgtctagattcattaacatatatatgaatcatgaatgtgggcaatcatataaagtctcataatatgaaacggaggaagtagttgaaaagagagaaataaatggttgatgaattggggttggttacccggtgggagggaggcagaaggcgatggtgtaggcggcggcgctgcaggtgaaggtgctcgtgccgtcgtcgtaggcgtagctgtaggcgcgcgggcacgccgtcttgaagatggccgagtacgccgtcggccggcacgtcgccggcgtcgcgtacgcgccgctgcagcagtactcctcctccccgaacgcctcgcacgcgctccggcacgccaccgtcccgctgccgccgccgccgtcgacgccgtccacctgcaactccttcggacacgctgcagatatatgctcacgtcagcgcaaacacgtacgacacgcgtgcatggatgcgcgacacgtacagcggttgaggtcggccgtgcagccggtggtggcgcagccgccgccgccgccggtggcgccgccggcctgcgggacggcgacgacggggaggttgtagccgtcgacgaggctcacgtcgtagtagtccaggtcaccggcgccggcgccgccgccgaccttccccagcgtgacctcgaacagcgtcgccggcggcgtggcgcccgtgccgccgcactccaagcggccgccgcagtcgccggtctggcacgcggcggcgccagcggcagcggcggcggcggcgccgccggcgccggagaagtcgcacccggtgcgcgcccatatccggccggaccaccccgccggcgccgggacctgcacgctctgccccgggtcgagcctgaaccccgtcgtggccagctgcggcgtgccggcgccggccagcgtcgccggccatatcgtctgggcgcagtggttggatatcgtgaagctacagctcgccgccattgacgagctccaccactgcgccactagtgcgagcacaaagatcacacacgctggagctctccaacttcttggtgcttccatggcgtgtagcctagctagctaagctaaagtctctagatgagagagacttgccactgttcttggttttggagggaaatgatttgagagatttgagacatggatggagactttaaactgattggagtttgtttgagatgtgaaagaaagggtttcttggtgagattgatttagcattttgcattttgcatgtatgaggtggcctcattgagaagatataccttatgtaacaatggaagggataaaggtgaaaatgaaattaggagatgactaacagttttattgtacttggtgagtgtgtataccttcagctgttgactacatatgctttgtttcatcagccttaaccaattctcattgtccatataaataccatttatacagcctaaaatactatgttttatgtgaagtatacataaatgataaatgatacaatgcagtgtgaaataagttagggcattcaaattagatcaactagtgcaatttaatatttatgtaccagtctcacactcctatttgtgagaatatcctatgattatccctgaacagtgcttccaaggggacaattttggctatgcattagtaagaagcaagaactacaagaaaggtatcaatttctcacatctaattatactgcatacaaatctaaaaaaattcatcagtataaaactacagactaggtatccaaaaaatatgcctaattctaccgctgtagatccagaaaataaacataccatctttcctaacagattggataaaggatagcttccagttgggtatcacaaataaagaataaccatccagggacaatgaactttatgcttcagagaaaatacgtgcaactactctgctactataggatctatcacacacaaaatgatctcctaagatattagcacatacccagcacaacccttgctaacttcttcctgtgccttactctacccttgtcccttgaagaagccaacaagtgaataaagaccgagagaaatataatgcatgcaagtttgtaaaattcattggaacacaacatacaaattttatcaaaaagaacaactcatgtttccaggttcgtgttcctgagaatagatgacaggagcatagatcaataaagccggtcagcaagaaaggtcacaacatactagtcacaggctcaaacacccatcagaaaggccacaaacagtactttttaatcttgcaaaaccacacaatatgctaaaacagatatatcatcatgcctcatctatgctgtctcctcgttaggtgctccatcaccactcttgggagtatgagaatcatcaacaactgtgacaccctcaaggtctaaggggcgcccagtcatgggatcaataggacgtctgtcgcgaggcccacccttgtgggccatagctagcattggaggtggaggtagaattccagcacggtagaggatgcgctccacaggatccgatggctgtgctccaactgatagccaatacctgatccagggcaatagtggcagatgatgaactttggacagtgtcaatgaagaatgctgaaggatgcactcgaatggtaatgcgtcaattaagcaattagacaacacaaaagatcgaattcaggccctatggctatcagacatcaataggataaaaatgataataaaaacttcacactcattgctatgactaatgccaagttgcttaatttgcaaatataaggaattgcatcatacaaaagtaacaaaacagcttctttctgcataaatctatgagaaaatctaaatagagaatgaaacccccattttttagaatcaacaagacatgcataaaaaaaaactgtctgttatttaccagaaactactggaattttttttagactggtagaaactactgtaattacattatgtcaaaataattattgctagtaatactctagatattgaagattatgcgttcatcctaaagggctaaggcaatatttaggtagatcttgatttgagatttttagtagcaacaaaggatgagtaaattagttgcactttgatctttctatgcttcaagctgtcaacaaaattacaggcattaacaccgatgactagctggatagttgcttcattgaaaaccaacaaaaaagaaaattacgagctgacaataacccaatttcagattgttctgacatgactatgaaccatggtgttcgtttatgatcggttactgtaacaaggataaacactgaaagtatactcacttcacccggtcgaattttaaccccattctcttgccaccatccttccctgcaaaacagccaaatagaatcaccacacttatcatcaaattaacattacacccttcaaactccctattcatcccaagacaccatcaattattgaactacaaacatcccaacatttccaaggcaggtggctctcccccccaagaagacacgacgctggatgaggattccggaagagaagatcacggcaagaggagaatcaaggccaaaggaggagagggtgccgtaccggggagcgggtcgtagtagccgaggacctcgaggtgcttgccgtcgcgcggggagcggctgtcggcggccatgagccggtagaagggcctgttccggcagccgaaccgcgccagcctgatccggacaaccatctccccgccctctccacaccaactcctccgccggcgaccggccggcgctcgccgccgctctgagtctcagaaaaaggcgagggttttaggagaggagagagagagagaggaactggaggtagacgaaagggcaggtatatgggccttttttgggctttttttagcaagttggtccatgattttagagaggtgggcctcttagcaagatagggcttgttgggctttttagcgagatggtcggtaatgggcttgttacttttgttgtgtgggccgtaatgggcttttttagagagatgggcctcgttggtctcactccagctattctcgccgcgttcctcccgcctcatcgccgtatttggacttggaaggagctcactgacctccgcctgccgcgcgtgtggctccagctccgccgccgcggtcgcccgccgctcctcctcgtcggcgagcacagagaggaggttgccttgcttccccgtcaccggcttcctccccacccatcggccggcggcgccgtcctgcccggagccccagagagaagaagagtgagagagaagaggatggaagaaattctctatgctggctgaagcagttcaattgctacaacagcaatccctgccgatcaagtcctatttttccttctagtacctctttatactctggtttttattcagttctcttttcattgttggacttgttcatctactttgttcttcattttctttttattttccttttttttttacagttgcagttcctgctttatttttttccccatgtcttgttttatgtatggatgtctttggtatggtaggtgttgtgtttgctgccaaacttgtcactagaatacgagagaaatgcatgcgtacaagttttggtattggtttacacggggtatttggattaacctcttactaaaatattggccctactaaattttgatagaaaagcgaacaaaattaactggctctaatataaatattaggggatcccaaatattggagtgcttctaatatcctagcaatttccttaagctagggctggtataagcagtaaatggcttatgagcgacttaaaagtaatttgtgggtaatttttttattgatatgttcttaatgatttagaagctaataccaaaaaataaattacaacaaaagaccctaaaatcagcttcaaattaaatttcaaaatttaaatttcgacgatggctaataagctgatacgcatattctcatgctggcttcctttctggcttttgcggtttggcctgacttcaccatggaccatcctgggagctgcttctggaagttcaatcactcatcgtcagagatcgatcagagatttgatgatctgtctcatctccctccctgtttgcatactgttgctcacgcctgacgccacacaccaccgaccatgcactgaacagttaacgcgggagctttatgtcacagcgacagtgtcactgaataatttgcagctaattttacatttactattttagagattatcgatgccaagaaacaactcaacagaatctctgctcaaattaactgattattttactactagggctgtgtttagttggatccaaagtttaaattttggttgaaattggagatgatgtgactgaaaagttgtatgtatatgacaggtggatgtgatggaaaagaactgaagtttggatccaaactttggatataaagacagcctagcatagttagcatggagtgccagcagatggatgattcttgtatagtttcctggttcactctaatttcagtctgtcagaatttgatttctacgatttacatgagagagagatcacattgtttcctctgaaaattttgcttctatcagctgctcactagaccaagatacaaaaaaacaagatgcagctagtagtattattgagtagcaattcatttttttttttggaatgagtagcaggtcgcaattaaggaataactaaatagataatccaccaattggtgtctgctgttcagctgcacgatgctaggtacatgcccccacatggcagggaataattcgagatttatatctgctactgcaacttagagacaaataatatgagccatacaaaaatgcagtagagttgtaccaattaatggagcaatatattcaagcctgcctaaatagataggggcttttaactatttgccacttttagatttagcaaataactatttgccacccctatctttataacatgtgagtccatatgtgtctataatatgtgggtccagtggcaaaaagttaattgacacatctaaatgtgccaaatggttaaatatctcaaatagatatgttcgaatattagttagttggacctaggagtagtagatcactagttctcctacaccacatccatttaatctggcactttaatcttgtcttttattagttttttaaaggaaaagagaaaaaaaaatcttgtcgtttggaataattatgatatgccatcaaaatacaataatgtatactactactacatacattaagactgatgttcatgcatgtgacacgtttccctccctttgcattgtgtacacaaattaattaaactcctttttctgttgcataattctttacacgtatttatgtgatgacgtccaagctgatttgtcgctaattacatctttaattgctaactagttttactagtagtacaatgagattaattgttgtctccttctcttgatgacgatgtccatttcaaaatgcaagctgtaagaaggcgattttatggttgtaaatttatgtcagtttgtgaggtttcagctgataaagaagtgattagtctgatatgaatgttgaggtacgtaagcatctgcatggttgcttcttgcttgctgtggatggatgcttcttgcttatcctttcaattttttgcaattctgcctgcagagaattttattcttgttgctttcatgcactcccgccacacctttttatatcttccaaattcagattatgtgaatgtaagaaaaatcttcagtcacccttgatgcttcaaagttactagtgattagttactgcaattttctgttctgaatgatgaggctccattccatgaggttacttcattttggctttgtttaatttaaggcccggttttgatttagattattaaacatattattgccattgatttaaaataagtggtctaagcaatataataagaaaatataaggaaaatggtttttcgaagcgtggagcaaatatctagccatttttgtgaaattgttaggctggagctctatagtgaattgaacgagaaaattgacattgtgccatcgtcaaaagtggttttcgcccaaatgccactatcaacacatggttacacgctaaaatactatctaggaccaaattaccctcctctcctcttcttcctccctccaacatcattagctctcgccggcggcaacaatgccaccatcggcagcggcgtgggcaggatggcaacggccacatctgcctctgcctcctccgccgcggcgttcggcgccaaaaccccacgcctgggcccgagcccgagccccatatccacattcgcgaggcctcctctcgcgcctcggccgccggcaggctccacgccagcctccacctcgacggcgcgagcgggagtgcgagcgccacgggcagtagcagccggagacgatgtcgtagccgcgccgcggccgctccgcctcgcgctcctcctcgggatcctcctctcgctcgcagtcccgcttcgtctcctcgggctccggctcgtcccgattgcgctcccactcctactccttctcgtcgtcgtcgtccccttcacggagccgctccccacccgctgccaaggccaggtgacatcccccgcctctcccccacccccacgataccatctgcttgtcctgcgcaatcgattgtgccgtcaacggtgcaatgtggccgccggcgagagctgatagtgatggagggaggaagaagaggagaagagggcgatttggtccgaggtaatattttagcgtgtaaccgtgtattgacagtggtattttatcgaatccattttgtagggtggtatttgggcaaaacccacttttaatgatggcataatgttaattttctcgaattgaacggacagtgcaatggtccactcaatttgttccacatttggcttaattttgttttatcgtttaacgaaaatgaaatatggccataacttggtgacattgggacaatttcttctactttggtcggcttctttacattttctccctgctcataatgtaacacctactactcataatgcccatatatacaactgaagcaagcaaacctgaaatcatgcctgtctctgcatcaccaaatcttctgaaatctaagctgcaaattaacttgccgtggcaagaagttctgatagttacatcactcaatataactttgctttgcctttttgtagctgtgttaccagcagatcagaaaacccaaaattaaccacaaattaattcatcatggttttcatttagccacaacacagcattgcttagtcggtagcagaaagcgaccagtgacaaaactggagaccatgaaactgtgcctgtatttggagctaagctgctaataattattggcaccatcactcgctgattaaaaagtcctaagtgccggtgtgatgtgaggctgccattggcttgaaacacaagcaaaaatggactctgaccaaacctgtctgcttgcttggccgcctagcttgtcgtcagggcataaaccaccaccgaccgctaggtaatcaagcataaaatatattaaattttatacttcatcagttagggaatacgcaaaagatttatacatatttcattataaaatatattatggatgtatctctagtaccttccaatcgccgaaaaaaatgtctcttctgtagcaatcattggagatggattaatcagtaaccaaacttgtcgagtgaaataatgtagtcggccgtatagttaatttaaccccgccaaacgggaaaaaaatactttatttagtcgctacatagaaatagcgatgatgtatctctagtacctccaaattgccgaaaaatgtctcttttgtaccagtgaatgggagatggattgatttgtaacagattgtgcaacttcgaattttttttgtaaaatagatatatggtggttttttgggtttaaagaaacaatttggagagagttgcacatgcatatatggttaaggatatgccacttagtttggagtatatgcacctggcacaaattctttttctgattgagaggatcacgaggaaataattcaacaagacgagaattatatattggagtgttggatctaactatgcaaacacaataagataaacaaataattgcactagaaatagtagtgcagtgcacatgactagtagtagtactacttgctgtgaaacgagtgctaaagagtactcctactgtctgaaaaaacattccatgcctattgactgtttgacagatgtacttacaccacaatttggtcagatcgatttatctaaggaccattgatccacaagccatcaaccatagtaccatacataaattaagttgcaaaagatattaactaatattttggaaaatgtttctaatcatgcttcttaacactgaaattcacaagagttggtgtcagtatatgaaaaaggagttgcactttttatgtgacatatttttcagtcgatcaataattggagcttagaaaactacgtactgcgtctgtatctgtccttgctgaaactgaatgccactggcattttcggagaaagctcaacatggagccaaatgttcagcccagcatgtacacgtttgcaaacagtcactgccaagctggaccttgctgaattatcataagcagacatggaagaaaatgtgagtgatccgaaatgaaatgttcagatgtgcagccagtaggatacttcgttgaaacacccaaggttactacttaggaaaatacatgacgcatgttttgttaggataagactttaaataaataattactatattatgatataatgttgttagattcgtatttaaaagtacttattcatgattatacttttgtgtcatataatatattacgtaggataattatttgtcaaaatcttatcctaaaaaaataaaatacatctcataataaaaaaaaacaggggtggcactgtcaattcagagacatacaacttcctcactcgaattctaattaagtttccctatcttgatagccaaccgagctaataatactactagccagtagcaccccaatagtgttagtattcatattcaattagaataaattcgcaatttggtggctataacacacaatcgtttaccgaatctaaactaattaaacagggtccatgtcgtcaggctcgaccggatcgataaacacgcgctagtttaccaattttttttttaaaaccaaatacatacatatatacgatccattccttgcagctgatgcatcatccattcttataatcttaattagttaaaaagatttatccaaatgcttaaccaagaaattaattaagcagtgccatgtcatcatcttatcacatggtaaatcacaatcatcatcttgtaaatcagtacatcttgtggaaggagagaagtaaaacgattgcttcctgctactacatcttacgtatgtgataaaatccttaattatccgtgcatttacttgcacgagaggaacagaaagctattactaatcatggtgattactgcgtgtcgcgatcagtaatgagctggagaacggaaacgtaccgggacttgctgctgtcactgtcgctaataccgaagagaatacgtattttgtctcgtggttttagctaactacagtgcaagaacattcttaggcagagatcgtgtggctctcagacttggtgatgagattagcaggtaatctagaccgttgatttgatcctaattaagctactagttctggggaaatttaagcatatgccaaggtgctagtcaatggatgcttagcttgttgggtatatggtggtatacaatatacatcatgaatttaataaacatgagaagttatcctggttattgttgaaccatttgccaaaaaaaaactttaaaaatatgagctattttgttatggacttatgatgccattagaagcaagctgaaattaactctacagattgctgtagcatgcaagaaatcttcagttcgttttcgacgtcaactgcagagacagtaatgtataaactaccagagccaatgctgctaagtaacttgctactgtacgtgctagagaaattgtcagaagaattatgacgccatgtcgccacatatatatttgttcttataacttaattaatttcctttggaaattgagcacactattccttctgaaagcatctcagaatcagatggaaatatttaagctcatttgttaacattaaactgtattgcattgatcgcacatcacatatactgagagactttgtggtgttcttataattatatgttaggaagaaaatttctaactaatttgtggacaccatttaatatttccaagaaatgaatttaaagtggatatgattaaataagaacaaccagtcaagcaaaagtaaatgatgtttattactagggttctatttcacataaattgtctcatatatgctccattaaacacctagcagaatgatcaaaaaaatgcgcatgtttcccaaacttctaaatagtgtgatttttatttgtacataacttttttatattttttggataataatttaaattcatttttaattttataatattttattcgtctataccctcaaataattatcataaattattcaacaatcaaccaataaaaaaacaaccccttaattaatcaatcggaaaatagtgatctttgccactggtgttttatttcacatgcattatatatgtgaaaaaatgtacaatatgcgacataatggtattcctactatgaagaacttaatgtttttgacatgtaaaactttcatagttcgtttttgtccatatatttttaccacagaccatgaaatatcacacatatatatacacgtctatacccacacgttgattaatgcgaggaatttcttttgtttacaactagtcgaatacaagtcttaaaaattcatagaccaaagggtatggactcaacattcaatgcttcatctccacaaaaatagtccacaaagcaacaacatcaccaccacatcatccctctaccctacctccccacatctcatccatgcattatgttcccttcacaacctaacacaaaacaaaaccattcaatttctatagaaaccacacaaacatgtttacaataataatcaaacaatactaataaacaaataaataagatttacataggaacaaaaaatgaagccaataagctagcccaccaagccaatcactcactcaccaaggtctcccactcctagtcatcatcatcatcatctccctaactaaaaccacacctcccctcaccactatagaacaaaatccccagcctctctctctagattctctctcctaataaaagagagaaaaaaaacccaagaaaaataagagagagaaactctctctctctcatcacccacccaaccaagccaccccctctctctcttccttgcaagcatccatctcatcaaaggccaaaccctcctcctctccccaacaagaacaacaaggaggcgcgattcacgcgaacaatcacaggagggggagagaaggggagaaatcatccgctcatctcccaaaatcctccaaaaaaatccatctttatcccgaaaagatcctccttttcttggggtttctgacaggcgtgcacggctatctttaggcgttctcggcctcatctctcgtggaaaggttcttcttcttcggggttgtttgctgctgcttaatttgaggaggaaaagcccaattcttgtggggagtgaagggagggaggaggggggcatggcggaggagggggaggagaggcggcggttctcgaatcttcgcggcgtccggtggcgggtcgatctcggcatcctgccggcttcgccgggggcgtcggtggacgagcaccgccgcgccgccgccgattcgcggaggaggtgaggctcatgctgcttgtgatgccccgtgttttgcgattctgtgccatgtgcggtttgttcttgggttcgttgatctctgcttagtcgatgttgttatcgattcccctatttttggtttggttcttgtgtttgtgtggtataaaaggtttttgttttcacttcccagatggttttgattggcatgaatttctggcttggtttgaggagaaaccatgcaatcgtgatttgtttagtgtcataacttagcatgaaataatttgtatgttggtaatcttttgtttgtgatggtgttgtgtgcacatggtgatatctccatacttgattcatgagatggaattggtggagaaatttctgctgaccttgtcaattagacaaatttgtcatttttatatgattggagcattggtccttcttattcctttcatctatatatatttatttaacatctgatttgtttgcagatatgttagtttgagacgacgtcttctggtagaccctcatgttccgaaggaggagggcagatcatcaaacctcattgtcgacaacccgctatctcagaaccctggtattgatacaagcatgaatttatgatgatgagatgctaagcttaagatttggtcgatgatatgttagaatttagaacatttatgcacttgtttcctaccttcttatttggtggtgaaagtcttcaaatccttgcatgatctataaagagtaaattcccatagatagtgtggagttatcgtcatagatcgggataatgatgtattagaacatggatgcacttgtttcacacctgcttatttagctgcgtgagaatctttaaacatctgcatgatcattattcattaatgctgatgaacaaccataagttgatgcccgcttatcagcatagatgtttattgcttaagttaatgctctatatgtgttagtaattattcaacatccctctgtagatagtagctggggtcggtttttcagaggcgcggagttggaaaaaaccgtagatcaagatttgtctcgtttatatcctgaagatggaagttactttcaaacgcctacttgtcaggccatgctgcgtcgaatactattgatgtggtgccttcagcacccagaacatggataccgccaaggtaaggaactccttttgcatataaaatttacaatagttactaatttctcaattagagttgatcgaagtaatctgattggctctgccctccctgtcgcaaatttgaatggagctgacatcctttaatgtcatttagcttagcttgttgttagaagttcccacttatgggcatgaaaattgtaattctagaatacattgttagggcatattgataagctctgagatccttttacaagttaataggtcctgagatcctttcacaaggaaatacataaaaaaaacgttcattttgttataaggtttaaactcttgaagtgctatccacctataccatgtagtgttttcggtattgatttttttcttttaaagatgtggcattgaaattctgattacttagcatgacccaattgattatcatcatctctccaaatttgttatgattttatttgattggcatatgtggaaagacttatcgactatttttgtcacaggaatgcatgagctattggcccctctagtgtatgttcttcaagttgacattgacaaactatctcaagtacgaaaattgcatgaagattgcttcaatgatgattttgatggagttcctttcccagataccgatatggttttcagctataaacctagaaaggacccaaaatggagttttggagctgacaatcagaatgattctgaacgatcttccaaaagtaacactcttgatgagcttgatccggacacaaaagaaataattttacttagtgatgcatatggcgcggaaggcgaactaggcattgttttgtcagaaaggtttatggaacatgatgcctattctatgtttgatggtttgatggatggaggtagcggagtggtacgcatggcagagtttttctccccatcctctgttggatctagctcaaatctaccacctgttattgaagcctcatcagcattatttcatttgctctcaattgttgagccaaccctccataatcatttcattgagttgaaagtggaaccacagtggttcgcacttcgttggttgcgagtcttgtttggacgagaattctgcctcaatgatcttttggtagtatgggacaaagtttttgcttgttcaaacaatatgctgctaagtagtgatgaggaatataactttcgtatcttgtgttcagatagaggagcatttattgcagccatggcagtttctatgcttcttc

SEQ ID NO: 75133 - DNA, 1374 bp, Oryza sativa
cctgtcgctaaaagctccttcatgttggcgtcaataagagggtacctgaaagtcaccatcaacagattcagcaggtttacatgatgaattatgagttaaactgagaaaattttagaacaatttggagtactccatacccagttcgaccatctctccaagattgcaaacagtgcctgatcctggctccacttggactctacgttccttggaccccctacagtagtttaaagaggattatacctttttccagccaaatctaactattctacatatatttagctgaaataactgtgtattttcaggataaacaataaaagtgaatttcagagtgatacttctttttcatgcattatctagggacatgagagagagagttatatctttacctaggtgaaaaatggagttcccatattttgctgatatgaaccggaagtaatctctccatatcaactcaaataaaaccctgaaaacattgtcatatcaagaaagtatttcagtttcaccattgacttctaaggaagttggaaacccttaattgcaataatctataaatatttcacactccttacaaactttatagcatatgtaataactctcatttctcaaatagtataataaacgagagctgaaaaaccagagtttagaagtgataaaactctggagaaggcataccagtatgtagaatcatttgctattctctgcttctcatatctctttacctgcaccatggccaaaaatacagcatgagacaaagctactgatctccagaggttaccatgaatttattacctcttcacaaatataacgaggcgaaagactgccagaagcaagccaaggggagaacttggtggagtagtctggacctagcatgccattcctggtctctttgtagactttcagctggtctttcttccagaagtactcatgaactcttcccagagctgcactctcccctcccacgaaatgcattcccttctctgactatagagagaagcaaacagtgacagttacaacttataggtgaagttctcaaagcttatctgccaaagtggcaaagtacagttgatcactgaaaattagctcaacacagttaactgaaatcactgaacctgcctttgtcatgcttaggcctagtgactccagtgttggtactgttccccaacctccaatttcatccaggccagaaccaggaggcggcccgagtgacggtggcaacttgctacaattccgaactgaggacttagattcaacagcctggtaaaaacattttattgacagtaactatcatgccaatctaaacaatggacaacctagatgaagaaactttatgagaatatacctttctgaactgtgtatatacgtcaggcacattgt

SEQ ID NO: 75134 - DNA, 1646 bp, Oryza sativa
cgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccactgcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaacacatatccatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtagtgaactccgggggggaatcggcaaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccaatgcacccgggtcgccagcctcgtcgccactgtcgcccactccgccgtcatcgtcctcctcgtcggagttgagggctaacgcgagccgaggggccgaaccctcgaagctgtggacgatatggtcggcggcgtcccggacctgcgcgcgcgcaccgtcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgtgaggcgggcggttaagtcgctttcgcccgcggccgccccaccgctgcgcgccctcgcgtccagctccttctcccgcgcctcgagctcagtggcccgctggttcagcgtggccctctcggcgcgggcaccttccagattacggcgtgcctgctcctcccgcgctg

SEQ ID NO: 75135 - DNA, 6418 bp, Oryza sativa
tcggcctcctcgagagctcgctcccgctcggtgagcgcgtcctcgcggaggcggagcgcggactcctcttcggcacaggcggcctcgtgcgcagtcagcgttgcctcccggatggcaacggcggcctcgcgatccgccaggtccctctccacggcgcaggcacgctcttccagcgccatggcacgggcctcaagggcttcttcgcgccgccgggatgccacctcggtttccgccgcccgccgttctcgggcagcggcagcgtcaaggaccccccgggcggcgtcgagcttcttccctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaaggcctgcagaaggggttctgcgctcagtggagcaacggaaggcatggggaagagctgcctcgaagaggatgccgcgtggcttggcccgccgatggacgtgccggactcgaggatgtcccccggacctggtttgtcctgagcgtcgcacgagggagtgggcccaagcgatgcgcccgcggcctcgtcgcgagttgcctcggaagtcgtcgtcgcctcggcctggcgaagtctggcctcctcccgagcggcttctttagcttggcgagctcggacggccacctgggcagcttcctcggcttctcgaaggcgatccgcggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcggcttctcgccggtcagattcccgcctccgggcctctgtggtcgccgggtcctcggcctcagactggccggacttggaatggcgggagggacgcgacgggatctcgctgaaacagaagaaagaccagaagacaaacaagatggatgagtgaaaactcgcgttgagagaatgaatacggccacgatgggagtgggacgaacctgcgagggggtcggttaaacgaccaccttggaggggaaatgaggtttccccgggatggttctgtcccccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatgtagtcttcggacccggtgtactcccaggcgccccgggcgcgccgctggagcggcgcaatccggcgacgaaggtagtcgccgaacaccatggcccctgtgagcccctgggatcgcaggcccgccaagcggtcgaggacggcgtcatagccatctcccagatctaccggcgcccgccagctggaggcctgcgctggaggctggctcggaagtcggaggcgcgcttcgtcagcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcacaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgcagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagtacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccacgcttccactaatcccattcgcccgtttgcggtgcatgaagtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccagagccggcgtgttagctcctggagatggcacgttggtcccggtcagatatataccaggcttcatcctaaccattacaagcaagacattgtatgaagaggggcgaacatgcagattgatgaactgacacgtggtggacaagaatgaccgatttgtgaccggtctgacactggtcatgtcgtcagcagacagacatgttcccacgtcgcgcctgcttccggcggaagtggaggtaggtatgggccgttccatcagaaggccattcggacggcaaccatacaagtctctgtctgtttatgaaaagataggataagtccccacaaaaaagagagagatggtgcatgtggtatccccttgaggtataaaaggaggaccttgcccacttagaagggggattttggatttcggagggggatccagaacgatcagagagggagagagtaagagctctctggttctctagctcttttgtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcacggtctcccggtgaggagccccacgctccgtcagacaccgttgacttttaatttaacgtttgacaattcatcttatttaaaaaaatatgtaattatcttttattttattgtgacttgattcgtcatcaaatgtcatttaagcatgacataaatattttcatatttgcacaaaatttttgaaataaaatgaatagttaaacgttaataaaaagttaacagcgtcgtacattaaaatatgggaaatatggggtagtactaattaagcagattagcagaacactactggtacaactccagcagtttagcacgagcaagtggtgatcgagacctgaacttgatcgcaacgatcagaagcgcgtccgcgcgtgcactacaccacaccagctttgccgcatgtgcgtccctctccatgtcgtagctactacggtgccttttcacttattcttatgcttatcagctaaaatttaaatatttagccttaaatttaaaggtaattttaagaattttttcgccgaagtttgttttttcaatcatcgctaagaacctatgtatcgtatataaaagttttattcataatatttttttaaaatacgccgtttcgctatatggctccgtcagatgctaagctgcggcatcgagccggccggtcaccgggttcgtcggcggcagccgatcacggtgtcggccgccgcgacgacacgaccgtacaaactttgtcccgggagtggcgcgcggcgcccgacccggccggcggtggcgccattatagtaatcctgtgacagccgagattacttggctggttggaggcttggagctaattaagctctgtgtgtttggagaggagggttgattaattagcgcgtgtgatttggtttggatttgacaggcgcctacggtgtggttcagacttgagagtgttcagaccagatgcacagtcgtgtgttactcccttattccataatattaatattaaggtatggtcaaacttgacacggtctttaaaactaatctttattttataattcttataatatattataaggtttatagtaacaaaattataaccatatgaaaataaatttaaatgttaatccaataatatgatttttaacataagtaaaattcaagtcatattatactaaatgttagttaaaatattttgaaggttgaatcttaaaatatgtgagcgccctatattatggctatattatgagatggaggaagtatcggttatatcactgacttcaataaaacttccactaccttataaaaggagcatatgtaaaccatttgaccgaaatccgatgattgaaattgctccgtagatgaaaaatgaatggtaaaattaccctattagtatatttaagcattatttcttaatattacacaccactacacatataacaccacatacattattggtatggtactcaggtggtattcgtttctagtgaagatacagatgaagttatgacattaaaaaataaaattcattaacgtacgattaattaagttttgattattataaatttggaaaatggatttatctgatattttaaaacaacttctatataaataaagtttcgaacaaaatgtatagtttatctgtttgaaaaacatagtaccaaaaatcgaggtaaaatctatatcatcgtcggaaagaacgaggcatcattaagcagttacacattattagtagactgaaaatattatggtgtgtacgtgcgcctctgtactctaatactccatagaggacactgtcggctctgatctcgcctatcatgcatagacacattaattgttgaaccttatcatcaaatattacgtgatgattaagattgcttgctgttttgccatcgattatatttcttgacacgaggaagaactggcactacctgtcgaactaacctcaagcagccagtgtgagcacaaatcagctgcgaaacgaattgcaaagccagcaaagagatacagtagtactttatcaactaatctagagctctgttctgcttggcaagtcaaacatggccaacagtatgtgtgattaaactaatcaccctgcaaggaagatgtgatccatttgattaagtcaatggacaagattactttgagtaccttgctcaaaaggttctcccagccgttggctatggccgatgtgcttcattgaccctgaaagagaagaagcacctccacctcgtgaacagcacaaaatgtcggggatttctagggtattaatacggctagtacaatgccatttcgtatttttaaatagttaggctggcactacaaatatacagtagtactacttaacatgatcagtgcatatattaattgcagtatcagccaatgtttatgagagactcacggct

SEQ ID NO: 75136 - DNA, 14001 bp, Oryza sativa
cactctttaaacacatcaaaagctcgatatttgtgcttaacaaaataatgccaaactttctgcgaataatcatcaacgatagtcatcatgttacgagcaccttcaaaagatgtcttacaagcaggcccccataaatcagaatgcacataatcaagaataccttcagtagtatgtgtagatgtgttgaacttcaccctcttatgcttgccaaagatgcaatgctcacaaaatttgagcttcccgatgctttgtccatctagcaatcctcgcttgctcaattctgccaaaccaatttcactcatatgcccaagacgcatatgccaaagattagtagcatcggaattagataatgaatcagaaactactgcaacattacctaatatagttgtacctcgcagatggtatagattggcagatttaatatcagctttcatcacaacaagagagcctttagttaccttcaaaattccgtctccatcggaatatttgtaccctttgcgatcaagagtacataaagagatgagacttctcttcaaatttggaatatgccgcacatctgacaatgttctaatacagccatcaaacatctcgttctgaactgttccaatacctgcaacctcgcatggtgtatcatcacccatcaaaacagtaccaccttgaacaacttcataagtggcaaaccaatccctattcgggcacatgtgataggtgtatgcagtatcaagtatccactggtcactagtttgtgcacaaccaacataagcaacaagcaattctgcatcagacttctcatcagtaacaactgcggctttaccttcctcttctttcttaccttttggtatgtattttccggttctcttgtctttatcctgtagcttccaacactcagagatatcatgtccatctctcttacagtatttgcatgacttatacctgcctctggactttgatctcccacggtagctacttgagcttttatctcttgatttgttgtttgtgttcttctcctgttgcctgcctcgaacaaccaagccttctgcttgtgaatttgaaccttcagagggtaccatcttcttcatcttttctttggcatgcaaagcatcataaacttctttcaaagttagagtatcacggctataaagtatagtatccctgaagtttgcatatgagctaggcaatgaacacaatagaataaggcctaaatcctcttcatcatactttacctccatagactcaaggtcagcaacaatttccttgaaagcggagagatggtccatcacggactcatcatcttacaacttgtgcaaaaataacttttggcttcaggtgcatcttactggtaagatccttagtcatgcatatctgttccagcttcaaccacagcccagcggctgtctcctccttaagcacctcatgcaaaatattgttagatagatgaagatgaatatatgacatagccttacgatcccttttcttctcatcaacagaccaatcctgtgtcctcttatcaaatctagaaagcgcatcattgaggtcttgttgtgcaagaacggctcgcatcttcacttgctaaagtaagaatcttgtgtcttggtccaggagaggtagattatacttcaaactcgccatgggaattaatcctgaatttgctagtaagaaattagggtaatcctagcaaaaacgcgaaacctggtacacttctcgtgtgtctgtagcgtagatcagtaaacttcctggtacaagctttggtgcgcgtagcaattttgcctctgaaaaaacaacctaacagaagctctcggtggattggtttttcgcctcgggaaccgtgcgctgcagatggattggcttcggctgattttcttctcccgcactgctgtactgctgcttttctgacacgcgcggcaggaaggacggcgtcgactcggagttgacggcgactatgctttggattggatttcgccgaacagaatttggacggaatgacgaacacgacgacgcgtactgccgattagatcgatttcttcgatccgaaaaatcacgccggtggtcgggactgcagtagatcttcaatgttctgatactacttgttatgaaaatagatgcacaacggagacacgaattttacgtggaaaacccttgcgggaaaaaaccacgggcgccgaccggcaatgatccctatggaggagatgattacaaacgtaggggaatcataatgggaacgtcacacctttccgtatggcttacaagagtatatataggggaaatagaaagacacttaataggaatttctactaggaaactaatccgaatatattgtggacccaaaattcggatcacatatttaacaagctgtttaggaatcggcaagcggatgcggcagcgcagcgaccaagcaaggcttggtccatctgctgccaaccaaatggctaactcacatggcgaggcggagtggacatagcacaacttgccaccaagctggcatagcatgtcgttgttgctcagaaagcccctgcatggagggttgggatggacagtgaatgtttcatcgcgcaagctaaatcgaaggataacatgtgagctcaccttgctaaggccatggccggtcgtggagtggagagcgctccagtagaagaaccctgggagacagatcggagtcctagcattgataggatatggcggatctatggtcgccttccatttccaacaatcttctccatcaccaagagtcaagatctcatgtccagcccgggattctcctccgctgtgtgatgagcggaggaagtgcctagccaccttgtacttgccactccaagggtcgaacccgaaggcgaccctgtgctccagtgcaacactgtggcttcctctcggcagctcaacgaactcgctggtcgtcaggttgcacacgaagatctctcccgagacgcaagggatcaggatgaggccgtcgcagtgcagaggcatgctgaacattgggatcccacggggaaatctcttctctaggatgagctcggcaaccttgctctgccctggctggaacctgtagaaagtgacaccctgaagtttaaacttcttggggttactcagaaacatccgtggcatgacgaccatggatggcctgggcctggaatgctccaggtggcggcgcgcgaagctggtgctgattatggtggcgcgccacagcttgcacacggattggaatcgcacaaggcacttcgcgggaagtcggacgaggatttcggagaaaagtatatcatcagggataaagccaccgccggcggcggcggcggcggaagctgaccgcggcggcggcgccatcagacggcgtcgttttgggaatgggtggttctccatatggatctctcgtttgtttgtgccgattgccggcttcaatctgtgtgatcagatgattacataatcagaaaatagcacccaataattcgactcggattcagggatccactttatctaatttgactcggattcagttgatgaaccacattttcttttcgggggaaagaactaagtgttattatttacttatagtaatattaatcttatcttaatcttaactacttcgcgattttgggccgtcgtccaagttcgcacgcgacgtccacacgccccgactgcgttcgttcatgttcttcttcggttcacgcctaggcgcctagcaggcaggcaggggaagagcgggcgcacgacgtcggtgtccggtggcacaacggcggcggcagcggtgcctcgacgcgttcttggacacagcacaatggaggaaggcggcagccggcgtggggagcgagggaagagttgggaacgccggcggcgagaactcagtccagtcggaaaaaccaaactgatgtgaggtgtgagagaaggggggaaatagggaaaatggactcgccggagtgaggagatgctggtggcgagatgagacggcgagataagctctaggggaggagatcgctccgtcggggcagcggcggcggcggcggcggcgcgcacgcgtgccatgcgcgccctccggaaggaaggaggcggctggctcggctgggttgggccatgtgcgggagagaaggtcggaagggcccagaaagcaaggtgatgtcagcccaggagtgacatgactggttggaggatttcggcccaaaagaaatagaagagttttctgaatttttggagggatgattttaatggaatctaaaagaaattcaaaagaatttgtttggagataaattttaacaggtagttcatggactctatacatgtggggggaggggttggtttatttttggcaatggaagtttagaggggcttttattttgggggtattggtttaaaggaggagtatttgaataaaggaatagatatttgaatttggaggagagtctttggcaggaaaactttagaatatcattggaggcaaaaattatggaatttagataaaatgaaaaagacaaatggctaaaagagtaggttttagctaataaaaaataataaatcgggatgtttataaaattgaggaggaacttgaacaatagtatatagatgtttgtctttagaatatttttgagaatgggacttaaccaatggtgagtttggaagaaagaaacaagagcaaaggatggctaaaggaatgaatggtatatcgagaaattttttatatggggaatttggagcttattcaaaagtaaaacaaaagatttgaatagatggatttactaagagtcggccaaaaacttggttggctagtttcaaggatacaggaatttgaaatttatgcggaggtcgattggatctagatgaatttgggtaatgggaatttaataggaaataaatgtgctaataaaatagggtttcggtaaaaataaattgaaaggtttatgctactgttgcatgcctgatgacgcgaagacgacgacgaacaggccgtgccgcagcccggagattgactccttcggggaggcacgcggtgaagactcgacaagcgaaaaaaaaagcgaaacaggtgaccgtccccaggagcgagatcgctcctcccgggggcaacggaagcggaagcggtgagcggaggccttaggtcgtctgctctgataccatgttgaatagtacagggagagagaaatacagcgtaacgtggatacattgtattgagcttcaaggggccaatatacatggattacatggattcttaagtaaactcagaaatagagatggatactaatcctatcctaccataacaaatcggatacaatatgatcctatccatatactctaatagcctgcttgggaagtctctccagcagatggtccacacactcacaatggagaactacacaaacgggatcagtgaccaaaatgctgtaactgacaacttcgcaaagccaacatcaagtatagcacctgatgttctagcactctgagcggtgaactcggcatcatcttctccagcaacatcaaccccatctgagttgcctctccaagctcttgcattgagcttgagcactccatctttgtcgacgacaaccacccgccgtgagatctgaacgacgccgtcgccatcgacgggcaccggccggtcaccgtagtcgatcagcaccacttcatcagcgataccgcccatgcgtgcagcaaaccgtgcaccgaaatcgcttgagccttcggtgatcttgatttctatggttgcctccactgcttttatcgaatgtccatgtcttagagacatcctttgtatgcaagaaggcacgaataggatcgtatgcccaaaaatcgatgcttagaattctgtcctctgatggtgtttcgcctttgactttgagttgaaattcgacttcggctgtgtttagttcacaccaaaattaaaaatttggttaaaattaaaacgatgtgatggaaaagttagaagtttgtgtgtgtaagaaagttttgatgtgatggaaaagttgaaagtttgaagaattattttggaactaaacacggccttcagcacattgacgaagctgaactgcacgaacagggcctgtcagcaccaaacaagaatcctgcgtataagagcagaacagtaaataattatattgtccgttaaagaaaaaggaaattaggtatcttattatgaccatattcataaaatatttcatcaaccctgttgatttcaactagtttggtataatggcccataagagcacccataatattcagttaaggaacaagaaaagtgtagcatattgtatttctgctgttctttacatctttgggcataaggtaaatagttcctctttccctggttttcatgaacaaaaatataacacatacagcaatcactgtgaagaatatacaaaagatcgcgtaaaaaaagaatatacaaaagaaagctgtacttttcaaaaagggcatgaaatagctcaatataaataacaaatcaataaatcatatactgctgactgaatgctgtttccctcgttctaggaaatggcgctttactgtcctggttttagaactttgcagtcgattttcatcctctatcaagagagcaatgttagaaaacgataggcaaacaaacgataaaaaataatagatcaatcacaaaagacacgagatttaacgtggaaaaccctcccaaaacaggagagaaaaaaccacggacgccagccagcaaaatatcttcactatatctggcggcttacatcgccgcacgctccggcccaagcctcccagcgacgggcctccgctccactacggcagaagaaatgattttggatcacaattcaacaagcaaaatattggtcactctgtagtttgtacaacggccaataggtgaatgagataaacgctcggtggaagatagtgctttagactttgagtcctactccggtactttctacttgtagtagaaagtaatctgaaccactaatctcatttgatcaaagggtttagatcaatttctactaccacctcacttaatggtagtagaatcgtggatgggtattattgtccaagaacaaatattagtggaggggtataatcatcatctatatacaatcactggccctagccatactctctcaatctttcctcacgtcggccaaagagaatcgcgtgactcccccaaatcgcatccggagacgacgccgagtatctcctccctgccgccgcctccgccacccgatagaagtacaccaacgccgggcctcacgtgttcgtgacgatgctcctggccgtggtgctcacggcagctgtggcgctggcgctcgtcaacgccgtcaactcgcatgacttcgcagcgcacctcgccggcgtggactgccgcatggggctagctggtccagcacgatgcccagcctcgggcttcatggagctcctcatgccggcgctacatgtgattggatgcgtgctcgccgtcttagatcgcctgcatgcctgcctagtgtcgccctctcgctacacctttcgattgcatctccatgtacacgtgccagtggcagcacggcgaagtgaccaatatacatgaagtatatgtgctaagtaggattgaatttgttccgtatatggtgaacactaaaagaaaacctttctccttgttcgttcagcagataaaaatgtcaaacagaatcattttcttattgcttcaagtcacattaaggccgtgtttagttacaaaatttttcttcaaactttcaactttttcatcacatcaaaactttcctacacacacaaacttctaactttttcgtcacatcgttccaatttcaaccaaacttttaattttggtgtgaactaaacacagcctatgcatactattgctactgctactgctcgagttcatacttcagacttcaaaaaggccccaccaattcatgacctcataaaatctgatttggaccagcatattgatttaacaaccagaaaaaaaaattggacatgggcacacctgttgcctcgaacaatatttttgcagtattagaactagttcatataagttgtacagtctaggatgcactgaatgaatacagatagaaaaggattacaggcaaggctctgactagaagctgcaaaaacatctaaaacaggcaagcaccggcgaacaaagaagtactggcgagacggccgtcggcgccgccgccaccggaatgtatcggatggtgcccctacacgcggcaaaatggggcgacaaatggaggagaatgagtggggaaagaatggccgccggagtagactgccggcggtgcgaggatttgccgagcagtggagatggctgtcatcaagaggagatcgacggtggtgggaggatttgccgcagcgaatggatgcgtcgtccagtcgccgatcgagtgcctagcgagatgaatagataaaatcccaaataccaccattacccctaatcactaagtagtaatgtactaatatgcccttgtgaaccgacgattcagatcaattctacttgtagcataatactacaagtagaaagcaccggagcgtcgctattagactttaggtgtgtgtgccgcactgacaaacttctacagcacataaacatatcaccatttatcaaactagtactccctcctccgtttcaggttataagactttctaacattacccacgttcatatagatgttaatgaatctaggcacacatatatgtctagattcattaacatattgatggcttcatgcgggtggccttggacttccacagcttttcgttggcctttcttctattccggcatgcttgtggctgtgtgaggaaatggatgttgacaagctagggtgttagctttaggttttggtgtttggttgggtaattttgcaggtgttgctcgtcaattgttatcttctgtgaggtttttctctttatctgttttctcctctttgtattccccatatattctattctcctatcctccagggcccctgcgcttgcgtaggtgaagcctgccctgtgtaagatcatttggctcaatatattcaggtggggactctctcccccccggtgatttagtcaaaaaaaacatatatatgaatgtgggtaatgctagaaagtcttataatatgaaacggaggaagtacatgttatttgctaagttactgaagttttctttcagaaattagttatgaaacaatagaaatgcagctgctggaaatctgaaccgtattttggtatggcatgagattggtatggtccctcaataaaatggtgccatcaagcccttgaagtgaagaatttcgctcgttccgccattagaaggcaagaattctgcgtgtgaacctttttttttaaaggaaggcaaaagctttgtctcgtaaatattaatagagatggagaaaaaatagatcaaaaatatgtatagggtaagcctcgaaagctaaacccacaggaacccaccaaaagagattaagtgatatctcccaaaatatcgaactcttgaagcttcgaggctctagccttgacccaagctcgagcttcctccttgatcttggcaacgatggacaccggcgttgaggcggtgcttcggaagattcttgcgtttcattcgcaccaattttcccaggaaaccaagatcaccagggttcgtaaaggaatgcgggggttatcaggggagtctaccacaaggctccaccattgttccaccgagtcatagtcgctccatttgctcatttggaggtgagtttgggtccacctttgtatttctgtccagaccctctttgtaactctgcagtgtgccagaaggtggaccgctgattatacagcacagcgggtaggtcttctgattttgccaacctcttttcttgaacctgtcagctgtccagagtctattttgggtgactagctaggagaagaatttgcattttagtggggcccagcgtgtgcactttcaagtagtaactaaacagtattatctattcatcgacagcacaagagagttcagagcccattcgacttgaagtgaacatatataggttttccaagaacttgcctatgcagtgccggtgagtctctgcgcgtcgtccctgtcgcggttgaagatgaaattgctcttgtgatcaagcaaatcgcggacagcgatgaagccgaacacatggagcggccactccaatccccctctcaattcggttaccttccatgagtagatctccatgcatcgaaaggtttgtcgttgtaggtgtggctcattggccctctagtagctgcaaaattaaaaaatatatataaaaaatagataaatcgccatcagttaatcgttcctccaactccagtgcgtggaacaagaagggttgaattgaatcaatagatcaactacactggatcaaatcgcaagaagaagaaaatgtactgatatcctcgaaaccgcacacgtcggcccaaaaaagcgagaatatgaaacggtagtcgtcagggttgggctcctcgtaatctccggtccgcggcttcttcttcttcttcttctcctccgagtcgctgctgcggttgatggcggcatggttgctttccgagtctcactgttttgctgtgctgccgaccaactgcactgcaatatgccgtttgcagtcttcattttcaagagggttcttttagtttgtatgagcctttcaattacgtttctgtgcgattgtatgtgtaatgttctagcagcagtcatcgattataggttccattgtttaaatcctgctcacatagtcacatattttgatgcagaaattcagttaaaatgaatcaatgctgttatagctggctgtcttttttttatctataaagatatactaccaaattgttctttgttaattcttatttctttgccaggtttcataagcatcgactgtggatatactgcaaccccgagttacaccgatactgtggatatactgcaaccccgagttacaccgataccaacacaagtataacatatgtgggcgatgaaggttttatagaagcaggcataaaccacaatgtagaccttaacaacttgcagcagacagatcttgcacggcgatactcaaccatccgtttctttcccaatggaacgcgcaattgttacacgttcaagtccctaacaccaggtagcaagtgtaaaatcaaaggtgtttttgattattattttgtgatgaacaattggcatcggagattattggttttgttatttggaatttattcacgaagtggttttggagatgattggatttataggtgaattacaggtgctgtcattttatgtgaccggtcagacagggctctggtagctggtcagaccggcgtgtattgcgcggttagactggcgcagcccgcggtctgaccggtcgacgctgtgtcggtttcggtttcgggttgtttatttggatatccgtgattatttcatgattatgacttctagatggatactatacgtatgtaatactgttgtttgctactaatgagttaagttggagatagcttggtctcggaatatggtttctttgtttatttcatgtgtaggtgactcgatgtctcgggagagtatttgcggtgatggactgggagtcggcttggggataagacgacgtccgtggtggtcagagatcatgcgggatacttaggctagagttgatgcacgtggttgatggagattccatatggcatacgatggagttattgtgtgcgtatgggatgcggagtcgaatttggaaggagtccaaatttggtacgattggttatgtaaagtttctttcttgtactagagggtttcctaaggtgtttaggactcctagtatgagtttggtttgtggctttaggctgcctacctcgggtataaatagagggggagcttgaggcttcccggtatcgtttttgagagcaattgagttgagtttttagttagggtttcgagtttagtcgaaatttttgtaaggagtgctattggtgcactttgtaaacacagaaagaatcaataaagtcgtcatctactttaagagttattcgatttgtatttaccgggtttcggcggtctaaccgacgatataccagcggtcaaaccggtggtggcgaggcagtcagaccggcggcggcgacagcaagcggcagctgatcttggcggtcagaacggagatctaaactcggtcagaccgacggcaaccaggcggtcagaccggcagggcaacttcggtcagaccgcgatccgtcgaatttgagggtaacttttatttccgctaaaagttttcggtttttgggtataccaatcattcacccccctctggttggcttagttattgtgattcgatcctacagcaagtacttgctgagggctgcctttggctatgggaactatgataggataaacaggctccctacctttgatctctacctaggggtgaactactggacaacagtaaggattgtcaatgccagtacagcatatgtgtttgagattatcgcggtgtccccagccgactatttgcaagtttgtttggtgaactcctttcatttcagggcttgacttgaggccattccaggaaaaaatttatccaggttccaatatgacgcatgctctagtcttgctcagcttcttccgtaacacggtcaaattcgggcccaatcgctaccactttggaactgatgatcatcaaatcaggtaactattcatgcaatgctttgctatgcaatttttctttgacttatgcgtttacctgctcgatgttcttcttaatctataaggttcccagatgatccccgcgataggatatggcagaagtatgaagatgtctcagaatggacggatgtgccagataccgtcaatgggatagtccagaactctcccaacgatacatacaacgtgccatctgcagtgatgcgcagtgtatccactccgttgaatgattcaagaatggacctgtcatggagttcagattcttccatgaacgttgacattgccaccaagttctttgttgttctgtattttgctgaggtggaggccatccaagggaatgcattgcgtcaatttgatattattctggataataacacattagttagtgcattcagtccaatctccatgatgactagtgttttctcgggcattgttcaaggttctggcagtcatggcatctcccttgtggcgacatcaatctccaatcttccgcctttgattagcgcaatggagatattcgtggtgcgcccactgaatgaatcttccacttattctgaagacggtatataatatgaccttgagaactttcatatttgtttcgtctgtccacatgttactgtgagtgtcatattcgctatcaagataagattcaaactaactaatgtctatttgccatcaaaatacaaacagctatcttgttttcggtatgcagttgtttggggctggagcaccttgtgatcagaactgtatatagacattatttatcagtgctctgaaactgatgtatataacttacttacattattatggaactcaaatagttgatcttatgttaatgtatctaccattggggccaattttgaactgaattagattcagcatgcacggaatcttcattattgagtggttgattttctttctatttatctttgctatcttcagcacattctatgatgatcatccagacaaagttttctgtgaagagaaactgggcaggtgatccatgctccccggcaaccttttcatgggatgacttgaactgcagttacactccccatggtccaccaagaataactggcttgtgagttctgaatgaacaagataactcaattacatgctgtgataaaatgcatggataaaacattgagttgtagtgttcaatttatgtgatgatggtttaagtttcctgcagatatatgtcatctagtggattgactggtgaacttgatgcttcgtttggtcagctgacttagctccaacacctgtatgttttgtatagtacgatttcagactttccatgttataataatacctcttgcattactgtttagccactagtgcttgttgacttgctttttttttgaagtaatttactgcaggggaagccccca

SEQ ID NO: 75137 - DNA, 770 bp, Oryza sativa
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 75138 - DNA, 34774 bp, Oryza sativa
  unsure (1)..(34774): unsure at all n locations
cggcgccgacatgcggggcccaccggtcagcggctcgggagagagggaaaaggggcgccgcacgcgggccccactcggcagcggctcaagagggggggcggtccaccgtggaccgggaccacgcgggtggtacaccgccggtccacgggaccgacggcccagatcgcccccggggctgatcggacgggcggcggcgacccggctcagcttggctcaaggccggccgaccggccacggcgatggcgacggcgcgcacgcgcgcacgcgttgccggcaacagcaaccggcggcggaggcggcggcgcgaaggcggtggcgctaagcggcggctaggaaggagagggaggggaatagaggggagagggatgcctcaccgagagtggccggcgcggaggaagacgacggcgaacggcgacggtgaccacgggcaaacggcggcgacgggcggacgaggtccggaatgccctaagggaggaaaagagagaggttagagggagagagatgaaccacggcgatcggaaaccatggccgaaggcggcggacatggcggctctcaccgtcgcacggtgggaacggcgctccagcggcgaacctcgacggaggaggggtggacggggtggcccttgaccttgcgaacccaacggcggcgacggcgcggtgcggcggcgagcctagcggcggccggagcggcgggaaaggcggcggcgggtgggtgcacagcgcgagagcgatggggagcacgagggagttcggcgaaatggggaaaaagagagagggggcgacggcggagcttaaataggggaggggagtctcggacgtggccggtaggggcgagattccgccggccaacgtgggggagtgggagaggagagagagaggcgggattcgaaaatcgaatcccggccatctcgggcgcgggcgcgggcgggagagagaggggagtgggcgcgggaggtgcggtgcatgcgcgggcgtgaccgacgtggcccggaggaggcggaggcgtgggcgcggcggcgcgggtggggcccacctgtcggcatcccgggtgggaggagggaggcggccggcctagctgggccttggccttcggccggcccagcggaggggagaggaggaaagagaatgggccggcggcccactcgaaaagaaaagggggaaaaagaaaaaaaaagaaaaaaagggagaaaaggattttccctggaattaaaatattgcttgctcaattttaattggttaaaattatttctagggctctgaaaattccactaaaaatcctgttagtgaatttcgacatgtagaactcaaggaaaattccacatgccagattcgattattatttgtattactttcttagggttttctcttgatttgcaccggcattttcttagggttatttataaattaaattttaggcttgggaggaaaactttagggtgtgacaaacaaaaactgggaaggcttatataggagagaaaagcatgtcattctggaaagaattgatgccattgacattagagtagtagaaagcatgggtatgagtggttctgatagagaggagagaagggagcttgaaaagagactcaaatttgttattagggaagagaaactgaggtggattcaaagaagtaaagagaaggaagtattagaagggaattgtaatactaagttcttccatgctaaggcaaatgggaggaagaggaagagtcagattcatagtttggtgcatgaaggagaggtgattgaaggacaagataagttattgctttatattacaaatttttacaaagatctctttggacattcaaaggaaaataggttttcaattgatatggcaaatgtatctaaggtggcagaggaagatatgaagaagttaaccactcctgtcactttagaggaactcaaaacaatgatttttgaactaaaaaagaacaaagccctatgtccagatggattaacaggagaattttacatgtgtttttgggacttggtcaaacaggacatgattgacttgataaatgattttctcaagggtttgataaatatttatagattgaactttgtagtgattactttgattcctaaaacaaaagatgcctatcaaatacaaaaatttcgtcccatatgtctgttgaatgtaagctttaagataataactaaagtcctcatgaatagactcaacacaatcatggcatacattatctctaaatagcagacaacttttctgaaaaatcgtttcatcatggaaggagtggagatattacatgaagtgctgaattcagtacatcaaaaaaagcagagtgggatcttgtttaaagctgatttcgaaaaagcatatgataaggtggactgggtctttatctatcgaatgccgaaagcaaagggattcccagatcaatggtgtgattggagcatgaaagtgattatgggagggaatgtggccgtcaaagtgaatgagcaaattgatccttatttcaaaactcacaaagggttaaggcagggagaccccctctcccccctgctgttcaatttggcagcagaagctttgactttgttaatttagagagctgaggagaatagtctgattgaaggtttggggactagtggagataacaaaattgctgtcttgcaatatgcagatgacacaattttccttattgatgataatctggagcatgcaaaaaaatttgaagtacatcttgtgtctgtttgagcaccttaatggacttaaaattttaccaaagtgagtttttttgctttggggaagctaaggaaaaacacgtatatagcaatattntcacctgcaatgtgggtgatttacctctgaaatatttgggtattcccattgaccaaaaaagaatactaaacaaggattggaaggtggttgagaacaaaatggagcataaattgggttgttggcaaggtaagctgcaatctattggaggaaggctggtgctccttaattcaagtttaagcggtgttcttatgtacatgctctctttttatgaactaccaaaaggggtggaagataggatggattacttcaggaaaagatttctatggcaagaagatcaaagtattagaaagtaccatctagttaattggcccctaatttgttcactcagagaccaaggaggtcttggggtgattgatttagaagcaatgaacaaagctttgctgggaaagtggatatggaaattagagaatgaagagggttggtggcaagagatcattattgataaatattacaaaaacaaaccactatcaattctgaaactcaaacctggtaattcacatttttggcaagggattatggaggtgaaagatgttttctttagttcgtgcatataaaaaagtgggaaatggagaaaatactcttttttgggaagatagttggataggtggtagaccttttggccttgcaattccctgagatttataacatagccttgacaaaaaagatcaccattgcatacttgaacaaaaagggcattggttctataaaattcagaagggatttgtatggagccaaactaagagattggagaaaaattacacacagctaggaagagttggatttgaaagaaaattgtaaagacaaactttggtggaccttgtccaaagatgggaaattcactgtgaagtctttctataatgcacttaaaatgaagcaggtgaattatcctcatagaaaaaatctggaagttcaaaatacctttgaaaatcaaagtgtttctttggctctttaccaataataaaattttgacaaaagacaatcttttcaagaggggctggaggaaaggtgataataaatgtcagttttgtgataaggaagaaacaattcaacaccttttctttgtttgtcccatggctagattgatttggaatataattgcttgtgctctaaatttgaatccttttttgaacatgcaggaactgtttggttcctggattaagaatgctgacaaattcacaaaaaatctcattctggttgggatagctgctgtgatatggtctatatggaaatgtagaaataaagcttgctttgagaaaaaaaacttccaaatgatcccactgttttaattcacatggcctgcaattgggtggatgcatggtcaattttgcagaagctggaagcaagccgaagaagtttgcagctgggagccaggttgttaaaacaagtagcacatgaagtctacaactcaagacatggctggtgaggagtacacaggatcgcaggatgatgaagacagaagatggcctatgcaaattgttgcctgatgtccgttttgtgttgttttctgctcaggaagtgatatgtcccagactactcaagtaatatcagtcggtgatttgcatatttttataaagtctggagaaggccaaagaatatttcaagctccatgcagtgtaccagtgccaacagatggatcactgtatgcgatgactctggtgggtgtgttgattgtcccttctttggccttctatctagatctattgttaatcttctatgttgatcttctatctagatctattgttccgtagactctggtgggtgtgttgattgtccctcctctcctcctagggggtcttgtatttatactcataaatgtcccattgtccaagtagaactagggaaaccaatatggatacaatccgagtagtccttgtcgtttccatatagaactctggttgtctttccttatccagaactcctcctatatccgcaggttgtttccgtataggacatggtacgtggtgggtcctgccgagatttagtcaattactattaggtatgtggtatccatagccttgacacaaataagaaggctttgcgtcagtccagatactctaaaattgtgctccttacaaattgacactccaaattttttgttttgttgtactacaccaaaatattctggcaaaccgccactggacactgcatcttcattgaaatataatatgtacttaactgcggaaacgtaatgaccgggacatgtctatttttccacatatctcgcgcttaaaagaatatagtctgaaaaaaaattcaatactttcacaccctgaaattgaggcttcaattatttgacattgtggcccaatatcattaactcagcttgtcctatatcccatcatcacgagtgtcaacattatcaaagtggcaacaaatacaatgtcaaattagcaattctctcattaaaaaagaacatatgaaggccaacttcatttttggaacatattactttcttagagatttaagacaacacaatttcaagaattttagtttagaattatgtgctttggatcatacttaccagcttaaaaaaataaaacgtctaaaacagaaccaaagaacatttttaaaaaagccttatacatataagcgttcacacatatatgataataacttaaagcaccatcaataagatgcccgcgcgtgtgcgcgggcttccctcctagttgtccacaaagcacaaaaagagtcagccgatgaagcaacaagagaagtcatcacaaagcccactttgaaccgaaggaaaggccatagaacgatcctacaagtaaagcccaaaaatgtcgagtctttagggccgagttattactgaatggcatgtaccatcaatttgtcttcttgtgcagttatagaatccgattgacccgcaggccgcaggcagtggttgctcaatgcacattttgtttcagtactttatggaagcctcctcatagctacatgcctgcatttttttggtcgaatggcctagaaatctagaatcctaccctttgcgactgaagacgtgatctagctgtcgtccatctcttcgaggttagctatctaacctggtcactggtagccatggcatcaacgacgatcgacgagcttaattaattaacaaatgggatcaatatccatgcattgttgggcgttgataccatggatagtactatcaactaaagttttgctagctggtaccctctgtttcaacagaaagctcaattgttccatcattccatacgtgcacgctctagctcaagcattccactgttttccaagaacagcttgcacctacctaaccttgctacccatctgcaccctgtttcacacaattcccattcatcgctcatggatgtaacatatccacggcacacaaggacagactagcctagctagctacacatcttaattttctgttaattcatgccatcgatcgatccatcgatctggagtatatataaagacgtcacccctgcctccaatcttcacaccaaacgtaaatcccaatcaaccaagctctcaagtacgtgcttagctagctagctagccagtaactgaacatacattattcatagtgattagtgagctaataatggcgctgatccgacgccggctcctcccaattctgtcccttctcctcgccgtcaccttcctcgccggcgttgcgacggcgaagaagaccggccaactcaccgtcttctggggacgcaacaagaacgagggcacccttcgcgagacctgcgacacgggactctacaacatcgtcatcatctccttctacagcgtgttcggccatggccgctactggggcgacctctccggccacgacctccgcccaatcggcgccgacaacaagcactgccaatccaaacacatctccgtcttcctctccatcggcggcgccggcaatgattactccctcccatcctcccaatccgccgccgacgtcgccgacaacatctggaacgcgcacatggacggccgccgccccggcgtgttccgcccattcggcgacgccgccgtcgacggcatcgatttcttcatcgacaacggatcgcccgaccactaagacgagctcgccgtcaagctctacgcatacaacaaattgtaccgtgctcggacgccggtgaggctgacggcgacggtcaggtgtatgttcccggacatgaggatgacgaaggcattggacacgaagcttttcgagcgaatccatgtcaggttctacgacgacgccaagtgctcctacaaccatgggggcctcgccggcgtgatggcgcagtggagcaaatggacggcgaggtacccgaacagcgaggtttatcttggtctcgcggcggtgaacttgccggggaagaatgacaatgtgtttgtcaagcagctctactactatctgcttcccaatgtgcagaaggcgaagaattatggtgggattatgctttgggacaggttctttgacaagcagactggttacggcaaaaccgtcaagtactgggcttaatgatcagttaattacctgcttaatttcggtactaaatactatatgtgttgatttgtgcgtgtgacggtgtgagtgcaagcatgtttcagaataaaaatggttgtgtcggttctttacgtattgtatgaataaaatgggatcactgtgtaacgagatctcaagttgtttgttggtcatcaatggaataattaagtgtttatatatgcaacttgtcaaattaatgttgaccatcaattgtttgatactttttgtttgggacagaatggcactgcaaagagaatttgttttttaagtaaacagtataccctgtttcattgaataaaggaggagataaaagtatttacaggaaagaaattctgcaagacaagagactgatccttaattgaacaagctaagcaagtagatcaggaacaataagttttctatgggaattgaggagaagtcagctacctgtaagttatgttccattcagattggtccgtcagctttaatcgaggagaagtcagctacctgtgagtgcatgcatgtttcagaataaaaatggttgtgtcggttctttatgtattgtatgaataaaatgagatccctgtgtaacgagatctcaagttgtttgtttgttggtcatcaacatcaatggaataagtgtttatatatgcaacttgtcaaattaatgctgaccatcatttgtttgctagattcttgtttgggatagaatggcactgcaaagagaaattattttttttacgtaaacagtataccctgtttcattgagtaaaggagtaaaagtatttacagcaaagagaaattctgctagaatgcggcgagaaaagtggacaagagactgatccttaattgaacaagctaagcaagtagtagatcaggaacaacaagttttctatgggcatcgaggagaaatcggctacctgtaacttatgttccattcagattggtccttcagctttgattgatttgaaattctgattcgttctaaacgcggccaacctacagttttaaggtcctttttgaggtaccttacattactcctggtcaagtacaaaaaagtcttttgacttttcaattttcttaaacacgtagggataggcaagtaacgttgattgattgtttttaggtttagcgtgttgccttctcatttaacggctcaaattacaggatgacgtggttgacaaaatcattctgaaaattattccctttttggcgaaaccgctggggaacaaggctgtttggttccccgccagacttcgccacgccttggatgcggcagccacgcaaaacaggctattgtttggtttccacataagttgaggcagccacacaactttacagtcatttctgtgatagtttatgccataagtgcggtgagcttttccttcgccacaaaactgtggcagcgccacaacctggctggctaccaacggcagcgaaccaaacatcccatattcggtgcccaatcgattttgcgaacactgcatccatggcactggttttatctatcttcacatgatactaggcatactctgcttcctctgttctattttttttttcttcacgacatatgtgacaagtaatagagtattgagcttcgctcggtgctccttactggcagtataaaacaatatgaaccgttagatttataaacttttttcagtagaaatttggagggttcgatcatctaaggagaaaaaaaggccgtggagggtagaattgtaaatttgcatctctatctaagtgatgcccccaccggaatcgtggccaatgcgcctccaccgtcggtaccaacgctgaatcgcaaccgaacgatccaccgttcatttcgatggaatgaagtcgatcggatccggtgccttctattgttttattgtttcatgaagcagatcagtaaatgactaatatgtcctttcaaatgaacgatttatattatttctactggcagtataatattaccagtagggagtaccgaagcgttcctctatagtattaacatgcataccgcttggtggatccttaattgaacaagctaagcaagtagatcaggaacaacaattgatcaggaacaacaatttttctatgggaattgaggagaaatctgctttgaaacgacctgtagggttatgttcttttcagattgcttcttcagttttcattactcggaaagtgtgattcgttctaaaccaggacatcctgcagttttaagatcctttatgacttatgaggcgctttataaaacttattgtcaagtacaaaagggtcttctgagtttttaattttattgaacgcgtagggatgggcaagtaaccttgattagttgttgttagagcaggtacaatagcaggctataagccagctgcaaatatattttaagaagataaatcaggagagagaagagcaacagactatatatttgtagccagctgtagcacggactccaagacgcagtgtgtctatgacaggtgggactaggtattaatagtgtaatatgtaactattgtatgaatgagctattagattggctatagataaattggagctagtagttggctatactattgaacttgctcaagagcacccgcaatggtaaagtaaggtgctctttataaaacatgtacatctcagcaatatattagattaatagtaaatcatctcaatagtatgtctacatgggtatctatagctctctcatgcattatctcgttcatagttagtagatagctttgctctctctcttcatttaatgtcttccaagtaggaaaatatgctgacatggatctcttgtagagagtttatagataaccattgtaggtgctcttaggttgagagtgtggagattaatcatttttagagtactgcgtttttcggtgaaaccgctggggtcggtacccaaccacaaggtccacaatttgcgaacagtgcagaatggcactgatttagttattttatctctttacatgatactaggcgtgctctgtttttcctttcttcgcgggatatgtgacaagcaagcggtaatgtattaacatgcataccgcttggtgtacaaccaaggtttgcaaggattaacatttggtaaccgcacagagtcgttcaatatgctttgcctattattcaattcggtaaaactaattgaagaggcctctccaattagttttaactagagacatccacgtgctagtactttaggagttttggttgctattaatccatttagcaagtagggaaaatattcctatcatctatgcttcaaataaaattttctcttcaattactcatccgttttacaatccgattacaccgttgtgtttgtaataattaaatctttacaacaagatctcacatgattatattttgatgaaaaatcacaaattacttttatgatatgtctaaattacttttagatttcactaagttacttcttagagatataaaagtaaattcagtaaagcttaaaagtaatttatatatatattatatagaagtaacttataataaaaagaaagtaactttaattaatgacttttttcactgaacaaattatatatatatatatatatatatatatatatatatatatatatatatatatatatatatataagttacttttagatttgattaaaatacttcctatatattcataatgctctgagatgattacttttattattttttagttaattttataatttgtgctgattaatttaatttcgatctgcgggtggcgtctgccctcgccctgcccgtgccctgggagggcgatgctcgggatcctcttctcgtggttcttcgagtactcgaccatcggtgtttgtattcagattggcggcagccgctagcctggccgctcgtgctgctgcttctgcgtcggctgttgcctcctgattaaccgcggcagttctccttgccacctcggaattggttggttcaggtggtgtctcattgttagcttctttgaacgcctagtcgaggtttgtggccattgtgcgaatacgctcggcccattgtgctatctccggatttgcggcggcgtcaaagggtgtctcgttgagtatctctcgcatagtcgcgaggtgttgtgcgggtgtcccggaggttgaagccgtgtttttgccgtcattaatggcgtagactcctcttgtgttatcggactcagacgccgagtaaccgtcatcgccatctgacgtgtaggattcctgttcgtcgaaaataatggctccaacaaagcagtcggagctatattcctcttccgtcttctccgtgtcgcgtcgggcccgagtgcttctgggcgcttctcgaggtgcaacgtacttcacagccttcaggaaaaccctgcaatccaggatactatgcgccttactgttgtggattggacaccaattggcgaacatacgtgctccctcttgttgtccgttctcttccacataggccttgacgcgttgtaccgccttgtagtcttccaaagagtgcttggtggtcttatggatggcacaccaagtagtcaccttgatgcgaacttccctagccggtgcctgatatcggaaggtggcctcgggaggttgctcctttgttgtcataatagccagtgccctgtcctccgcctgggcgggaagggtcgtccacttctggttggacttcccctctgcatctgctaggttcacgaccgccggttgaccgggagtgactgtggcagtagtgcagactgggaaggcgatcgatccgacttgagtccacaccaacgttgtcggcatgggtgctgctggggcatggctggcgtagtagtcgatgtaacttggcagcatgtcgtgaggcccttgaacgccaagccccctacttggtgtgccactgtcaacggctggtatccgtagacggggtatgtagaaatcggaggaacattggcgctaatgtagtacgacatcgctggaaagctaaggcaaggattttatattggttcgggccccgagaaggtaataaccctacttccagtttatatgggattgctggtgggaaagatcccgagtacagagtacaatatgtggaaacaggaatccggcgagatcgtagtcggaagaatcgaatacaatctcgacggttttggtggctatggctacggaattatgcttctgacttctgttgtggcttgattgatccgtcctcgacccataggggtggtaatccttttataccgtgagctaccagcagtcctcgtgtaggactcggaccgtgaggcccgcacggcttaggaaagcccctatcttctacgagtaggtctccgtcttagtctcttggtatacggactccttccgtattctcctatgacttccttgtatatcttggtcttctttctgtattcgtgcaggtatacctttgcttgtactctgtatttcatttccgggtaacgaggatatcccttatccataatcctgacaaatacatatgaggcaaaacttttgccctcccttcaaaaaaaaaagaatcaaccactccagtccggtttagtagaaacaccgttcatgcaaatgaagtgcttggaaccgactgaaccggttttgccataaaccggggttaatccaaagatggttggactggcggcgtgcgaagggatgggctccatgtttagtaatgggctaaagaaggccctgtaaagtttctgaggttcggaagcgttcaacccattagaggccgcatctttgttaatatatagttggtgaaaacagccatcaccgggtttacaatcctgcgcatgtgatggccggatagatgtaacaaacatactccctccggacactaatacatgacgtttcggatagctaatttacatagaaatcaagcaaaaaaaattgtcgaaaacaacatctatagaaatatggagggagtacaataaactcctatagtgaagctagaagatctaatccatccgggccaagtctcatatgcacacacatatactccctccttccacaaatacttaacgtttttgagctaaccaacgtcaagtaaataaaaccggagggagtacatatataagatcacaaactatattctaacaggcccaacatggcctaaaatagtcccacaaaggcacttttaaggcaaaaatctcccgaaatgcaacaacctatatagtttcattgaagtaaaaatatgcatatgttttgtatggtgtggttcaacatttgaactatataggcgacccggcgaaccaaccagagtgaactggttttagtccaacaacccagctgggtcaaccttcggtctagatttttccactatgcatggtaagcgctacaccggctggctccttgggtggtcggatgggcaagcctgaggatcaacatatttcttttatttgaaatttgataaaattcaatccaaatttgaaactttctgactagagattgtatgccccatgcaatatttatgagtggataagggaccggaagttgtatgccccatgcattcgcgcagagaaatgtactataattaaccacacgagggtcgcgcgcgtacgtagaaaaatacatatgtgccggagtgcgtgcgccagatccgcttctcacgcgcacgtagctagagtcgtcgcctgggagtagcaaaacatgcatatataagcataaattataagcaaaagatgattcgctatttaaacgagtgagagtgtagtaagcatgaactaactatatccggaaacattatgcactaccctcgtgacactgacatacataatctaatcaaattatgtactaccctctcgatcgatactatgcaatacataaacttatcaaattatgtaactattctcgcgacacgtacacaccaacacataaacaaatcaaagtaccaaaccatgtagcccatgccactatatatatgcatgcacatcatcgatcagattgcaaaacgaagaataacacactaacttcaccatgcaaggttcagtaggagtccatggcatcctcctcctcgccgccgccgccgtgttgacgcagtgtctcctcgccgccgccgttaatactccggtggtccagtgcgcgtcggggacgacgaaatgcaccgtgaccaacgcgttcggcgcgttcccggacgggtcaacctgccacgtggccgccgcggcgttcccggcgacggaggaggagctcgtccgtgttgtcgccggcgcggcggcgtcggggaccaagatgaaggtggccacgcggctcggccacaacttcatgaagctctcctgccccggcggcgacggcctcgtgatcagcacgaacgcgctgaaccgcgtggtgggtgtgaacgcggcgaggatggagatcacggtggagagcggcgtgacactgtctgagctcatcgacgccgcggcgcacgccggcctcgctctgccgcacgcgccctactggctcgacctcaccgtcggcggcctcctctccaccggcgcccacggcagctcggtctccggaaagggcggcgccgtgcacgagtacgtcaccggcatgagggtcgtcacgccggcgccggcgagcgaggggtacgcgaaagtccgcgtggtcaacgccggcgacccggatcttgacgcggtcaaggtctccctcggcgtcctcggtgtcatctcccaggtgacactcgcgttgcagccgttgttcaataggtcggtctcgttccgccgccgcggcgacggcgacctcgccgaacgcgccgtggcgttcgccggcgagcacgagttcggcgacgtcgtctggtacccagcccgcggcgaggccgtgttccggatcgacgaccgcgtcgccaccaccaaaaccaacacgatctcctccggcgatttccagaacgtcatccagtcgtcacggtcaacggagcagcagcagcacggagacgtgttgccgttccaggccggcatcagcgtgccgctgtcgagggcatcggcgttcatccgcgacgcgcagcggctgctcgacatgaaccccggcgcgctctgcggcggcgagaacggcggcatcctgatccgctacgtcaaggcgtcgacggcctacctcggcaagacggaggacagcgtcgagttcgacacgaccagctgccgccatgacggcgacgcggcgatgccggaggagatggagcagatggcgctgcgcaagtacggcggcgtgccgcactgggggaagaaccggaacgtggcgttcgacggcgccattgccaaattccccaaagccggcgagtttatgaaggtgaaggacgcgtacgatcccgatgggctcttctccagtgagtggagtgaccaggtgctcggcgtctccggcgccggtggtgtgaacgtggcgaggaacgggtgtggaatggaggggctgtgtgtttgttcggaggacgagcattgctcgccggagaagggatacctctgccgtccgggaatggtgtaccgtgacgcccgtgtgtgcacgccgtgtcgccggcgacgcctacgccgatgcatgatcgaactcgatcgtcagaacatgacacgtacgacggcttgtatgtacgtgtagtgtgtgtggccatgctatgcaggccgcgtgaataatgtagtagtactggcagttaaatctgcacgaatgtactgctacatgactgcaatttctagttttcaaataaaacatgtttgctcagatcagatcaatggcgtcgattttctgaacatatgtttcattttcgattcaatggaaaaaaagtagtaaaacatttcaaggctcaactcgatcgatttggttttaaaataattgtggacactgcccaaatcaactcgatatggcccgggccaaaaacaacaccatcatcatagtatgagctgctgaagtaggtatggcaagtcatttcaaaagagtagggatcgatggcaatggttcagatgggacgtagagcaagaacatgtccgagccatgctcgcgagaactagcccggtgttaacagaattgatatattcggttttatctatgccgaacagcttctagatattaggagatagttatcacatgtgctgttatctcctgtaatctagctctatagttgaaaccttgtacgccacggcttggggctattccagccatcgctatttaacacgcaaggcagcgcagcacgcgattgtgcggttgctttcaccgaaactttacatggtatcagagctgtaatccaatctatctctacctctcaatcaatggcgtcctcttcctccaacgccgcaaccagcaaccttttccaaggacacccggtctctgagaagctcgggaaaaccaatcacgcactctggaaggcccaagtcaccgcaggagtgcgtggggcgcgcctctacggtcatctgaccggcgtgactccaaaaccagatgaggagatcaccgtcaccgaaggtggaaaagaggtgaagaagccgaactcggcttatgcagattgggaggctcaagaccagcaagttcttgggtacctcctctcctccgtcacaagagatgtactcgtgcaagttgcaacctacgaaacagcagcagaggtgtggggaatcatcgaacagatgtacacctccgactctagagcgcgctccatcaacactaggatagcgctcgcaacaaccaagagaggaaacatgaccatcacggagtacttcacgaagatgaagaccctaaaggatgagatgcaggccggtggtaaaccactggatgacgaagattttctgcagtacatcatcaccggcgtcggccctgagtttagcgaggtcgtgtcggtggtgtgtgcacgagtggaatcaatctcaattggagagttgtactcacaactcctcaattttgagactcgcaaggtgctgtacaatggagcacaagacactggagggtttgccaatgtcgctaatcgtggcggctttggtggacatggcggatctaacgtttgtcgtggcggcggcgctcaacgtgggcgcgggcgtggcggcaaccaaggaggtcgcggcggcggtccaggaggtcgtggccgtgggcgaggatatgccggccctgatctccgtccgacttgccaagtgtgcttcatgaaaggacacacggctccagagtgctggcacaggttcgatgacaattatgttaatgatcaaaaacatgttgcagcagccacttatgcagggtatggtgtcgacacaaactggtacatcgataccggcgccattgaccatatcaatggcgagcttgataagctcacaatgaaggagaaatatgaagggagcgatcagatccacactgcaagtggagcaagtatggatataaggcacattggttctactattgttcatgcccctaataatcaaaaaatacatcttaaaaatgtcctatatgtaccacaagcaaagaaaaatctagtttctgttcatcgtcttgttgatgataactctgctttccttgaactccatcgtgattatttttctcttaaggatcgggtcaccaggaaaacactccttaaaggaagatcatggcgcaggctctatccccttccaaaatcatccttgaagcaagcctgcagtgttgaaaagctctccttggcccggtggcacagtcattttgctcatccctcatcttccatcgtcaagcaagtagacaataaatttcatcttccttgttcgagtttagcaagtgagtcggtttgtaatgcttgtcatcaagcaaagagtcatcagttaccctttcctatttccactagtgtttctaggcatcctttggaactcatatttcctgatgtttggggtcctgctcctgagtctgtaggaagaaaaaaaatactatgtgagttttattgatgattttagtaagttcacttggatttatctcattcaatataaatcgcaagtgtttgaaaaatttcaagagttccaagttatggtggaaagaatgtttgatagaaaaattctagctatgcaaaccgactggggaggtgaatatcaatcattaaattccttttttcgcaaaattggcattgttcatcatgtttcttgtcctcacacccatcaacagaatgggtcagctgaacggaaacataggcatatagttgaagttggtctttctctcctatcgcatgcctcaatgcctcttaaattttgggatgaagcattccaagctgccacatatctaatcaatagagttcccagcagagttactcaaaacatttctccccttgaaaaattatttcagcaaaaaccggattatgcctctcttcgaacctttggttgtgcatgttggccacatttgcgcccttataacaatcacaaacttcaattccgctccacacgttgtgtgtttcttgggtttagtaatatgcacaaggggttcaagtgtcttgatatatcatccggtcgtgtgtatattctcgggatgttgtgtttgatgaaaccatatacccattttctgagcttcatgcaaatgtgggcgctcgtcttcgtgctgaaatagcacttttacctaatggggatgaactagtattgaatcatgtggctaatccattgcaaaataattttcctgctcataatattgctcaagatggtgcaccagaattttcagccgcagaagatcccgtcagcgatcccggtgatgattctctggagcagtcagccgagcggtatggggacgaggcgttcgagttcagccagcatgtcgagaaggtctacagaaaagggatctagaagatgtgagaaaaggcttaatgcagtcaagattcagtgaggtcgatctacgaacctaagttgtggtgcataagcggagccaagtcgagacctgaaggggagtgactagtcgaatccacgacgcgctcatcatctctatctatggcccctgggtcccgaacaggggaatgcgggctagtcgatgagtcacggtgttcaacaactgaaacatccgtgctaacgtttactctgcaaaagcaccttcaagacatcacaaggaaagacaagacattctcacagagtaccgaatcgagtacttaagagtttaaatattacaaggccttttaagaccactgggttataaaaattacccctgatagaaggggaggatgctgtcggcgatcggggcgacctcttccgcaaattggagatggcccgagttcgcctcgccatggcgaaggatgttctcgaggtccagctccgggtaattggccctgaagcaggcgaggatatgcgccgcgccaatacggactccggtggtcgcagtctccctcatttggctggtatacttcgggacaacgctttccagcactgtcacgagttccgccaaggccgccgtcatggacgtctcgtccccgaaagcaggagcctccacttctcccagactagtggcagtttggtggagggctgtgtagctaacccggagggatttcttcagctcgtccatatggccgtggagctcgtccaatcgtgcctccaggcccttgtaccggtcattggagccggcgtagagctccttcatcttggcgaggtccgcctcagacacctccagtttcttctagaggtcgtccatcctctcattcgcggcatcaataagagtactcgagttcgcaattgaactcgagagctccttggcgccttcctcgagcagacgacgcccctccgcaattttctccacccagttccgaggacgggagatttgcgggaggggaggggtcgtacttggagcatcagggccgattcggacgccgcaacaacagccgcttccgcagcttgatctttccccgaagacaacgtagtcgaggaagctctaaaacaggaggtcgacaaaggacgtcgtcaggagaaatcaaaatatcccgcgcacctagtcgagcgaacaggaaaatttacctcgactgtgtgatggggatcagctttgaaagagggaccagcggggcaaggggctttgcgggaccctacagttatcagaagataaggatacggcataacgacgaagatagtgaaaagcgttccggttgaaaaactcaccttcccgctgctcggtggaaggggcatgatgagccgccaggacgacggagccgttccttttgcagaaggagacaacaaggcccccgatgaactcgggacaacctatagaaaagagatcacagaatcaggacagagaagatgtgtgtttcgcattttccagtaattaattttctcagaaaactttctcgttacctcagacgatgccgctcctcacgttttctcggcggctatggttgttgggacctgggaggccggggctgcaggggttgagaaaggcgtagggatcagatcatcagagaaatgcgggagctttatccccacagaaaccctaaagtaatcctcttcttccaaaatgattctatgaaagaaagtcagaagatgaagatctgaggagaacctggagcgacgacggtgggttcgtcctcgacggttgggccgccgtccgcggttgccgtgtcctctcggcgcggcttcttcgggaccttctccgcaacagtcgaagccttgttcttcgtcatctcgcagtatggataagaggccggcggggaggagaatgaagatcaaaaggcaatggtggaaggaagattagagaatgaaagtgaaagggcgtcgagcgaagtgaacggctcgcccctgtggagatccccttttatagcccgatggcccaacggttcggtttccgagatttttcccacctaagttttcgggagtctgttgaggaaagtggatttagacttcaaatcaaatgaacagatactagaaccctggcattgtcctcgggatcaccttgccttctcgaatttccgagaacggtcataagggctcacatagacaaccgggtacgaaacagacatcggatgacatttgagttgaagtcgggggctactgtcaggattacggataaggggtatcctcgttacccaaaaatacagagtacaaggaaaggtatacctgcacgaatacagaaagaagaccaagatatacaaggaagccataggagaatacggaaggagtccgtataccaagactaagacggagacctactcgtagaagataggggctttcctaagccgtgcgggcctcacggtccgagtcctacacgaggactgctggtagctcacggtataaaaggattaccacccctatgggtcgaggacggatcaatcaagccacaacagaagtcagaagcataattccgtagccatagccaccaaaaccgtcgagattgtattcgattcttccgactacgatttcaccggattcctgtttccacacattgtactctgtactcgggatctttcccaccagcaatcccatataaactggaagttgggttattaccttctcggggcccaaaccagtataaaatccttgccttagctttccagcgatgtcgtactacattagtccttacgccaacgtttctatgattgctacataccccgtctacggataccagccgttgacagtattgatagagaaggagggagaggttgattctgggatttttcaggttaaactgatgggccattttttctatggcgcttgcataaacagtggatgaaaactttgctcagcgcacatctatttttctgtcgatgactgataaatcgaatacggggtcgtttgtacccagaaaattcgttgataccaagactaacaaaaatacatgataaacatagagggagatatatttttatacaggttcaaccccgtcaaggttagtagcttacaaaagcacgtagcgatgtagggtatccaaattgcgcagataataatactcaaaatactagctttcgctagcaagataaaaaagggagagtacagactgatacgtcgatcacacatgcatgtatggcggcacaccgagttgtgcacataaaaaaaaaacactagctttcgctagcaaagattacaaaacaacatgtactaagtaatgattactgtgatagtgattgagctatatgcacgcacggattggactgatgatggaggcacacgtatatatagagagattatcgttggttgatctctgaatcttataattaagcccaggcactgacataccgtccgtagtgagtgatggagtcatagtagctgttccaaagcatcactcctccgtaggtatccgtcttctgcaccgccggcagcagcttccggtagagctcaccgacggcgaccatgtcattcttccccgtcaaattcgccgccgcgagccccaagtaaatcttcccattataagggtaactcgccgaccacctgttccactgcgccatgacgccggcgagcccggcatggttgtatgaacacctcggatcatcgtagaacctgacgtggattcgccggaaaaggtaggtttccagcgccttcttcatcctggggtcagagtcgtcgtacgcacaactcaccgtcgccgtcagcttgaacccgatggggtcacgccagtggcgggtgtcgtagttgatccgctcggcgatctcgtagtagtggtcgggttgaccgcggtcaatgaagaagtcaatgccgacgactgtgacgtcatcgccgaatgggtggtagactcccgggcggctgccgccgaggaaggagttgtagaggttgtcggcgacgtcggcggcggatttggaggaaggtagggagtagtcttttccatcgccgccgccgatggagaggaggacgtagacggccttgaaatggcagtgggtgatgtcggcgccgatgtggcggaggtcgtggccggagaggtcgtcccagtagcggccatggccgaagaggctgtagaaggagatgatgacgatgttgtagagtccactgtcgcagactgaacggaggctgccttcgttcttgttgcctccccagaagacgaccacgttccgtctccttccggctggatcgatggcgccggcgaggttggccgtcgccaagaaggagagaagaaggatggcggcgaggatggtaggtggtgatcgccggcgttgttgttcggacgccattgttgtgtaattgtgtgtggagtgctgttgtgttggggggtggagaaattagttgcaggtaagttcgtatatatagagatgcatatccatgtagatgtatgtagggccttgctcaggaatcattaggcgtgtcgttgtagccagcaacttgcaagcttttttggacccatggatatatactgcgtgctgtgcttgcagctgcattcatcaatcctctgtttctgaaggtaccattctaaagccttgttctatggaatatcgatgggttgcacctgcaaaacaagggatgaaacattacaggtcagtctttgccttaattaatcaaccatttctcatgaagagaaatgctctgtttttatgtcctctgtttcgtaccatctgtccgctctgtttttgcatcctcatgttttcccgcgactagtctgctttaatagtcgactagccaatgagtcgtgcgttacgcgaccatcagaaactgtaataatcgtttaatgtaaaatataacatatatacaattttaccaaaaagtacagtaatagttgataaaaaatatttgaatttataatctatgaatgagtatgctgtcaagaatacccatttacataagaatagatataatagatgatcttataacaatcggcaggcatacatagtttcgaagatcaatgagatattgtaatgggtctgttgtgaaaaaaatgttggtaagataaagcgtaacaatatgacagtctcataatataggaatcaccataaataatgtttgtgtttgaatattgtaaagatttttttacaactcagaatattgtaaagttatatagtgatagagtgctcaacattgtagatagatataaagtggtttgacagtgtttataaaacaaaatatgaggatttttatcttcttctgctacttactatcttctcttatatttttacatgtaagagacaggggaccaagagtctagtagactctagaggcctccagatttaagatttgctaggagtcaaccacatagttcacctatcttttttgaccctactaactgactactgcatgcaccaatccaccattcaaacttaatcgaacggcctacaatccactaaggccttataccattatatggcatcgatcaatgatggtcactttctaggccaacttttgcgatgtctctgcatgcggaaaaacggattgacaagtcttagcttatcgtcttatccaggcatccatgcatgcgccatgaagagagagcaataatgctctgttttttacgtcctctgtttcgaacaaacgaagctgttgaaagcagagtactgctctgtttttccgtgacgaatctgttttcccacactgattttaccataccggcagcgcagcacacaggaagaggctagctaacatgcatgcatctcctgccctgttatcaccaaaaaaaaaaaacaaacatactcatgagaattcgcttttgtgatagacaagtacccaaaaggaagatgagtggcctaattccctgccccttgcgcaaacgacaatgcaatatttgcagaatgctatccagctgttgcccttcaagatgtatgaacaacatcctagtacatacatactccctccgtcttaaaaaaaaaaagacaaaccctagatttccgtgacaacgtttgactgtccgtcttatatgaaatttttttataattagtatttttattattgttagatgataaaacatgattaatactttatgcgtgaattatctttttaatttttttataattttttcaaataaaaaggacgatcaaacgttagacacggaaaccagggtttttttagatggagggagtacagcacgacacgattagttagttttggatcgagatcgaccagcaccgatgacgtggtagccgctggtcgagtcaacggtcaaatctcatcaacatatccaacccacatgcatcaaatccatccattaacctatacgcatccaaatcacgcacaccacaatagaccactacctaggtgcctagcagcagctagaccccaagaaaaaagattgctccctctggttttcaatgtttgacactgtttacgatagaatatttgaccattcattttatttaaaaaatttatctaaatattattctgaagtatttattttgttacgagttgatttattacaaaagatattttaagcatgacttatatttataaatatttaaatattttttttaataagacaagtggtcaaacgtgcactacacaatcaacggtgtcaaacattaaaaaccggagagtacattacataatcacaaatctcttcttctctacatttaagcaattctacggtacttgaggagtgtcaaacattaaaaaccggagagagtacattacataatcacaaatctcttcttctctacatttaagcaattctacggtacttgaggagataccatgaggtaccaaaattttagtgtaaaggtaacataagatatcaaatttataatagaaaaaataatactttatagtacctacttaagaaccgtaaaattgctcctctacacataggagtacatcagaaatcacttcaagcaagctcacagccactgtacactgacactgtcgttgcaaaatggctctccctcccttaccctttgcactagcagcagcattgctgctcacaataatctccggccatctcgccgcgccggcgacggcggacggctacgtcggcggcctagcaatctactggggccgtcacgccgacgccgacgaaggcaccctccgccaggcctgcgacaccggccgctacaccaccgtaatcatcacattctacaacgtcttcggctaccaccccggcaactacaacctcgacatctccggccatgacgtcaccgccgtcggcgccgacatcatccactgccagaaatcaagaaacgtcacgatcctcctcgccatcggcggctacggcggcggatactcgctccccacctcccaatccgccgccgatgtcgccgacaacctctggaacgctttcctcgccggccgccgcgccggcgtgtcgcgtccgtttggccacgaggccgccgttgacggcgttgacttcttcatcgaccagggcggcgccgatcactacgacgaactcgctcgccgcctccacggctacggcgccggcgtgatctggacggcgacgacgaggtgctcgtacccggatcatcggctggagaaggcgctggcgacgaaggtgtttgatcggattcatgtgaggatgtacggcgccggcgagatcgagcggcggtgcgtgatatcgtcgaggtattcgtgggagaaatgggcggcggcgtatccgggaagcaaggtgtatatagggttggtggcgtcgccggagcaggacgaggcgtgggtttttcagaaggatctttattatgaatatctgcagtttgttaccaagctgcctaactatggtggtttggctgtctatgataggtactatgataagaaggctaattacactggtgagggttaaatggttaacgatcgatcgtctttgttgatgtactggctgaataattaaagaagatccctcgtgtttgtaatgttgtgatggaagaataatggacgaataaaatgaggtctctaaagaagttatgtatgtaacagatgtcagttcatcatataataagggcctcatcggatgttctaaatggccaaaatacggaaaatgcgttttcataaataaaaaataatttaaatgtaaaacttttgtacatgtgttattcgtgcttcaaaaaacaaatatagaaaaaaccacgatgaagaattttaaaaatcaatcataaaattgagtttgaaaattcaaaatttggcttcggattataatccaatggcgaagcgatgagagcctaagtcgttttaaccaaagtcaatagtggagcgagtaactagcagcactgactgtatgacatttttgctgagcgtgtctatgtttcacttcatagcatctcaatatataaattgttgggacatgaatttcacaaatttgggttttctgccctcattcagtactaggtacagcgaagaatttagccgacaaatacaaggagcacaatgcccaggatgtggatcctctttagtagcaacatactacactgcagtaatatgtggacatcagaatagcccaaaaataacaaataagaaaacaaaaaataaactgcttgctgatgacctgcaacgtctccttgctcagttcctgtcagggagaacttatgatcacattacaggcacaacaaaccaagttcaggtctagatgaaaacaatataactaaagcagtaatgaaatccatacttgtggataaaaaaaaaagttggaagaccacaatgcaagtcaacgggcagatgtttctccgatgtgttcagactcaggcacaccaacagactcagcatcaccaagtgtcccagtggagctgcccctcatagaacgccatgaggtctccagctgcaaactctcccttataccttctgccacctccgtcatctttggccgatcacgccctgcacgcctagtgcagagcgagatcggccaccttccatacagagttgagatcataatctgctcttatcctcgggtcagtgacgccctcgatgtctccttctgcgagcctctcatgcacccacagcaggatgttctttttttccgtgtcgctgatggggatgattgctggctgagctgtgatgagcaccaagagaacgacttcaaagctgtatacatcgctcttttcgcttagatgagaggtttcgtagtacctgaatgctcatgatataaaaggattatcacatcagattcttctccaattgaatgccagcagttatgctaatcttttatgtaaaatgtaataattaggggtccaggacatgcatactcaggatccaagtatccaggagtacccgctgtaaaatcaaatgtgtttttgattattattttgtgatgaacaattggcatcggagattattggtttttgtcacaccctgaaaatcctaaatttataaattgttgtttaaattgaattattagaaatgattttaaaagcctagaagaaaagatctaattttaaataataaattccaatatagaagtgggccagataaaattttattaaatacttcacttgattctatagttcctagatttttctgggatttatttgagccaagaaagtatttttaataaatggaattgcatttcatgaataatttaaaaagaaaaaggttttaaagtcctcttttagctttgggccgaaagtcggcccaaaaccccctctctctctccccggcccaagcgcgcccggcccagccagcccgctgagccgagccgccactctccctcctctctcccgctgacaggtggggcccacctgtcagggtcgtcttcctcctcccgccgcagccgcgccctagccgcgcgcaagccgccgccacctccttccaaattcggccgcgtctttcccgatccgatcaaattgctagaggggaaatgatcctcgggatctcctcttccttttctcttttggaaacttcatctaatttcgtttggaaatcgccggatttgatctcgattcggatttgattttctttcctaaccttaaaccttccatctcgccgccggccgccgtgggcctccatcgctgccccctaccccatatataaggacccccgggacctcctctcttcgtcgccaccctcgccttagccctccaccgccggtagagctctagccgcgtcaagccgtgcgccgccgtcgccgccgcaagtccagtcgtgcgtcgccgccgctccggttgtcgtcgtcgctcgggaaggccgccatcgggttcgccaagtcgtcgctgtcctcgtcccatccttcgtttccgccgaggaccaccggagcatcgccgtcgtcgtcgacccgaacgtctccgccgcttcgacctcaccgccgtcgccgtcttttgccgtccgccgtcgtccgagccttcggtgagttcgccgcgtcgcccactacccgctggtgccctcgtttgcgccgccgcgccgtcgttcgccggcgagcacgaggtgccgagtcgccgccggtgatgacgtcatcgtcgacgtcagcgccatgtcagccgtagaccgcggtagatcagttagatctcggccgttcgtttggattagattagatctcggccgttcgttttgtagaccgtctccgtgcacccggttcaccgtgaacccgagccgatgacgcaataaatcctttttccttttcaaaaataattctttattgcgtcataattcaattaaaatctaaataaatgatttaatccgatttaatctttaaaaattcataactaattcatcttagctcggatttagttggttcaagtctctaaatttttctaaaattgagatctacatgttaaaaatatccacaagtgctgtttatgattttttatgtactgttttggtgatttttgctcttttatgcttacattccgacgttcccggagagtctgagtttgcaggagaagactttgaagagttccaaggtcagcaagtcaagtcacacagatcctaaacaaccctttgagcatgttgattccgtttaaagctattgtttctattcaactattgcatttattttgaatgtcattgggtgggaataacctattgcctttgttatagccctttgttattgcttacctatactttgtcacctggttaataattggattagctagaacattatatggttttagctaaagcaattaggatgcttagccatgcttagagacactagctcatataaatgggataactaatgattcactattactaaatgatggattaatggtagctcatgatggttaatcatgataggatgattaattaatttgccaactaaaacatgataatggtgggttgtgagcacatggttttgatggtcgtgctcatgacaattaaggaccggttcacgattttcggttgtgaaacattaaccgtgccaaccacaagccagcgtgggcaacgggtttaccttttgtatagtgtggttcattgtggagcaccagactgtgaagtggcggagataagcccacgggggtcgctggggagtccatgccttgtttataagggggtgattatgatccaggaacgctgtactgcttttaattgtgttatgcgaatggtattgtcacaatctctattcgggtacttgttaagtattgcgacgcatggttgacatgatgttgaggttgtgtcttgtgggtacagtggtacacctctagctagagtaaaactattcgaatagccgtgcccgcggttatgggcgggtctaacaatgtctttcgtgattagtctcatacctctcaccataataaatgatgctgtaattggtaataacttgttagctcctggtttggaatgatgtattcctggtttggagatagaactgtgcagccgagaatggttattcagaatggttgggcctatacaacgggtatgttgtatatcgttggattaatattgtttaattaaatactttactgttttactaaattctgaagtatttattaaatgccatttatgcaaatgagactatattatgccatcctttgttatcccctgcacttgcatatttgttgcgtggcttgttgagtatgtcatatactcaccttgcaatcattcatcagaggaggagttctacagtgatgctgaaggtgtggaggattaggcgtagcgctggtcaagctgcttgtgggatggagacgcctgcgccgtttatcttattttccgctgcttagatttttattgtttgagaggaactatctacctctgtaatgactttatattcgcttattaattagagtaataattgtactctattatcaatttgttattgtgtgcctcggctgattcctggacgagggtttacacacatgtaagcgtttggaattttggatagaaattccgggcgtgacagttttgttatttggaatttatttacgaagtggttttggagatgattagatttgaaggtgaattgcaggtgctgtgattttatgtggaccggtcagaccgggcatgtgctgccggtcagaccggcgtgtatcacgcagtcagaccggcgtagctcgcggtctgaccggccgactctgtgtcggtttcggtttcgggttgtttatttggattctagatggatactatacgtatgtaatacagttgtttgctactaatgagtcaagttggagatagcttggtctcggaatatggtttctttgtttgttccatgtgtaggtgactcgatgcctcgggagagtatttgcggtgatggaccgggagtcggcttggagataagacgacatccgtggtggtcagagatcatgcgggatacttaggctagagttgatgcacgtggttgatggagattccatatggcatacgatggagttattgtgtgcgtatgggatgcggagtcgaatttggaaggagtctaaatttggtacgattggttatgtaaagtttctttcctgtgctagagggtttcctaaggtgtttaggactcctagtatgaatttggttcgtggctctaggctgcctacctcgggtataaatagagggggagcgtgaggcttcccggtatcgcttttgagagcaattgagttgagttttgagttagggtttcgagtttagtcgaaaattttgtaaggagtgctgtaggtgcactttgtaaacacagagagaagtaataaagtcatcatccactttaagagttattcgatttgtgtttcaccgggtttcagtggtctaaccggcgacacaccggcggtcagaccggcggcatcgtggtggtcagaccggcgggtgacctgcggtcagaccggcggcggcgacaggcgcggcagggatttcagggcggtccaaccgagagatctacaccggtcaaaccggcggctatgctttggtcagaccggctaatctactccggtcagaccgatctcatcgaattcgagggtaacttttatttccgctaaaagttttcggtttttgggtatatcaaccattcatccctctctggttagcttagttcttgctattcgatcctacaagtggtatcagagcgttgttttcttctttggatttttatcgatctagagtttttgccatggctactcccgctcgtttttcaactaagcctaatgttttcgatggaatggatttttctcattggtgtagtaggatgcaatcttacattatggctgaagattatgatatttggagaaaagtttctcatgcttatgtgattcctgaagccattaatactgctgctgaaaaaactgcttttgaacaaaattgcaaagctcgcaatattcttttgagtggtatttctcgtttggattatgatcgtgttgctcatcttctaactgctcatgagatttgggttgctttgagtaattttcatcaaggaacaaataacattaaagagcttcgtcgagatcttttaaaaaaggagtacattaaatttgagatgaaacttggagaagctttggatgactatctttctaggtttaataaaattttgagtgatcttagatctgttgattcttcttataatgctaattatccacaatctgagatttctcatcactttttgaacggtctcaatatgtctatttgggagatgaaagttacatctattcaggagtctgttaatatgtctactttgactttgaactcactttacaccaaattgaaaacacatgagatgaatgttctttctcgaaaagttgattctaagtcgactgctttggtttcttctatttcttcttcggatgttgatgtttcttcatctaagccttctttgcttgctgtttttaatgccacatccgatgatcaactcgaacaaatcgaggaggaggatttggctttggttgctaactgtattgctcgagctatgaataatgccaggaacaggaaaagaggtggtccaaatcgttgctttgaatgtggttcaatttatcatcttcgttcgcattgtcctaagcttgggagaggcaaaagagaagacaaagatggtgagaagttcagcaacaacaagcccaacaacaacaagccgcagggttcatctcaagcgaggaagttcaaggagaatcttaggagggcttttgatcaagtctatgcctcatttgagccatcaagtgatgtagatggtgagagtggagatgatgataagggaaagaacatctccggtgtttgcttcatggtgcgtggtgaatcagacattgagtatgaagatcatgaggtaagtgcttttgaggaagctattaatattttgagtgcaaaaaatatgaagtgtgagaagatgtatagaaaacaggaatttatcattgaatctcttaaatctgaaattgatagattaaaatctcttattcctaatgatgatgattgctcaaattatgaggttttaatgaatgagatttcaaaaattagaaatgttaatgctacacatgatttgaaaaatagatcttctcttgcttgtagtgttcgattaattttttgccaaaattcatagaaaaaataatatatcattgggcattaatttgcagcccaattttacgaaatacacgtgaaatgtgtctctatgacgtgtgggaccagaaaattcaaatatcatacgatgttcaaatatattcaaaattggactcgttttgttgtatgttttgattggaaaataatggttccgacagaattcatatttgatatatgattagagagatataaacatttgaaggagaagatcaactagtgttaaccgtatatccttaattggtttgctgctcctcaccggttggtaattatccttatgaggtgtggcgtccactgtcaattagccaagttaatcctcgtgattatctccagcacacacacgttctttttatctggagcacaaaattctttttatcacgcgcaggtcgttggattaacagacgcgctggcttatccagagaattaacgcgtgatttcgctggcttgcgctggaatctcggaagggattaggcgaggacgccggccgtcgcctctacccttatataaggcgctgtccctcacgacgccgggggagattggagaaaacccccgacgcagaggcggctggcagaggaggagacgtagcagggcaaccctgctgcgtgctctgatctgatcaatcacccatacatccagaagcctatatcaatagatacacaatcacacgccgtcgccggcgtcgggcgctgcacagcacgcaagcctgagccggcgatgaaccttaaaccacacgtacacgcacccacaaatatttgattaggagcttgattccgattaggcaaaaggagattaaattccatcggcggcaattcgcgaggagattaatcattgccggcgacgattgtgccggtgttcgtcatcaagctaatctgcatgtgctgcaggcctgataaaacatcaggggagcaaaaagatcagatgcacgccgtagtgctgcgcagttgcgtggccc

SEQ ID NO: 75139 - DNA, 1314 bp, Oryza sativa
catacattaaaatacggagggagtataaaattaaattaggatcaatattccctttaccaaacatattattaacacatttaatagaaagcaaattttaatttttcagataatattaaatatatttctattatccgaagcaacacacggataactgatattagataaaactttaattgttggccaattgtacgacgtgaagcatagattaatcttctcgaagttggattcatttccattttatccatggccacacattcggtgctggagatgggatgaacatgatttgtgggcactctgccttctgagtaagctaaaatatgtaccaatgcatcatgcttatagtatctgtaggtgtcatagttgaacaatttgtggtcacaaaacaatcactattgtaaatgcgacttttgtagcatttttgtcatactgtcatactaaagaagataaacgagcttcattgatatggaaatacatatacatatgtactcaaactttagaaaaataaaatgtaagaaactatctcgatgaagtttcaccaactatactttttcccacaaatattatatacgtaatatactcaaaatcgtctggatatatacctctgcagcaacatgcagacatggcatacggaatgctttattttgttgatggcatatttcacaaaataaccatagaaaattaattattggcttccccgaatgcagacttgatctctcttttgaaataaaaaagaattatagagaggttaagaattattttaaaataaaaacacacatgtctatcacttagatgttgatgccactcttatatttagagccggccgtaaagctttcggggatgacgtcgtcaacaacacggtagccaccattcttggcaaggaagcggatggagaagggtcctttgagcggcgcctcacttttgattgtccatgtgttagttgacgactccttgagcgtcacccagtccttgctgcccttctccttgatctccaccttagagatggcgacgttggtgacgagctccagactttttccgctagaggcctcaccgaccttgaaggtgacctcatatgatatgaagcttaacttagcacctctcaaagctggcttcgcttccattctatccattaccacttattcatgttggagatattattaatgcgacttacattttgttctagcatctgaataagctaaacgatgtgctgattctttatgcttgtagtttcatgtcacggagtgatcgattcaacaatttctttccacaaatttttttttttaaaaaaaaactgtaaacaacatttttgacaagcta

SEQ ID NO: 75140 - DNA, 5620 bp, Oryza sativa
tggggattctcttacataaaataatagggtatttacgagatggtggctaactattatagcagaagctatagaatgactcaactctagtgttttactatagacgtaaaccatctatctatctatacttgagaactaagtagaatgagactaacttatataactgaactcccggcttcgataagaattccaaaatgactctgaaaaagaggggttgaagcaagggtgagtacaacgtactcagcaagttattaaattcaatatgaatgtatgaaatagtggtatttgagtagggctatgattacttgcagaaaaagtagaaagcctgtaatgattttaatgcaacagtatttaataaagtttggaattaggtttctaaccaaataccatatgagtcccaatgctcaaatccgtgagcacggctattcgaatatattcatttatattttactgcagtaaatgtacgctttacccgcaatccatgacgtgccaaacacattagctttgtcatggcaaagcttttcagttactaacattagtggtacctgttccatgaactctagttcccatgcgctctgaacgtaacgttatcagcagcgagaggagttttggcgttcccgaggtctttagagagaactgattgtatgacaccatgtcatcacaatcagggttcacaaacaagttgacgtcaataaatctcatatttacctgcgcctcggtaaatatcacaattgcccttcgcggcataaatttgcctcctgcgcgaggacttaagaagaaccactatacagaggtaccaccttttctagataacttaatcagctaggtctatgcccatacgagaattgcggtcgtactcgtatgttcttcacatgtacttggcagtcttatgtcggttggaacagtactagccacccggaaatcaaccatttctaccacactattccaatctaagttcattatattttatgcaatctaactaggcatggctaagcaaaatctagcatataactggtttgctatatgttcaggttatgcattcaaaatcatgaatggttaatgcatagaatagagatatagaatatagggtaattatgctcaaggggaggaataataacttgccttgctccaacgcaaataaatccgagatagacaacctgattatccgatcctcgaaataccacaggttgtcatccaaaatacaatagactctacttgaagaagaggaagaactaaattcaataaaagccataaaatagcaagaaagcgataaacggttaagagggatagggtttagggtatagcctatctcttttataggttattaggattattgggctagtatttcatgtgtaagttctaaaggcttggaggctagaggggattaagcaatcagggtcacttgtattttatgtgtggcttgattgctgaaaggatgggatgtatattgggtaattgaactggttcaactggtatatggctagtattagctggtggtaggtttaggtagtataatacctagggtttggttatatttaagccgactacggaatagggaagcatattggctaggctctgtataggttctaggagagtaggtggctgcgtatagtggataggcgatattggtaggtggggtatttggatgacggttgggttttaactagcaaggtgttagctagggtttagttgtttaagccgatattgaggtaggataaatatcggctagggttttgggtgtttgctagttgtcgctagagttggacagtatagcgactagatttggtatcatttctagcaggtgtcgatagacatcatatcggctagaagaatagtaggtgggtgcaggtttagtggggtggaagtgttactccgataaccgtgagtggcgacggagcggctaggattacacagagcccgagagctaactgtgcggcgtgctgtggaggtcgatggaatagtgaagctccgaccgctatacgcatcgaggcgtggggtgccaggagcagcacttcgaccttgggtttggtttatgccgggctttacaaccaacggttcgacgtcggggatagaaaaccgtgaacgtccccatggaaggcgcaaagttccaaccggcggctttttagtggctaaaagggtaattgggataaaataaaatatttgaaaagcaaatataggtttaaatcaaatatttattcaaatagtatttgaataaattaagaaaattcaaataaaatattagaatagtaaatttggtaccaaaaggtagattttgaatttagatgaatttaggtctaagtttcatcggaattggatctatggtttaggagatatgggtttctaaagattaggttttgaattaaatctagaaaagatgaaagtgcactgttcatgggcccacctgtcagcctttctttttctttttcctttccttcttcttcctcccgtcgtcttcctcctctcttccagccgagcaaacgagaggagggggaggaggggcaccagggctctggtggttgggaggcggcgacatcggtggcggaatgtgttcccgaacgacgcgcatctggggagggtggtgtccggcagggggaatgagagaggagaccggaacggcgatggccaaaagcttgccccggccggtttgggaagtaacggtggtggctaatcttggaaggggaaaggaaggggaaggttagggaatgggtttgccccatcgaggcgaagccgatggcgcgagggcttggtcggaaatagtccgacgagggagatcggccggtggccggcattggggacgagagagaaggatggagctcgaggctcggatctgggggaaaagaaggggcttcgccggctatttataggcggcgaaaggaggtggtcaatggcggttcagagaggagaaaaacaagggaagcacggcgctggtggagtggaggagaagaaaacggcgccggctcttctctgtgattggtcggcgtcggcggcgcgtccacgcggcggctctgctgcgtttgggcggcggaggaggtagaggacggcacggcgtcggcttggcgtggtcagcaaggcgacgacggcggctccgggagcagctgggcggcggcggcgcccacagtgaggaaaggaataagggagggaaattagactttcagacttgggcttaggtgaaggaacttcggcccaaattgagtagaattgattttgtgtatagatggaattatatttggagggagtttatatgtggagataaatttcgaaataaagatcttctatttatttgagtgcaatatttttagaagtggggtatggtggaattgatgcactcaaatgggagagaaattaacaatataattcctcaaaatatttttgggaatgaggcaagcaaacaaagaggaaaataaataggattttagccccaaaatatatggcatggattttagagaagtatttgaggctaataggaatttggatgtgtggaagagaaggataaaatatattttcttagcacaagagcaattattcataatatttgtaataataccattcttgtgccgagaagggatcaagccgtaggaactaaattggcggttagatcaaaaggaggaatttggatatttgagatttggaaagggaactaaggataggtttggaatcaaaggatgggtcgacaattaattccaattaaaattggaattacaaagagttggtttggagggttttcttggaccataatttatacaaatgaaaagggtttttaaactaaatttgaataagaggaaattttgtcgaaagaaggttttaatttaaaaccaaatcaagaaatacctcaatttaaccaaatatatttttaaatgaaaaacacaaaagaagttaaatatcaaagaggggttttatgcaagttagttctagaaggtccctctaatcataatttcctagatttagaaggttattaagaacataagaaccggcatgatacataattagaaaatatctaattttcagcatgttacagtaatatactcaaaatcgtctggatatatacctctgcagcaacatgcggacatggcatatggaatgctttattttgttgatggcatatttcacaaaataaccatagaaacttaatttttggcttccccgaatgcagacttgatctctcttttgaaaaaaaaaggattatagagaggttaagaattatttcaaaaaaaaaagcacacatgtctatcacttagatgttgatgccactcttatattcagagccagccgtaaagctttcggggatgacgtcatcgacgacacggtagccgccgttcttgacaaggaagcggacggagaaggggcccttgagtgccgcctcactcttgagcgaccaggtgttagtcgacgactccttgagcgccacccagtccttgccgcccttctccttgatctccacctcagagatggcgacgttggtgacgagctctagactttttccgctagagccctcaccgaccttgaaggcgacctcagtggcgcatgagccaacgaccaacaatgccgccactgccacggcgagccggaaggagtacaacgaggccattggcgagctagctagtttgttggtgttgtctttcttgtttcttgaagggtagagggatggatcgaggtgtttggtgatccatattgcagctgggtgtgtatttatggtggcagggggcaaagaaaaccaggcatggatgcacggtgcggcatagagatcgttggccggctttttcgtcgagcaactctaatacaattcctataaataggtgcaaacttggtagttccgattgtttcactggtgcaggacatgcagacctctcaaaaggtagctatgcattcccatgttttctctacttattttttaaattgcgaataataaaaatttgtgatgttccgtttatggaggatatggaccaagacacgaaaatattaggggtgaagatgctaacagaaaacagaggggtggtagagctaacggtcaggagtgatggccaggcacatagaggggcaccgtgtagcatccatagtatatgtcacagaggggccatcaacagctagatgttgatggaatcatggcggtgacagatgggtcatgtgctggcccgttgcggctctgctcgataggggacataggttagcatttatggtgagatggggttggtgctaagtaaattggtagagcacagctaggcagctagctggatatcgagcggtggcggcagttgatgcaatacatttgataggaatacaagatgacaactcgacgaggcgtatgtggggaggagcacgtggccttatgaaaataatccaacaattctaggtctcggtgtagattgtacaataaaaaagagtacactataaattcaattgatatttttttatggaaaaagtacgaatgactcccccccccgaactattgaggtcgaccgaattacaccctcgatctcgaaaccagacatttacaccctcaactattgaaacggacaaataacccccctgactcaatccggggtggttttgggtccacgtgcagtccagtcagcatttttttaaaaaaaaaaatcagtgggccaaacctgtcagttctccatccctt

SEQ ID NO: 75141 - DNA, 2236 bp, Oryza sativa
gcaggtttcacttgcactctatccattaccactcattaatatctatccattaccactcattaatacctgagatgggattaatgtgacttacaatttgttctcgcatctgagtaagctaaatgatgcatcgatgctttatgcttataattttagatcacaatatggtcgattcaacaattttttttcatgaaaaagaaaaaccaagtgtaaatttgacttttacaacatttttaacaagctaaaaatgagaaacggactacatcgaattggacatactataaaactttggaaaatcaaacaccaacaatcatctcaatgaaaactgaccaaatactccctccttcccaaattgatcatcatatatgcttatgcaccaagaccaaggataatttaaatcacatcaatcaagacatcaagcacacattctcccacaatgcatgcatcgattaaaacaccatgccaattacaccttagcatgcacatattctgccatgctgcagtaattgtattctgatgaaatctgtgtacatgcaggtatatgatgattaatttgagaaattttgaattccattatatgatgatcaatttgggagggagggagtataatttttcaatgcatcctctataaacaatatatatattcaaaatcatgcttatatatagccccacaacaatattttggaagaacacatttatgccttattttgccactggcctattaccacaaaataatcatgggaaattaattgcttgctcactcacacacggcatgatatcttctaaaacataattatttagaggttaataattcccatgcgacccaacacaagagcacgtatgtctattaattagaggttgatgccattcttgtattcagtgccagctgtaaagctttcagggatgacgttgtcgatgacatggtagctgccgttcttgacaaggaagcggacggagaaggagcccttgagcagcgcctcacttttcagcgtccaggtgttagtcgacgactccttgagccccacccagtacttgccacccttctccttgacctccacctcagagatggtgacattggtgacgagctctagactagtgtcgctagagccctcaccgaccttgaaggcaagctcagtggcgcatgagccggaaggaggacaacgaggccattagcaagatagattgtttgttggtgttgtctttcttgtttcttgaagggtagagggaaggatcgatatgtttggtgatccatgttgcagctgggtgcgtatttatggtggcagggggcaaagaaaactaggcagggacgcatggtgcagcatagagatcgttggctggctctttcgttgagcaactctaatgcaattcctataaatagatgcaaacctggtagtcccggttgtttcgctggtgcaggacaagcggacctctcaaaaagtagctacgcattcccatatcttctctacttattttttaagttatacaataaaaatgaattacctcatcatgccgtttatggaggatgtggagcaacgcatgaacaaataaggggcgaagatgctagtggaaaacaaaggggtggtagagctaacggttaggattgatggccaggcacagaggggcaacggtgtggcatgcatagtagatgtggcataggggccatcagcagctcgatgttgatggtaccttggcagcgatggaggggctcaagtgctagcccattgtggctctgtgagaagggacataggttagcgtctatggcgagatggggatggtgctaattaatatggtagagcacacctagttggatatcgagtggtggtggcagtcattgcaatacatttgacatgaatacaagatgacaactcgacaaggcataggtggggaggagcgcatggccctggggaaaataatcttgcaattccagatgttagtgtagattgtacttcaaacaagagtacactttaaattcaattgatttttaattggcgggtgcacacattgttacatccatgcagcatgagagctacatgtgagaggaggtacatgggcaagcaccggggaaggatggtggatggattttgacggggtggtgggcattagagggcatgcctccaatcgtgcaaggggaagggacatcatgtgtgcgggaaccacttaagagggcgtggaatgaggctaggcatacgatggatcaggccccataaatcaccactacatttttttggccttaaagatt

SEQ ID NO: 75142 - DNA, 4933 bp, Oryza sativa
tgaattgcaatttgcaaaagcaactagccagccaagcccatcatgatccactgtccaaagttctcgtgacccaaagaggattcaggaactttcacagggagttgctgagcactgcatgcactaggctttacgcctttttcgcttttgatttcttatctgattgattacttagacccggagagtgaaaaattccggatcaaatgggcccaaagaagaaaaggaaagcgtagatgctaaatggcatttgcagtttggaaccaggggcgttttccatcgtcggtgacgtcttttgctttgctccgtagacgcacgcaatcatcatggcttcgtctgcaagtgatccaatcacttgaataaagtcgaggcgatttctgagccaccaacttggtgattaaattttggattatccaaaatgctcatgtaaaagatagcattgaaacgagtccaaagtccacaagattatgattatatatcgacgaaaggagaatctctaatgccacgtagaggagcagaaaaaatccgaccgtgcagactcgttttctctgagaggtcaggtggcattttttaaataatctgatgaggcgttaaggtttggtaaacttcgttttaattagagtttaaagaaaggccagttggtgattttttaagactaaacatcagtacatattcgtgagctatacgttagtgtctactacccctctgagtcacacacggttgagctgaaattgaatagactgttcttgatgaaaaataacaattttgctctagacaaattttttgtgtggacgacatgacaaagcaattaaaaaattttcatttgcaagatgatgattgcaataaattaattaatgtatgaacctcctatatttccatagtttgacagtcggcacagtgggcaacatcaggagttggtgcttcagattcctttttttaaaaataattacaaaaataattgcgtgctgcgaagttagtttttcctatctatagcactaatcaaattatgaaacctgtcacttgcgatatcattcgacgaatgtctgcttcatattggcatgcatgtgacaaaactactgcgtgctgtggttgtttaattaggcctgcatcttactcgtacttaagtactcaatcccaatattaattacctggttggttgatttgattagtcaaccctaggaggaggataaggattgattgcctctggagatctgggtctgctggtttgtcatggtctatagcacttgcaattaaatactacttcgacacagcactctgcaataaaatttcgtaaagatatgccacttgtgaattgcgtttctccatctcaaagtacaccacccattgcattaggtaagagaaaatgatattaattgcagtacaaatcaattacatgtgcatgctgtttaagtcaagatgtaccggatgatccactcggtcaaaacaacaattaccagcggattttacctatcaaaagacatatcactatcgatgccctactagtatatatgtcatcactatcgactaatagtgcaaacgaggtcgagcgtgtctacactacctttagatgtcaacatttcgtactatcgaggaaacgtccgcacttattaaaaaataaattaaaaattattacgccattaccgtgtcgaaattttactggtgccttgactcgctcacactgtcacacatattgggatcgatgacccctgaattttttgttttggagctagacgacttggaattgcaagctttgcaagtcataaaaaaaacacgaagatggaaagaaccacccatgttagtgttagtgtgacactacgagagaagagaagaagaaagacccaaaacccccggcaaaaacagccaatgccaacacaggccgcacccacatcacagagagggaaagatcctcctcagcacgtgcttcctccggtccacgcagcactgtgcacgaagtggaccagccgcgccacggcgacgacgcgagcccgcgccacgtcaaccggggccccacctgccaacgtgagatgagacgactcggacgagacgacgccgcggccgccataaatccccaatcattggaagcagttattactcgggtagatatcatgtaaaacgagctaattattagaaactttaaaagttttgttgtacactcgtaaaaacagatatgaaatacattttcattaaatttgaaatccaaactcaattttatttgagagaaaaaattgataaattttagacgtgtttactattcatatcaaatttatctttttgtttcactctgatacaaagtgaagtttgaacttgatattttgtgatgagaatatatttcacatatacatctatctataataatttttttcataaatttagaaaacttttaaatataatttccacacttttttaatacttaactcgttatcgctgtatatgtagtaactcgttattcatccatccatccagcggatagcatttttcgcatttctcttttcttcctttattttttcctccttgtcgctgccgttgccgtcgcgaggcgcgggggggcgcccaccttttctacggcgtcgttgcgtgcccggggttctcttcttagctgcgtctgcgttgccagccagcctcatctccttcctcgcttccgtccacttctccaccaccacctcttcgctcgctgactcgctctcgcgctcgcacacatcgctctcgctcgctctgctgctgccgcgccccgccgctcgcgctccgagcggggagcattgcgtggcgtggcttggatccggcggtctcgatctgatcgaggcggaggcgcgcgctgcgcggcggatggtgtgatcgggggaggcggcgatcgatgcggggaggtacggtgcggcgtggaggtggggttgggttgcgggcgctggtggtcgtcgccgtcgccgccgctgcattggtggtggcgcgcgcggacaccgccgccgctgacggtaagttggttcgtgctttgacttggtttttttttttttggttttgttcggttggtgtcgatacggggagacgactcggattcctcgctgctcgtgctgttcgtgtggtgcgtgctcgcgtgcgtgcgtggggtccgtgggtttcggtttcgtcgagatgagcagggggagcagggggattggttcgttctcgttgtgctccgccgctgcagctgcttgcaagtttgcaactgcttcgagatgagtccatggttcgtgttgttttcgctgttattttttttagccgctgcaattaactgtgcgtggtgagattgtgtcggtggcggcgcgggcgtcgtgggaatggatcatcggttctgtgaattggcccggttcgactccatcattgggattgattagtttttgtcttgagttcagcacaaatgccatttggcaaggcggttgtggcatgttctaattcggattaattgatgttctcttgcttgataaagcaatctggctgtccctttcgtctgggataacgaaaggaacttttgaggcctgtgatgatgtggtgtcgtgtgcttcatgtcttatcatcctcaatagaaatgggagaaagactgaaagagatggattgttcgcatttggattggtggaaacaggataacatgcaggagaaaacatttgtattggctatgcaagtaatagcagaatggacacctttaattgccatactgatgaacaactgaacataatgaagggggtaggatatgatcataggaagggaataatgtaagtgataggtgtatgttgttctcattgagtcattgtgatgtgcacattactcaatttagttaggtttatgctctaaaatcagggactgagcaatttcttttcgtgatgtgcacatgttattcctgcaattgttcttcatgtgtcctgcaatttaggtgattttgtggtcctcgtagaaaggtgcacactgtttttctttgtaataatgacttctttatgtttcccttaacttgtgtagtctctgctataaatggattgtacatttcactggggtcgccaaaacttcctggatggtcggggaatggcggagacccctgcagcgagctttggcagggtgttgtatgcaccggctcaagtataacctcagtgtaggttcttcattgcgttttcttttatctcatggaaatcctttgttttgttctcatattaactcaccgtttgtagtacgatgaatgctgcaaacttggggggtcagcttggtggcttagggaacttcacctccatcgtcaccatgtaagggtgttgaagttgtaaagtttttccacaaccatcgtagtgtctgtcaaaactagaagattctaggatttcttttttgtctggttgaattaactctttttttatgtcctggttaaatttctcattgaattatttatatgtttgatgtagaaatcttagtaacaataaaattggtggaactataccagaagacctaccggttacgttgcagcatatgtatgtacgattgatcttatctatagtttatcagtctttggtattattcaattgatcctgtgatctttgcactggtacagttttctttcagctaatcagctcactggaagcatcccaagttcattggcaaaacttaaaaatttggcagacatgtacattctcgcttctttccgcagaaagtttatatacaggctaatttgtgttgtaaatcacatatatcattttccttgttttcccaggtcactcaatgacaaccaactaaatgggcaactgccagatgcttttggttcactcactggacttgtaaatttgtaagataccatttctgtacgtttttatgccttggtgtttggttgttgtcttagtttgctgatggtcggtttcttgcagggatatttcttctaacaacttgactggtgtgttaccaccatctatgaaaaatctgtcatctttgactacattgt

SEQ ID NO: 75143 - DNA, 1109 bp, Oryza sativa
tgggaccaactttttatcttatttgccacttcagaaaacctcattgtcacagtcttagtcaaaatcttcaaaattacattttgcaaacaaataggtctatactgcttgattttatttgcatcttttattttgggaagcaaagttatcaccccatagttaatcctatcaatatctagctcccctttatgcaaatcatcatcatttctttgatcagacccccaaaatggctccacagatgtttgtaaaaaccaactggaaagccatcaggcccgggtgcagtgtttgctttcatacttttgatcaccttctccacctcctccatagagaaaggtctgaccattcttaccttatcctcttcacttaacctaagcctatctccccaagcatccccttttagatgaatgttgcagttgtcctccttaccaaaaagcttcttatagtacccatatatatgctgattgatttgttccttatctgtgatcacctcccctcattttgtagagagaaaattaaactcttccttttcctaccattagcagacctgtgaaaaaggaggtgtttgcatctcccctaagcagccaagtctctccacatattttctgccaccaaatctcttcatgagagtaaatatcctctaattctctttctaattcatacctttctgcccactcatgctcaaaaaggtccctttcatctgctcttttgtcgattgcttccaattgcctttctaaagctttttttcttcttttttgttcactgttcaaattagcaccccaaccccttaaccaccttctcagaataggcattaagacatgccaataatccaacacccttttctgtaatcttgttggcataactttaattaaatgatatgaaagtttggatgctggaaccaccccatctcaaacctgaaaacatcactccttgtcttttcctcatccctagtgtcaactagtggatatcgcgttttgaaagcgtgatatcgaggttcgcaacgggtcaggcaataccgccacgttaccgccaataccaattcgtgagcgagagtgtgacgtcagctatggatttcctgctagtcttgagcaatgaaagagcaaagacatttgagc

SEQ ID NO: 75144 - DNA, 1302 bp, Oryza sativa
ggtatgtatgcacatgtgctctcctcttcctccctatgtttttttctcgatctatttctgtcggggggtttgatttagttagggatggcgctccatcgtacctgcttgctagttgctatcgtgttggaaggtgaggtgatgttatcgtgttggtcatcgtcagcgctgcgcctccccaagtttttaatttaggttcccttttgaagaggtgttgaggatcattacatctaaacataccattagtataattacatcgcaacccagtagtattagaaagggtatgtataacccacataatttttgcaactacaagatgtttcttaagagtgatcaatgagcaacattagttttttacaacatacacctttgtcatctcgcagatcggtgggctgctgtccagcaatgatgtcgatggcctccaccaccgccagccccttttgcccttcacccatgcccagaggacgcaaatgcacagttcgagttcaaggtatccgtctactcaatctatgcagtactctgtaatctgatcgatttctgatttcttttgcttaatttgggggtacacagctggagctgccggagcggatgcatctgataagtcgctcgagattatgcgcaaattctctgagcagtacgcccgccgctccaacaccttcttctgttccgagaagtccgtcaccgccgttgttatcaaggtaatggaaccaaatctattttctacttctctcttgaatcctcgttaaactttacttttaaaaaaatctcactgcgtgcacatacaaatcaaatactagcaaaaatcatcttagccacaaacaaattcttctatgctgctatttcatgtgttctgtacctgcagcttgataagaagattattacgccctattgctgctgttgaaagttgatgcagtaggcttcaatcttaggtagaagagaacctgccagtatgcccctgattttccattggttagcaaggccttccatacacctcattggttcaacacgctaagttaacacacagttttaagtatcctaggttgcattgatgtagaaggtgagtgctgcgtactgcctgagattttcagagcacaaaaggaactttgaatgcaacatgtatttctttcccagtgctgtttgggatatgaaacaactagagcagaaacagtgaagcatgccagctgaatgctgattactgaactaaaatgtatatgaagagtgtattcacagcaatctcttcatgaaaaaaaatagaaaacccaagtccaacataataaaaggcatatatttgagccccatcctcta

SEQ ID NO: 75145 - DNA, 8753 bp, Oryza sativa
cctccccccccccccccccgccacgctcgctcctagctgctgcaatatttgagaggagaagatgagagcaagtgaagaagaggataagggagagggggaaagaggtggaatggtaggaggaaattaaaaagataaggagcaagtgtttgcgatagtggaggagaggataagtgcgagggattatatatactacatgttaaattttagtcccgattggtagtaaagattatttagatctttagtccaggttataagatcctcagccccctgacaggccactgacaggccttatcagggatgaaccgggactaaagttccaatcgggactatagatcacatagttccgatggaatttttaagcgggactaaaaatgcttttttattaatctagtttttgactgacccagcaaaggtcagttctccagttgtggtataagtcaacagttaattaattgttcaatactacttactccgtttcaggttataagacgttttgactttggtcaaagtcaaactactttaagtttgatcaagtttgtagaaaaaaatattagcatttttaacccaagacaaatttattatgaaaatatattcaataattgattgggtaaaactaatttagtattataaatattactatatttgcctataaactcatctgtgacgggctccaactccaacccgtaaaaggtgactcggtcccttttgacggggtactttagagcctagcacggatgactaattggtgatatagtcctcttgcaactcaataacaatgttgcttatagttggccaaaagcccgaggcctgatagcccggcccggccatggcacggggttttggtccggcccaagcacggcacgacctctactttggcacgatggcccgacccggcatggccaggtccaactatcagggatttaatagatgagggagccaaaatagacttaatccaaccatataaggcacggcgaaagagatgagggagacaaaatgaacttttcaaaggaggaacacggtaggcttcgtggcttcgagttggtccggcatgacccgagtcttattgggtcgtgcttgggccaaacgcgcagcaagtggatgggcacagcacgatccggcgtgtaggtcgggccgtgtcggcccgactgatatcggcccgagcccggtcatgctcgggccatgctagggcgggtgatccttttggggtgtgtttggttgggtggatgagcctggatgggagatgcatggccgcccgattttttttggtgtttggttggagggcagggtggatggggcggcccagaatagggaatcttccctcaataggttggataagtgcatctggccgatttggttggatgaagccatctagttttggtccgggtgatgtgacctattctgattggctatggttggtttgattttctgttaagcaagctctaaatgattttttttctcctaaactgtttatctaatttatggtttgattacaccattatatttgttacaattaaatctttaaaacaagatctcggatgattatattatgataaaaatatatatatatgacaaatgggtcccactatcttatggtttctcccattcatgctatatcccctaaccaaacaagaaattggatcaacatatccatataaaccaaacaaaaaattgaatcgccatatccaacaaaatatggatggccatatcccatccatgcatgaccgtgaaccaaacacacccttggccatctataatgctgctcaaccgtgacggggttatatatgttgtaatccggcaccaaagaggttttaccttaaaaatgtaactgctaacaaaatgacagaaatagagatatacattcctagaatccccatacatttcacaatcacataaattccaaacctcgattatttacaagtctcaataattggatgcctcacatatttcttcaacaaaactttaagttgcaagcctgaagaatttagggaactggacatgcatcttgaaaagagagctatcacacgacctgtgaatttatatacaatttgataaaaataatagaattagtaacgcaaatgttaccaacagcccaccatatatagatggttgtcatcggtcataggtttgatcacacagcccatcacagatgattgccactgtacgggctgcaggtctccgtcgctgattggctgattaggatgctagggttttgaagtagtaaggctaccagtgctacttccaaagtgccgaagagagtttctctaatagtgaaattctcctaatgactcattttgtttttgtgctccaaatttcatgcagtaccacatggggttttcatccaggggaaaagagatcgatacatttctatgcacataaggttactcgccgtgcacaccaactaacatatatacaagaaattacagaataattgatacatgtacatataatactattgcacctatatgttaatatgtaaagtctcaacagtataacatgaaaaatctgataattttctcagagttttgtcttctatgtctctgtgttcgctgaatctaaagtggagacgttacacttggatatgttgttctattataagtacatgtacaattttttaaggcatgttggtgagatttcttaacacggagcttttgtgtacatccgtttcatctagtctagttgtttgttggaaatctggtcttcatgtatctgagtatctctggggttttgatatcagtaaattctcaacttgtaacctagctgaacaaatcgagtagtattttttattcattggcgagttattccatcatatatattgtgatatctcacattgattgtaatacttttacgcaggtatacgttcaaacaagatcatcttactcactgggacatagacaacatcagtgttcctttcgttcttcactgggatatcaaggatggacctgcatgccgaccagagacaaattatgatagtcccttcggcgcatgtcatagcaaccacagcaaatgcgccaatgtcaccagtggtttggatggctatttttgcaactgctccgagggatacattggcaatccgtacataccagatggatgcaaaggtttgtatcccagcgctctactctccatccgcatgcttatgttttttttagataatggattaaaaacccgacctctacatccaaaaggatgtacacagcccaacatgtccatacatgagtacttagactccagccattacatgggacaaaaaaaagtttagaagacacgaaaagaagacagaattacaagttcaacaaacaaaacgaaatgactagaccaacaacctcaacgaccaaactcaaagaaccggtctaaacttcaactctctttctgaaattccagccacacctagacaaaaactccaaaactctcatctctaaagccttgcagcattctttaaccacgttgccatcctcttccttaagcagcaaagaccaaagtctcacccaattaatgcattcccctgaaaattacctacataaaagagtacgggtatgatccattaaaaaccacatcattcctactcaatcacaccacccagcacaatgctgaaatgcccacaaacacttgatttttaagcctaggattaacactggttagccaaataccaagtaaatgtgacactgtgtggaggctgatgccaaacgtgaaataaaccacgttgcacacgtacctaaccaatggacaataaaaaaaaggtgttgtattgtctcgttagaattacaaaagcaacatctaaggctacctttccaccttcttttagcaagattgtccttagttaaggtgactcctttctaaagtaccacaagaaaattttaatcttaagtggaagccttagcttccaaataaaagacttcgcatttcgaaacatgattttttttacatcgaattgacagaaaatattccatgcttatgttattagtcgatattgtcggaaatctataaacacccacatcccataggtaagtacgtacatatcccctgtaggataataaccttacacctatctagatcacagctgtcagtggaaaagtttgtacaaggatcggagctctcaagcttgttagactaattcttgctgattgtagaaagaccaactctcactgacgtgcttcggcttgcttttatacccaccaagcaccagcactctctctttctgtccacaaggagacatataatattgtatataatcattagcacaattagctctttgaagccgcgcgcaaccagtttgtagaaaaccaaacccagattcactactggatttggataattggccggaaggcaaaaatcacattagtcccggttcaaataggaatcccggttcaaaagcccaacagtactttttgatctttagtctcggttggtaagatcatttttagcccccgttgagaaagtgttaggcccctcactatctttagtcctggttgggttaccaaccgggattatagatcgacgcgtgcgtatataatctactcgtacttagcaacgcgcggtgcacttcgttgctctcgtctctcaatctcttcgaatcctcccctctccctctctctctctctctctctccctctctcagctctctgtctcgctccctctccctccaccgcaccacccgatgagagcggtgggagcggaggagatggcggcggctcagcagctcggaggtggcggcggcgccctggtggcggcccgatggctcggaggtggcggcggtggctccctccgcctgttcgaactcctcctcctccctttcctcatcctcttcctccgtctatcctcctcctctccgggagcatcgggcggcaacggcagagccctcccttctgtcggatccggtgtcccctcccccggatccagcgggaggggaggcggcaggcggcgcatgaggggcatgcggcggtgcacgagggggaggaggcgagcggcaggcgggcgcaatgatgctcattcttttttttttttgagaattttgtgatgtccattcgagtatgaattctatttgtgatattaactgtgaaatcgtgatgtgaaacatagtatgttcattcgatctgtgatgttaaattgatgtggggatttggggatttatatatggagcactcgctttggaaaaatcaatatgcaagtagcaaaaaccaataaaaagaagcaacccgaaactaaagggttgcaaaccaggactaaagagggtatcctcagcagttatttactcgccgctatacgcacccaaatccatgcatgtgaacacgagaattttgcttacagcgtactccctccgtccaaaaaaaaaatccaatcctataaatgtttttgaacattcacgttatccatatacatcctcaggattgttttttttccagagcagtatccctttgcgttaatataataggatagtgtaattgaatctggagttaatgtgatggatgtgtgatgtggcactgactcagcaaacaagtaaaggtaaaaattaaagttggcgacgaggaagactacattaattggagattcgtgtagcggtggctcgaggtggaagatgtgagtgaaaggattcagggcatatttggtagagctccaagcctccaactcttaaatttagcttcaggagttgggtctggagtggagttgtggagcagcctaaacccatctccacctctaaagttcattatgtgagagcgcttcacccagctctgctcccactttaggtggaactgaaactgtttggctgagctctagctctaggagtggtggaggtggagctatagctggagctatgccaaacaagctctcaattatgcagcgatagcgatgttgacaaacagtggattgttcctatgacaaataggatagatgcaattttggtttccagcgataaaatgggccacatgtatactccctccttcccataaaaaaccaacttaatactggatgtgacacatcctagttctacgaacctagatatacctttgtccagattcgacgtactagaatatgtcacatccaattctatattcgtttttttggttggatggagcgagtatatatctagctagccaataggctacggtcatctaggccaccgagccaggtcaggctcagcttgcttcattaaggagatacagagccaggccatatttccaacggtaatagaacatcccccaagaagatgagttcataagtcaatgtacatgaatgaatatattcacagtcaaatttagcatttggaaaaatttaggcgaagccttgggagggatccgagagagccttctcgctaaagctagtaagaacccttgtcgatctgaccggaatcctttgtcatgagtagaggtcatggatcggttttgtcatcagaatccaatccaaatccaatttggctcttcttgtgttcccttttttaggtgttagggtttttggagtactaattttctctaaagcctaattaaaccttgatacgcaagaccagccatactataaatatagatgtcaagcctattgtaggaaccaacaattaatcgacaaaatcgatttagtatctaacctctatcttctaccctacctatatcattcttcacttattccatccctattttccctccaatcccataattgctcacgtattttgtctcccctgcattagaggacatcctaactggcttttcaagcctagatcaaactggcccacactcattttgcgagttgcgttcctccattgacaatgaacatctacagtaccaccctttcgttgacttatttccgtgttcactactcttgaacccttcctctcgtatcgagaagcactgcatacagggaattttctatggcatatttcttgtactacgatatcaacgcggtcatggcgattcataactacgagtcatagatgacccctcattcttaacaggtgctacatcttagacgagccactctgtgacccgtaagagatgtaattatctgagacgagcatttttcacctatcatagattaatatgcccctgtttagcatcccaagtttaggctgtgcaagttttaacacagggccagagatatttaactacctatattttctccttcatgagcgtgtaagtaaaactaagaatagctttatttatttttatatttaacatctactgttttctccacttttcagatgttaatgagtgtgaaaacaattctatttgtggtgctgggtccacatgcaagaatacagaaggtagctatcgttgtgactgcaatttcggccaaagacgtgacaatagttctgataacatgggtaattgtgaacccatattttccagagctgccatagcagtcataggtgaggttcaatacatgaatgcaatgttgattgaaatttgcagcatgccatacattccacatataatatataatgctctaattacatgcagttctgcattccatgtatacaccatatttgcattgcactacattcaacttgaagctcaacattgaagtgtgaaaacataattatttccagatagaccatggctgtgcctaaatgttatcttttcgcatgagcatagaccatgtggttgtgcctaaattatcttttcacgtgagcaatatatatggactacgcaattgcatgaatatgtataagttacctttgcagtattgcatgttctatatattaactattttgtttcctatttgtccacagcaacagtttttatcatcgcacttctagtcgtgttactaatgttcattctattggagcgtaagaaaagaaagctgagagcttatttcaaccgaaatggtggacaattgctgaaaagtatcaagatagatatttacacaaaggagaaacttgaccaaattactaaaaattacagtactattattggaaagggtgggtttggtaaggtgtacatgggaaccatcaatggaaatgtgcgagttgcggtcaaacgctgcataacagtcagtgaggcccggcagcgggactttgcaaatgaaatcacaatccagtctcagattagtcataaaatttagttaaacttttgggttgttgcttggagacagatgttcctatgttagtctatgaattcatacccagagggagtctctgtgacgtacttcatggtaaagagtataataagaaacatcctctctcactactagcacggttggatattgctattaactctgcagatgctcttgcttatatgcattcatatgctagtcaaaaaattcttcatggagatgtgaaatctggtaacattcttttggatgataactttgtgccaaaagtttctgactttgggacatctaggctcatgactattggaaaagaccacaccacttttgttgtcggagatatgagctatatagaccctgtatacatgaaaattggccttctcacagagaaaagtgatgtttatagctttggtattgtccttttggagctcatgacgggaaagaaggcaaggtacaatgggaataatagcctccccatgaactttatggaggcttacatgacagagagtagagcatacgagatgtatgataaggagattataactactgaagaggacataaaatgcactgcaaatgttggtaccatcgctgttaattgccttaaaaatagtgtggatgagaggatgaccgaggttgtgaaggatcttcaaattgtgccaagtgaatggttgcaaatccttgggcatagggagcatgactcaactgaacctatgggtatttaatta

SEQ ID NO: 75146 - DNA, 1698 bp, Oryza sativa
ctgcagccctggtgatatttgttctttgatgtgtatggtgtgtacacaggaaggcttatatgtataggatacgttcttatacatctatgtgtatttcttcggaaagaattattacacatcaagcattagttatggttttccacgtgacctagcatcctattcgtgtccaagttgaaaggagcatatttatcattgagatgcccatgggctcaccagcaagcattgaattccaatgtattctgaatgaaacaactcacacagctcatcctccttgtcttggtgtcatggtgacatatatacattgtgctacacaactaagtaatataagctggtagtttaagctggccatacatgcatccatcatccatggctgggatatcgcagctcctcctgcgcgagtccaccatcaccatcaccatcaccaccaccactaatattcccggtgccggcgtcgaattgcccagacaagtgcggcaacgtatccatcccctacccgttcggcatcggcagaggctgctacctcgacctgccgggctccggcagcttcagcatcacctgcaaccacaagacggaccctccccaaccctacaccgccgatgccctcttggtcctgaacataacgctggagacagcggaaatgttcgtcgtctcggctggcgccctcgccgtggtcaagtacccatcagtaagagcaagaagtgccatcacgagcaaatttatcactactactcaacaagaagaagaacattctatgcaagtaaaagtaactgtaggaatgcctgtcacccaacaagtaaacatgacattcttaccaagcggatacaccttgagcgcaccgtaccggctttccccgacgggcaacatgttcacggccgtggggtgcgtcaccatggcgaagttgtacggcagcgtagagaacagcagcagcagcagcagcacgggggcgacgacgacgacagcagcagcagcaggagggcaaatgataggggagagggcgtatgcgtacgacgcgggctgcatcacctactgcccgagcctgagcgacgccgcggcggatggggcgccgtgcaaggacctcggctgctgcgagtcgcccatcacgccaggcctcacccagttcgccgtaggatgggggcgatggccaggtgcatccgacgacgactacggcgagttggaccccgaacagtactaccagtatgcctttgtggcccaggactggtaactagctaattccggacctgatgatgattctttgttatactatatctttgcaagtttttagatgttttcccatttctaattaataacttgacgttgcctagctacccaccatatattatgggttttaattggtgtttcccatatatatatctctagtaaagaaaatttcagcacaaggaatatatatagcacccatatatataatactaaaagaattggcacacgtatgaatttttaaaattgtttcaacagtaatgtagttcaaagactgttcatttcaagtcatctatagcatcaaaatacattacgttttttggaaaggacttagaagaattgcatgtatagtgtacactgctggagaatgcatatatactcccggttcacatccctctttaatcccgggtatgcaaccggaactacgaatcgggtgaaataaccggactaaagatatatcttctttagtcccggttggtgtag

SEQ ID NO: 75147 - DNA, 3850 bp, Oryza sativa
gccgccgccacgtgcaagtgcctcgacggcttcgagccagcgagcggcggggagtggagcgccggcaggttctcgggggtttgccggcggaaggaggcgccgccccggcgccgacggggatggtttcttggtgctgctgcggatgaaggtgccggacaagttctcgacgctcgccgggaacatgacgttcgacgagtgcgcggcgaggtgcgccatgaactgctcgtgcgaggcgtacgcccaccgcccacgccgacctgagcagcagcagtgcccggggggatttcacaagcatatgcaggttgtttcatttgctgttggtttaaaaatgacctgaaaactgtcaaagagaccaaaaaaaaaaatcaaaccagtttcgtattgcatttgttcataatacattgccatgcggagtgcgagcgccgcggcaaggaggatgcgaacggaggaggcgggtcacgcagagtgcaagcgcggcggcgaggaggatgcgaacggaggaggcagcggcgaggaggtgagcgcggcggcgaaggaggcgagcggaggaggcgagcgcggcctcgcagggcgggcgggggaggacggcgcgcgggggcggttggtgggcggcggtgcgagacgaggaggccgacgacgcggtcgagctcgtcgatggtcgtggcgacgacgatgttcccctccactccgcccccctctctctctgccctgagctcaccggtgtccgtgccgacgacgatgttcccctccactccgccctctctctctctgccctgagctcgccggtgccgcatccatctgcttccacctccgcgcccgtcgctggtacgtcgccacccccgccgacccgcacgagggggctgggaggccggcaagctcgcgccgccctgagcccgcgcgccccgggagccgccgttcttgggtcgcccctgcgccgcccagtgaggtagtgactccgtgagagagaaagtgagtgaagagagagaagtgactttgagagagagagagagtgagtgaagagagagaaagagaggaagaggggaaggggaggtatgacacatgggtcccactatttttttaaaaaaaaattgctgactggattgccacgtgtacgccacgtaggacaaaaccgctctgaattgggtcgaggggggtaattcgtccggtattgaaagttcagggtgagtaatgtccggttttagggttcaggggggtaattcggacgaccgtgatagttcaggggggcaattcgtactttttccattatttttagcctttagatgattaatctacagttcaaactatctccctacttttcttcttccataaagtcataccagcattttttttacgtttgaatcacaattctacatactatttaaatttaaattatcataaaccacattaatttacttaatctgatgttatctatctatcttacacgttattttttattgttatcatactaaattcccgcagcaatgcgcggggttttacctagttatataaagtttactctactaaagaattagtagtgccaaaatttacttacagtttagtactaccattgaattgatagagtagagaatcaaatagatcctaaatttgtgtacatgcatgtgccatggctctgaacaattcaatccgtctaatgcagggtttgcttcgttcatcggaaaggagcaggcggtggccaagtacagcagctcactgaagagcgtcatgtgcataaccagccaccggccattcctgtctgcgtgctgtccactgcttccgtgcgagcacagacgacaggttggggcatggccacacggggcactactccaccggctggaggctggagctgcctcccccgccgtccgctgctacagccagctcggctcattaaggctcggctcgtttgagctcgttgtcttaacgaaccagcttggttcggctcgttaatgttaacgagctaaaagactagctcggctcggctcgcgagcaggcttgttaacgagctatatcttattaatatcatattaataatttcaaatttaaaattttattatgtataaacatagtaatcaacactaactaatatagtactcactaaatatgaatagttttgatgtaattaaaagactaagcactagtcaataaacactaagttcatgaagatatggcgatattttatactaacgagctaagcgagcagcttgcgagctagctcattaagctcacgagctaaaaggctacctcgtctcgactcattaagactacgagttcgaatcgatccgagctgagcttgctacgagccgatccgagccacgagtttcgagctttttgtccacccctagctacaagtcatgccccaactcgcctccgtctctagcccattcctacaagtccaattaattgttcaaatgtgaacttttggataatgcaataaaatcccggcatttgctcaaagagctacagccaattattataccaattcaaacaaaaaaaagcataacaaaaaggtcgtaaaactaaaatgatagaaacacatgcaaagtactaaaaaccaacacaagaaattaccaaaaaaaattgaattctatttgtgtatctccacctgaagttggtaaaaaattgcataaccgttaactcaacattacgacatgcagctttaattaacttgatatcttcttcacacttttacagttatgcccaggaccagagccagtgtattgacctaaaaagaacctgcatataagatatagatggtgatttgtcaaaaaccatatcatttctattcaaccatagagcccaacatatagcagaagctcctagcaaaataagtttattagattttttatcaatccccataagccaattcccaaaggtatgagatatactatgtggaatatttaaaccagaagaaaactgtaattctctctaaagaaattttgcataatgacagtccataaataaatgatggatagtctcatttttcatgcaaaacaaacatttcaaactagcatgccaattcttcctagtcaagttatcctttgttcagacaaaccctttaccacataaaaatcttacttaaaaggcattttgagtttacaagtaaacttattcctttcaacgtaaccattattaagtacatagaatgaaccgagaagattccatctaaaaatatcattctactctgtcaaatgaagatgcacaattgaagcatacaaattatgcgaattagtcaggttctgcgctactaaagctctcctaaaagaaacattgaaagaaacggaatgcataacatttgcaaccaagaagtttctccttctttctatagcatataaagatgggtacctatctttaaaggaatagttaccaacccatttatcctcccaaaatataacttgttcaccattattcacaatccagaaacccatatttaggaacgtattcttaactttcataaaacccgcccaaaaatgggaattcccttgtttcctattaacctgggttagagatttattattaaaatatttcctttttaacagatcttgccaaacactttgctcattaattaacttaaatagccacttactcaaaagacattgattttgaatttgtaaattaggaactccaagaccaccttgatttttggacaaatcatatcccatcttgtaagtctatacttcttcttctgttcatcaccgcttgccaaaaaaaaaggtgatatataataatcattttttttagaacctcttttgaaatctaaaataagatatcataaacattgtcaaacttgagagcacaacattaatcaaaactaatctccccctacagatatatgttcagatgtgaatagcaagct

SEQ ID NO: 75148 - DNA, 1880 bp, Oryza sativa
gctaaagctagcaaggctacagctattcattcatttcatttgtctatgaccgagaaggctagacgaaaccatggccgagtgccgacaaggccaggtcactatactattaacacgtctaaaacggacgggaaccggatgcaccgttgctgggcaccgacaaggcaaaagcaacaataaaatccatgtttgatgaaggccggggtacatgactgggcaccgacgaggcaaaggtcacccgcttcaccaaattctctccgcactccgacgtggtggtagtgtactgtgaccgggttttggtgaaacaaagccatccgttccacattcactgtattcaacattaaatctgcaccaacctcaaccttcggcgagcaaacaactttgaagacgacgatcataaagcgcagcttaatcggaggtattacataggctcgtcctgtggatgtaattaaccggtagcctcattgttaggcgtcgggaatcaacggactgcacgcaatctccagtcagcataccttttcattaagcattcctcacgaaggcaaaaggcgaactcctgcgggagctctcatgtatttgtaaacattcatgttaatgaatcatgattaataaaatacagggtttccctattttctgtgtgttcgttgttttgtttccatcaaacatgtagttttgctttgcacacacgcactttggataagttgtttttaactaaaaaattgtttcaaaaatatcaaattacttttcatgctagtttgatgtttaacatgatttctgctaaaaagttaaaacaatctcatgatgttttggattgcttaatatgtaatttgaataagatgaaactaaaagatgctttaggtcgtgttgagtacatggaagatgttgtgaaaaacaatgaagtgctttctgccccaaatgtcataaaagcaaaggtgtcatggtagattgtgaaaattgtgctaatttggaaaaagaggtttcttatttgaaaaattctttgcaaagattttctgatggtaaaaagaacctcaacatgattttggatcaatcaaaggttagcacacataatcgtggtttaggttttaattcttatgctcataattctagacatcctcctgttgtgttaggtgttggtgctagaagtggtgagattttggttaaacctgatactaataaaactgtgtttaaatctgctggcatcatgtctaccttgaatgcatcttcttcaaaatccaatgttgtgcatgcaaaacctcctgttgttgcttgtgttgctaaatcttctaatgctaataatgtgtctaaacaacgtgaaaagtatacttgttctttttgtggcaaagatgaatatattgttggtttttgtttcacattagctcataaacagaaaaaggagagagagattacttttgcaaaatcaaagtggcaaaaatcgggttttccctcgaggaaaccggtcataccgcattgggtcccgcggtcggaccggcgaccggtcagaccagctgaacagccccggttagaccgaccaccggtcagaccggcggtgaagcctcggtcaaaccggcccccggtcagaccggctgcacaccctcggtcagaccggcctcagaggattttttctgaaaattctaaaattaattttgcacgtggatatatgcctattggatcttttggtcgtgtgtctcagtactggattcctaaatttttattatcatctaaccccagtactgaggcttcgacttctgtttgtgtgtaggctttggtagcaaggaaggagaacgtgtggatcgtggattccggttgtttgcggcacatgaccggtgataaaaattggttctcctccctcaaaaaggcatccaagactgaatcaattatctttg

SEQ ID NO: 75149 - DNA, 8207 bp, Oryza sativa
gcgctgtggtgggaggtgtcggcccaccgcgtctccggcgtctccggcgccggccatgccgacgcgctgcggcggctggaggcgtgcgcgcacgtgccggcgaggctgctcacggcggtggcgtcgtcgatggcccgcgcgcgcgcaaggcggcgcgccgccgcggacaacgaggagggctgggacgagtgctcgtgttctgaagcgcccaacgccttgggtggcccacatgtcagtgacacagctcgtcagaaatgatacttatgcagaggctttgtttgatctctttttcttttcccattacaaagagtgttaagtagaactaaatctcgtgactagcctctcaagaatattggtgtagtagattttctttcctttttgtttgaaaaaaaagaggtggctaccaatgctgtaacttcacatatgtgattagatgatagtgctatagggaaccatacattggtctaattaattattggtgatttgattagacttgtgaacaaatttgtggctcacatcattcacatgctgtttggtcgtgtgggggaaaatatctggagttgtggatcatagcacatgcacacagaataacagaaagtcataaactgtttgcaaagtttaatgttgtggagtcagagatcagcatgcagccttagtggcttatgtcatcatgcagaagttagcaatggatgactttaatttgagattaattcagaagcttacagtttgcactaccttgtgtaatttgagatttgacatttttatatttgcctcctgtattggatatcagagcatgatggattgatatagggtttatgacttggaagttaaaagaggagtttgcccacacttccagctcctagaaatctttttcacataaaggaatacacaatacacgaatatgtactgattaagcaatgactaaacatgaattggatctccagcagtatttacttattagtagttgaaatgtactgtactaggagtatgtgttttctgggtgaatgtgctgatcttgaagacttgatgaagacttgatcaagttcagactatcactttcagagtttccgtaccaccgaagcaccggctttctcgttcattgcgtcagtaagatggaagaagaggctgctcatcgtcctcgctgagtacaaatatgcaacctcaaaccaatttccaaccctaaactaaactagaacatatcttgaattctcgatcattcacacgtatacatctgattcaagtatcctccaagataagtggattgtcctactgcttaatgcttctcagagaaacaggtttgctgcagagatattattagttgttacctgcacaagtgtataaatcattcttgagtcttgacaagcactataatactcccttcgttttatattatcgatcgatttgcctttttaaagataaacttctcaaaagtttaatcaagtttataaaaaaagaaaaatacaagaaataccattgacaaacatcaaattcaataaataccatcaatgagtgcaactttcataaaaccatcatacaaacaattttatcccagaaataccatcgtcgataggattatgtccattccacgtcgttaaaatgcacacggttcatcctatagcactttaacgaaggactgctaacgaaaacctaacagtggtgacatttctaagacaaagtcgcttgtacaatggtatttcatggaactcgtactcatcgattgcatttcttagaattgtgtgcttgtcaatgacatgtttaagattctcttatagaaaaatataccaacattaatagcgcaaaattagttttcttaaatctagcattaaatgtatttttgatagtatatttattttatgttaaaaatattactatattttgtatgaacttaatcaaactaaagaagtttaacatagaaaaatcaacgctacttataatatagtagtataaattaccacgtaatttcgttctggcccaactttataggtcgcacgtacgccataatcgtgtttccggcccaaatagtatgggttgtgcagacaccgcaatccagttttggcccactccaatatacacggccaccgcatgggacggacagcttcgttgtcaatgatcgcagaaatcctaattcgcgcgtacgcgctacttctccaagtcgcgagcgtgccacatggccggtcctcctacgaccgagcctgcgcgcttcttttttctttttttccctttttttcaagtaggcgcaactactgtgtttctttcttcttctttttttttttgccgttaactaccacacgcgtctaagagtaggagtcaatatttgaaaacgttcaggtcaagatttaaaaacttttaactcagattcgaaaactttcaagtcaagatttaaaaactttcaactcagatttgaaaactttcaactcggacttgaaaactttcaactaaagatttgatactctcaattcaaatttaaaaatttcaagtcaagatttgaaaacttaactcaagtttgaaaacttttagctcaaatttaaaatctttcacctcaaaattcaaaatatttgataaaatttgaaaacattcatcttaaaattcaaaacattcaacttaaattttagaaacatttcaactcaaattcaaagctctgatattgaaggtgaaagattgaatttataaaatattaaaaaaaatcatgcgcgcgtgtggaaaagaaagaagcgattaaaaaatctggaaaaaaaagcgatctaaaaaaggaaaaaaaattacgttaaaataggagatctaaaaaaaaaagaaacgcgtaggacgcggctggcgcccgcgccggcagcatcccccaatgatcggctgggccgggaataacaataggcttgatgtacctggaatttagcaaatgactacctgcttcgtcaggactatttggaaatgagccctttcctggattatttgcaaaaagaccctactctgggttgttacgggcttattcactttgtggccaaaatcatcccaaccaaaatttctttatgaatcttgttggttttggatgaatttagtttgatttctttacaaaattcgatagtgtttttatgcgagaaaattttcaaaactaccaaattttgataagatgataccaaatttaatcaaattaaaagcagtagtaataaattgaactctggttcgatagtgttcgatttattactggaactgggaagctctccgcgtccggttcactcgccggacgccggcggcgcatcatctcggcacaagcaacggcgatcgccgccgccgccggaggaggacatgatcagtgcgcgcgcgcgcgcgtgctcgcttgtgctgaatcgaatgcttcgatcatctgagtaggcacccatggcgcggtgcgccgatggatccctctcatttttagcaaccgccgaagtagccgggcagcttccaccaccaccaccaccaccaccaacgcgcgagcctcgcctcccctcgtctcgctcttcctcttcgtctcccagctaaaattggcacaccgttcgatccaccccccccccccccccccttgcgcgaggctgcgggcgcggcggcggcggcgggcgacggcgagggcagcatatggggcccggaacctggcgcaaggcctacggcgcgctcaaggactccaccaaggtcggcctcgccaacttcaacagcgagtacaaggtcagccccctttccctccccaaatcctatcccctccatcgatccgccacaacactgctgcgtaatgtgcatttcagatttgtttggttggttgttaccctgatcgatctgatacctacattgttttcttgatggaattttggcaggatttggatatcgccattgtgaaggcaaccaaccacgtagagtgcccgcccaaggagcgatacctcaggagtgagtggtttctgtcttgggggtgggatgcaagcaaattccccatatggccatatccaattctggttcaccaaatgttgctaggttttattttatttatttatttatttatttattgctggatgcagagatactctttgcgacctcggcgaatcgaccgcgatccgatgttggttactcaatatgtacattggctaggagattatccaagaccaagaactggattgtgggtttatgctgatggtccctgattttttaagcatattccatttggttctgttcattcttttgttttccaatgaatagctactgagaattgctcctgtttggaattttcaaaataagggtgagaaaaaaaaattcagatgttaacagctatttatcttgtttttgtaggtcgcattaaaaacattgatagtgatacatagattgctcagagaaggtgatgggacatttaaagaagacttcttgaactattcttatagaggaactattttgcagattccacaattcaaggatgattcgagccctttaggtttgtgatttttttttctctgaactataagagatctctctatcctagtttcacatctgaactgatgctctccaccctacttaagtcagcttgggatgctctgttgggtgcgcacatatgcgtcctatctagatgaacgggtcgagtgctttagaattctaaaatatgatgttgaagcggatcgcctggtgaaattaccccaagcttctggcaaggtgacatcagatttctaagttggatacagatagtcgaacagcgttaacagaattctgactggctgatttcatggttgtaatgttgaaatcttgataaattaattccaggcacacagcagaacaagaactctaccatgtggagatcttttagatcacttgcctgcattgcagagactactactcaggctcatttcttgtcaggtttaattttatcaagctcacatgcacttaccctgttctccaatattattatctcgtcaagtccatcatttttgttgttgcagcctgaaggtgcagcctgcacaaattatcttgtacaatatgcattggcccttgtaagtttcaaactttgccataaagatatccccttttcattacaattttaattcacagcaagtgcgtgattcctactactattgtggaggttttttttattggccttaggttttgaaggagagcttcaaaatatactgttcgatcaatgatggcatcatcaatcttgttgatatggtacactgacagttcttcttgatatcctcccaagtgttttgcatatgtggagcaacaatttgtgaacataagcttggtttctgatctcatgtagtatttcgatatgcaaaaatatgatgctatcaaggcacttgaaatttataaacgagctggctatcaggtacataaagctctcatttgtgatattctgtagcgaggagtagcatatagctacgtcaacttactattttttttaactctatggtatgatttttcctgttcaacaggcagaaaagctttctgctttttatgagcactgcaaacgtcttgaattggcaaggactttccagtttcctactttgaggcaggtacattcattcagtgattcatccctgttttaaattgaagaatccttcccaatcttgacttcagtaggttcattacttctacataaaacgaaatagttttatcggacgcggaaagaagcacgaatatcctgatataccaaacattcctaattagtacccgttgtcaaaatcacatttacgtgataatggcctacggttttctttacttttttcttggctatttgcctattcctatgtataaatattacacttcagttatttcctatctgctaaatctccagttacaatgatttcatggtgttttgatggattacccatatgcagcctcccccttcattccttataacaatggaagagtacatcagagaagcaccccgtgtcagcatagcaagtaaaagtttggtgagtgcgttaacggttggtacaactacaaagagaaggtcatagcagaaagaagattccacagcagttctgttgatttgtttctgctgctgaaacaggaaagcgaggagcagaattcacctagtgataacgaagatgaagctccacaggaaacagagaaaccagtggatgaggaggaacaagaaccttcagagcctgaagaagagccacagcctacagctgagtccgtggaaggaacagagccggtaccactagcaactactggggatctgttagtaagttccatctcctccaactcagtgcctatttcatcgcatcctccacgctgatttctatgttgcgtgcagaatttcgacgaagaagtaaaccccctgattgcaaatattgaagaaagtaatgcactggctctgcaattgtggcaccaggtatatactagatgcaatctctggttcagatatactactttcactcatatttgtcatataggataattggctaagtagctgataaggacaacacctcagcattgaatgcattttatcatcgtcgatcctattttcatgtgcggatactgttttttagtttctaaagattgtatctgctactaaatattgtactatggatggttcagggaatgaaaacaaggcctcagcttcacaagatttgtttgcgctggacaagtctgggtgggaattggcactggttaccgcaccaagtacccacacaagtcgaccagttgacaatcagttggtaattatcttctttctagttgctgtattttttaccactctatacaggatttcagaaagctcaatactagcaagaaggataatcataatttgcagctgataccaagttactactaaaatcagtcaatagctaataacttatctgcatttgcccaacaggctggaggatttgacaagctactgctagacagcctgtatgaagatgaagcaaggaggcagcaaatagccagtgcaacctacaacggcagcgttgcaggaaacccatttgatcccaacgatccatttgcaatgtctaataacttcgcgccaccgtcgaatgttcagttagccatgatgcaacagcagcatcaggattatcaggagcagcagcagcagtattatcagattcagcaacagcagcaaatggtgacgttgccgccgcaaacataccatcagcagcagcagacacagtattctgctcttccttctcatgatggattatccaatccatttggtgatccattcggtggccttgttgcgatggctaatcctccaaagcaaaacaattcaaatttagtctgaattcgcacattcttttctgtatcaccctccgatttttgatcgtatctccttttccaattttgaggagcaacttgtatagtccgacgattttcaatactgcatcctgacgatgcaatgtaatactcacatttggaaactgatatgatcattcaaatgtcgatgtaccaaaatcacatgttatgctccactcttcatttcaccaaccaactcagataataccaagaaaagggtggtaattattaatctctttatagtttgtttgatgagtcttacatattataaccagatgagctacatggattcctgcgtttttattccctcacagtagctcatgaatttctggattctacatttgtacaacagcagaaaacaaatactagcacatgaaacaggcaaagcttgaattcgtcttcggctgatttggcttccactaatgcatcttcagctggaatttcgctcattcatcttcagctggaatgacatccgagcgctccacttcatccggaaagtgtcctgcatgatcattaaataagctaaaaatgagcaacggtgcaaaattaagtgcaagaacagtagggtagatactaaataggcaagccaaattagactggaattgcagaagagataaggaaaacaatgaaatacacaaatttgttctgctcagttcttgtgcgtgtttgttgaagcatttcatgattaggaattgcaggatggataaggaaaacaatgagtagtcacaaatttgttccgaattcgagcagttcttgtgcgagtttgttcaagcgtttcatgattaggaattgccgaagggataaggaaacaatgaatgaatagacaatagtcacaaatttgctctgaattcgagtagttcttgcgcgagtttgttgaaaaatttcatgattaggcagcatgagcaatatgggggaaatcgagatccctgaatggttagattctgaagaactcttaccatcgatgaagtagg

SEQ ID NO: 75150 - DNA, 2813 bp, Oryza sativa
agagctcgcaaaccggtggcgcttgccgcggacgcgtggtggtgtcgcgaaggtttgagagaaggagagtgggagggagccgatggtaaatatagcagtaatcgtagggcttttccgcaaattacacggtatccggttcggatttcggaaaactgcaggctgcctccgccggttttgccccaagtcggcttagggacctatccgtaaataaaattattgcaaggggttattcgaaaattacccgccgcctttacccttgtcgtgtacgcgactcaactccctctttcgttggagaggcggcggcgcgaaaaatccgaagctttcgcgggaggagctagggtttgtgtgtgtggttgggcgcgcggcgagcggcgggagatgtcggcgtacgacgaggtggagatcgaggacatggagtggaacgcggagctcggggcgtacacgtacccgtgcccctgcggcgacctgttccagatcacgctcgccgacctccgcctcggggaggagatcgcgcggtgcccctcctgctccctcttcctcaccgtcgtctacaacgaggaggacttcgccgacgccaaggagcccccgcacaagccggccccgcgccccgtcgccgtcgcctgaggcggtgagtttttttttttttggcgcaattggaatccgtttccggtgaagcgtgctcgtttgttaggttataagtttgaatcgttgctgtgtaatttggagtattaattaatcgatctcctgtatacctgattatggattcaataaatagttctgaaattttagcttttggatgacttctgaattctgttgtatgttttattttggacgaagtggggaaaaaattgcagccttggtacaagcatgcgattcgtatacctgattatggggaaaaaattgcagccttggtacaagcatgcgattcgtatacctgattatggattcaataaatagttctgaatttttagcttttggatgccttgtgaactctgttgtatgttttattttggacaaagtgggaaaaaatatgcagccttggtacaagcatgcgattcagcggtttgcaaagttaggaattgatgtatagtatagtagacctatgtaattttgagagtgtggttggctgataatattgataggtaaaatggaggagtaggatattgatgctcaggattgagtacaacctgaaaccacagatgtttgtattttgaattcctcatatatgatggcgcctgggcttgattgctttgattgtaacaggtgtgagattgtcctaacttcattgtttgtactaagacatatttaggtggtcaattaggtgcaatttgattacctactatgttttggcatgagcctacctcaaagaaatttggcagcctcttcttatggcattggtccagaaagtaaatagagtaacggttgtgcaacttgaataagtgaatgatggtgattggtgagcttcaggaatttttgtcagtcgattggttaatgtgacgctttgggggtgtttacttggttcggttgtttactaattggagaaatttgttaattgatgtggcaatgtggcatgataggttctctctttattttcgcgagtgataggtctcctgttggattatttgttgatggaaaaattaggttttgtttgtgccagtggacatgctttccaaaagagtcatttacaattagagtaactgatgatgtagattggcaactcagtttttctatggtgaggaagcttgttgaagtttaggttatagtgacttcataggtgtttattcatcattttaactgggaggatgagcttgtcttaggtgtgcaagtttttttcttgtcttgccaagagtattggtaaggctacaaggggagcctatggttctttgtactttgatctgtattgttaacttcttagaaaatctttactcgatttggttaacaccaaatttcagtattcacactgtataatattctatacattttttggtaacctttgctgcattagtagtattttcgtgccaatttgcaagcactacttaagtttcagaatgcttgtttcttcttgctgtcatttgggtattgttgactgacatcattcattgcttgcagcaggatggaatcaggcttaactaagatgagaaaacaaacgggagcatttgtacttctaagatgagaaagtagttatatcgacctttggcttttgaattcactatgtacggagttaccaaaaaaaaaaaaccacaacgtgttgacggggcattatgaataactattgcttggagattttgctgttgcatatttttttacacgatcttgcgcttacagatttacaatctcggtcacggttccatgatctgtgtggctctgtgccatgtaaaaaatcttgatgaaggtttcttcaggggaaaaaaaatggggatgatgaagcttatgcagtgcaagtatgctgacacggtataactcttctattgatgttgaatgcatagatctttacattgctgctcgatcaagatcaaaattctaaccggataaaaggagcataatattgtaaacaaagttcaacacatgagaggacaccaatcatgtgtgtttcctcattatcaaaacatacagatgaatggctccatctctttcgtttatgcttatgcttatcagataacatttgaattttcaaccttaaatttaaagctgattttgagtttttttcatcgaagtttatttttcagcctttgcttttaggtcactaataacacgtatataaaagttttatttacaaattacttctcgtttgcaaatatgctgccaaacaatgg

SEQ ID NO: 75151 - DNA, 1457 bp, Oryza sativa
agcgaaagtcagtgtcgcgataagcgccgatgcgaccaacacgctttcagtcgactctgaaagggttttcccgtgcttttcttgttcttgagagctaccaccacggatcagttcatcacgcctacgaggactgaagacggctccagaatgagccaataccctcaccatccattctgttgggttctgcagggaaggagacttgaaatgtcaggagatctgttttgtatgtattttaatttatgccaaaattttgatggttttatgcatatacctggggagaggcaaagtagtcttccatccttatcacttttgcaagatcgagtggtgtatagccttctaggttgacatggttgagctccacggccttattctgtaggagatacgtgaagatgtactcgtctcttttctttacagcaagatgtaatgcagtattaccgtcgttgtcctccaaattcagagtttccttgaacctcggatctttgcacaccaatttgactactttgtacttccgattctcaatggcgatatgaagcaatgttctacctttaacattatcacgaagagtggcacagtcttgatcggcattgaccaatgaggtgattgtgtccattgaaccaacagaagcagctatgtgtatggggaacatcccattgttgtcgggccgttgggtgtagtccgttctgcgatcttggtctatgccatcaagcagcgcagttgttacgccctgaactcctactgatgctgcaaagtgaagaggtgtacttccagaccaatcagctttattcatgagatctcctctccttcctagaatcaattcagagttctgccatcgagtatttccgttaattagtacctagctagttatgataccaattgtgtcaaagaatgtacaacctaaattctatggcaaagaacaaatcaaactttcattccaaaataagcactcaaaaagattctggaggatgcacagccattaacacgtacgtgagccttttactgttgctaggagactacctcaagattataattttttttttgataaaggagcttttattaatctcagacgattacaacaagttaatagaaccatactaagaaaacttccggcttctgcataaatgcacataaccaaaacacacacaagcccataaaagagtttgtaacaagagaaggaaagcagtaaataatgtatagtgttgatcaatgatttgatcaattatgaaagcacattgttgactatctgacaacaaccagatgatgccaaggggaaaggtgctatgtataatgagtcaagggcgaaagcataacaagcaagtactaatgtgatattcaggagaaatacaagcaccacctgaaggctatgcgaaagttaatggtgatgccagggtcagaaaagaagcaaagcaagtgcaggcattattgtagacattctcataaaaccactggcttattgaacc

SEQ ID NO: 75152 - DNA, 599 bp, Oryza sativa
aagctaagatcttggagaacccgccgcagaacctaagccaccctctagggtagagtcgttagtcgcgtgtttccttgcttgtgtgtgtagcgcgtggtttgcatcagtggggtgtgatgtaaccatgctaggttgtttgcttaatcaacttgcagaataagtaaaacaaacaacacatcaacaagaagagttagttcctttaaggtcctgtctctagttctggtctattctttcctggcttgtttcctctctcacctcaatccctgtcacagatgtttaacagagaaaaaggaaagaatgtcagcgggtatgcctcaagaaactcaagttttcaactcaatccaccactggcctcaagagagttagcaagggcacacccttggtccattccaagcatgctgcttagttcacagctaccattggttggaagtcaagaccaaaatcagtatgtgtttgatcgagcatttgccacccaggtcaatgagcttccaatgccagaagagcatgtccccttttgtcatgattgtacagagcaaggacactatgccctgaattgtccatgggtatatgccaaagaagccccttcctttggtttaaca

SEQ ID NO: 75153 - DNA, 514 bp, Oryza sativa
cggaatcaccattagctgggatcatgtgaagccacatcatcagaaatatagcagccgttggattgttgtgcatcttaaatgtcagccgtcgatacaataaaaatgctttactgattactttaactgctgtctcaccatggcatcacctccatggcaaccctgacccttatcaactattttcccccattgctttatagaatcaacagtagcctaaattgcatggcctaacctttctatttatatgtgctacgagtcaatccaagtaaggtataaaattttaattatcgttgtccaattctggttctgccttgaattttgggagaaaggtactaccgatgtgctgaccatgtcttctctacattgtagatgagatcattatggtagtgtccagactcgtgaaattacaagtgaaaatatccaaactgaatgaagtttgttttgctataagtgttcatgctgatttaggaggtcagcggtatttttttttttgctctcgctgaattggttttcattt

SEQ ID NO: 75154 - DNA, 3736 bp, Oryza sativa
tttgggggtgaaagcttttttcctagttggtttagactaaagagcctgctgactttaaggagcctggtgcttttccaatgtggggtctgaaaatctgtcaatcccatcgtttccttcccttgaacttctaatgctatcaggaaatatttggctgaaaacagtaacaattcttggtggttcgactggtggtgaaacgatgcagcatgcaagcagcagtagcagtagcagcaatggcacaacatgtcttagtggactcacctatataggtctttacagttgtgaggacctgcagaatcttgatcggtgcttgtccccggaatacttgccatccatcaagtccatagagatcgacagctccagcgatctaggactgtcaatgcctgtcgatagtttcgtgggattcaaatacctacaagatctgaaaatccactgcaaattgttatgcccgcagggaatggttttgccaccctcactccgacgactctctattgtgtctggccgtaaggttgacttcccggcctgcctacagagcctcacctctctcaacatcctgcatttgtctagctgcgatggcatggagtccattccgctgggcacaaatctttaggtcaaatgcctgcttctcgagcggtgctcggagctgtcatccattggaggatcacacgttctttcatccatgcagttcgtgagcatatcgatctgcccaaagctgcacgaagtagagcagccctttaaaaagtgcctgctgactaataaggacaagaaggaactgcttcaatttacctatcacttatatggataaagcatagctgatttctaaagacttccggggtatttttcttcacgctgcggcacccagagccttctgttgataattgagcgttggctggtttgggtgagccgtcgacgtgtgccttgagattgaaatggccgagaagaacaaagaaaagttcacaccatgtagagagttggagggtgagcggtggatgtggtttttgatgttagaaacgagtgcgaaagcgggagcaggtctggggttagccatggcgggatctgccgaggtgcatgagcagactttcttctgatactatgaagagattttcttctgttcagcaggtagcccggtaacaaatctctgcccttcgttctatccgatcagacgattggcaaggtgtggtacctccagatacatatttgcccatgaggtggtaccggcagtgttgagagaggtggaaggtgcttgaatcccctctgtccgatgagtggtaacagcggtggcttgtccatgggcaactgtggcggcgaggtggtggcggccgtggcggtgaggtggtgttggcggcggctggtgcgtgagcggccgtggcagcgaggtggtggcggccgcggtgttgaggtggtcatggagtcgttagagctggcgatgttgtggcagcggcgggggctttggcggctgcagtgacgaggtggtcgtggagcgaggtggtggtggccgcggtatcgtggtagtcatggagtcgttggagccggtgatgtggtggcggcggtggggactttggcagctgtcggcggccacagcggcatagtggtggtgctccagttgtcctctgaagctctaagacttttcgtttgctgttgctgcgatgccggtgatcaaggatattgccgatgcgtagtggtattacataagttgtacgctgaagtgtgttgataggtaagtttcattccaagcatatgtcatttttttagtggtaattcagtataaataaattttcttttaatttagtcatgcatgtcaatataacagtcctgtttttttaaggaggatgacactctgattggagtagatctggcatccaagagtacaaaagacattcaagcagctttggcacttgctggaacatgtcaatctgggtacactggtggagaaaccatctttggtccgtcggccgaaatccacaatagttccggttccactaaaaaccgagactaaagatgatctttagtatgaagctagagctggaaatggcggaccgtttttagacatggaaatttcactcaagaagttgtccaagcaggaaaaggagaccaatgacattagaaattggttcataggaataatagttctagctgtgctccttctcatgaaattatttgataatatgtactatgactaccgttgttgattttctggatgttaaaatggaaaaaaatttagtcatattgctagatgttattagctatgctaaatcacaacatattccccaacttacaatatcaatatcaatttttaactcaatgcataaagctgttcttgatgtcctcctgataacttaggtgtactccagtttgtcagtttgtttcatgttcttgtcacaggaagcaactaggacagttgcttgtgtggaaactgaatgacactaattttttgtgtagtctgttcaattttttgtgttcagttcttctcaccattagaaattaaataacaatatgaatgcaagtacctaatgacaatatgaatggctgtgaacttctttgaatgactgaaaagcaaattggcagcaatgataaattaatgaattccaatggaattgcatgttaataagtgcccatccatctgaaaacacctgcaggaaaatatttacatttatggaattgcagtcagaagatctcatgtgaataggaaaatattgacataactgaaagtttcagatgcaaatcagcaaatgtgtcaccatatggctcgtgacgccatgatccatgctaaatggcgaaccagaaaattcgatttgcctggcaccaaattctccaatcccaatacctactcaacaggttagcttgcatctgagatctgaccatctactgaaagtctgaaactaatactccatccaccactagtcttcactcctcagtcgcacccaatacattgcactaggtatttagcaaatgatataggcggaaacataaacagaggataaacaatcaaacccataatatgcaaacaataagaggacaaataattgaaacatatagacttaagaaacagcaggtgcatcaagtaaacagatgctgaagcctaaaggttccctggctacagaaagtgaagttgtgaattcttgcagtgcataacacaagattaagtcagggcatacacaaagcgcagctcatgaatggtgtcatacgcttaatggcattacatcaccctgatgccagctcgcacaatttcagagtattgacgagtctcgaagaaattgaatgccaacaatcaagctccaggaaaggtgagacatgtccgatgatgccccgtcggcccgtgcagttgcagcggagaggcgcacgtggctgcgactgccatcgacggccggctgcgtagcctccgaggatgtgggcgaccatccgcagccgccgcactactccacatctgccctccgcctgccgtcgtcggccggctgcatagcgccggggatgcggacggactaatccgagcgccggtgaggaaaagaacaaaggataagagcgtcattttatagcttacttattttttacggttttactacgtggggaatgctataaagtcttatattataaaacagagggagtacttgcatattttttttacggttttttaggcttaaaaactttcaaattgtagactgttagatcacatcaaaattcgtgcagatcggataataaaaattggcgcaaagtgcacaggagcaaagaatcaaacctacaa

SEQ ID NO: 75155 - DNA, 8708 bp, Oryza sativa
ttaaaaatagcatacttatttttacctgaaatgtcgttcctcaccgaagtcctttgttgagccttcaaagcaacaggtactccgtctcttgcaattcttgagctttgtcttgtagccaccactttctctttctgcttccttttcttcttcttccccgatgagataaagccatcactagtcagctcttgccccttcacttctccagtgatcatctctagaactctgatatcatcctccatccgatccttagtgaaatctcattttcctcctcggcagccttgttttcttgttgtataacaggagtgaccccccctatattgttaccatcttctcctaattcttctaaaacatttgctccacttactcattaattccctggacctccttcccttgtgagcataaaaccacttcttctgcctcatctgaaatatctgggatatactcaggtatatccactttctccccttcccccaaagagtcttcctcttcttccaccatctcattgttcttgtgtctcttgtgcccatgatctccttcccttttttgggtgtccttcttctcttcttcttctttttttgattcccctttgtcagcctcatggctgtcctgagagtcttcctcatcatctcctctcctccctcttgatctgtatgcaggtttgggatcatcaggatcatcttggtgatgttgtcttactccttcaggattccaagtaatcctatacccaactctgtttagaaagatctcagacgtcccccctatcttcaaaggatccctgcaaaggacttttactctcacagcttctctgttcaagctaattgagtctacctccatgggatctccaatcaagtgggcaattttttcaataactttttcagatctagccaatggtgggactcctgtagctctgacccaaacctcctgaagctcggcaaaggcctcaatggttctctcagtctccctaacattagctctagcattggataattcaaagtcaaagcccttgagtcttgttaactccctcctagcatctttggatggaaattccaccaaatatttcttctgctccacctgtttaaccttccaatcccactgcttatgtttctcatacaggtatttcatctccataacaatcttcgagatcgaagtcagcccactttcgatggttagaattcctgtaactggacgcttctccacctcatcttcctggacgacaatatgcaaacaatgaaaaacttgaccagggtactgcggctgattttagcttatcaagttgaagcacaaaacaccaatatcatgcacgcatatattctctagtagaacttccgagcccttttccgagccgtttaggaagtaatcagatatagaaaaattaaactgaatagttattttgtactaccattagacagtatagatcaacacagtcatggattttggggaaacagatatttgagtcagaagattttaactatttgagtcatggattttaactatccatagtgcttctagcgctgcaattcaagttcacagtgtaaatcgaggatctaaatcaattaaacagcaaaagcaacctgaagaaaggagctagctactgctgaagcagcaatagaagttgagcactagaagatgttgaaaggctctgaaactcacatggttaaagcagcaaccggccaagaaggatgggccaaacatgtgtgtggatcacgtagcttgtaaatctgccgatcctcccgcttcaccgtgatgaccaaatcggtgtcagcagaatcatccgcctccacctccgcctccgcctgagagtaagtgcgatgaacaatacgtgctactatgtcctgcttggccggggaagcagtggatcgaaagtcgaaggaggagaagctgcccttccccatggtgcagagaaggtgccccggaacaatgcgcttggattccacctgcaactcaacgatggacagctccttcttgcctgtgcctgaacctgcaattcctggagggaagaccatgacctccatgtagtacactgaagccgcgccgccctttgccatggagcaggaaacgaagcggtggtcgccaagaggcacggcctgaccggtgaaaggcaggttcgtgtcgagcaccatctcccactgctcggcgttcatgtcgaaggcgcaggtgcccttgtcctggccctgctgctgcaccgacaccgagagcaggatgtgggagccgacgatggcgtaggccgcgacgcgcaccgccggcggatcgcggtactccagcgggttgagacggcacgggaagatgggcggcggcggcagctcgcgccatccgaagtagccgaggctgtcgaggacgaggaaccatggctcgaagtcccgcccgttcacgacggaggggcagcaggagacggcgtagagcttgccgccgtgcgagacgaggacggggttcaccttagggaacacgagccggcagccggcgcgcaccgtggaggtcttggggtcgtacacggtggtctgatccagcccgatgcccacgatccgcgtccccaccgccgcgaacgacatgccgcggccgctggtggagtggagcaaaaggcggacggtggcgccggcggcgacctcgattaccgagtgggtgggctcctcctccactccgtgcgccaacaccatgtacaccgctggctcctttgcggcagaaccctcggctggggcctccttccccttccccttcctcttcttgttccccgagcgaacgcggacaagccgagctaccggtgccggtgctggcgccggcgccgctgccgcaattttcttcctcttcttgtccggcatcatcatcttccctcgattggaatcagattcgcctcccttctcgaaaacgagtgggtaaacgaggttagctacgatcaaacaaattattattattaggtggaaagttcattgaggtgtcttaacttgtgaagggattcgattttcatccttcaaccagaaaactttaacttgtgaacggattcgattcatcattcaactagaaaactaatacaacgggtccctaaactgtcaaaaccaatagatcccatggcggtttggacgattgttttgggtgtcgtggcgcctacgtagatattttgactcggtcttcatctgatgtggtatatgaagcaaaatttcatatttttaaataaaacaaaatatatgggcccacatgtatgtggccccacttcctccacctcatcccctctcttctctatctcctgcccttctccttctccttctctatcgcagcctggtcaggcagggaggaaagggcggctccggcggctgtgggcggaggaggagggggtggcaagaggtggccctagctacggcggccggaggaaaggagctagtgtcgatggcggcgttcgacctcagcgagctcgagagggtaggagcggccgagagccaccgttgcattcctcaccccgccggtcatccgtcacgtttgccacgccggtccttgtgggtcggggcaaggggtggtgcaagcgcgggcgaggatgcgtcggtgagtgcggggagcgaggacgaggagtatgggggcggcaccaagggcgcggaggatggcgaggaggggcttgggctaggggaggcgggcctggtggaggaaggaggacgaggaggaggaggccggcgactgtcggggttctttagaaaatcgacgacctcttgcagctcgagtttggcctggtcggcgccgaggacgtcgacgaaggttacacaattctcgggcacctgctcgaacttgctcttggagcggtcgaagtccaagcgccaaccgaggctaccagggctggtgtcaggatcaccctgggcgcggcggaagatgaagaagaggctagcgaaggcaaggaaggggaagaggaggttgcctacgaaggcgaggaattcgcccaggccggcggcgtcaccctcgacgacggagatgtcgacgtcgttggtggcgaggatgtcaatgaggtcaggggcgttggggatgacaacgatggtgtaacgaccgtcgatggcagtaagctacagtactcaggtggtgtcgatgtcgacgtcgatggcagtgtccattatccacacgcgcctttgcacgctgccgcaactgggcccacaacagcctcgcgcgcgtgatttttcactgccgcatgtccgattaagactgcatcgccctctccctcgatttaaaaattgaagatgtttttgtaaaaactatggtatgtcatcagtatccgattcatgtcacgcgtaacattcattacaaagtcacgactcacgagcaaactatgaaagagagtctgtgtgatatggataccaagcgaatgaaactcgcagagtccgtgtggatatcacgtacatcattgcccagatcatccgattctgttcgtactacacgccatgattcctggaacatgttagcataatttcaagtcttttaagtcagtctccacgcatgcttgtacgtactagtagggatactgttacaataatccataaagcataatttcaagtcagtctccacgcatgctcgtacgtactagtagggttacttttacaataatccataaagaatcagtttactttcgaaaagaatatgccaaccaaaataaaggatgatcgaagttaatgattttgtccgtcatccattcctgcccgacttgagataaagctggacgacaaatcgagctcgttttttaagccctcattatttggcttatgcttattcctataagtcaaattttaaattttagaatttaattttgaatttgactttttggttatttatcgtactttattttacagcattttcttttgagtcgctgagaacgtgtatataaaagatttgcacacaaataatcatttatttggcaataatcgatatgtataagcacatgaataaacgaatcaatggcctgtgattatttatccacagacacatatgcacaaattaaattggctctacccattgcaatgcacgggcatcttttctagtgaggtatgacaaaagaaggataccaaattaattcttacggaaaatacaaaagaaaatctataatgtattttcaaataatatgttataataattaagcatgttttagagatacaaagcaattttagattctcaataattcttaagataacaatagatctagtaaaaatatgttctcaaaaacaaaacataggaagcattgttccttaaaatgaagatgtagtagtcaaacattcaaaaaatttatcttctgccggattttatttacacagaaagagctccaaccaattttaaacgattgtattactgtgaatacatgctaataagatgcagcacatacatgatatcaaataaaaaaaaatcctcatctcttggttctgcatgctgcagctatctcaacaggaagcactagcttctgtagttctgtgggtcacaagaataaatcatgattcccaataggctggcgaacaaaaaagaggaccagcaatcttgttttagtcttaatacatctctcatcttgtttgttcttccttctgctgagccatcccaactcccagtcccactgcacccacgagctacaaaaccaggacaaagaaaaggatatcagtaaactctcaagtgagaaaccaaccaccaaaaacaacagtcaatggaagatatagaaaacaaacaaaattgtattttctcataacaaacgtggtacaacattcgctacctaatggtaagaagtaacgcatctagtgtgttaaatcaacaaatcactactgtatgatcatacccaggtgtagggccacctatatctgtccgcaccccaaccgctgccaccacactgcactgtagctgcctctaccactgccgtgtacgctagcacacttggggcttattcggtttggaggaatttgacccataggaataggaaaaatgaagtattatgaatgtttgcacatatcaatccatagaaattttctaagaggtttgagtggatgaaaaaattcatatgttttctctatagaacttatagtaagggaaattttcctttggttttcctatacttcaatcctagaaaccaaatgacactcatagaaattaatccttagaaatccaattcctttgtttttcctccaaaacaaacaaactgatcttaccaaaaacggcccggccttctaccgcagcaactacctccgctacaccactgcagctcgctcctttccagttgcttgaggaagaaagaaagaagggttagcggtcgccgtcatcacagccgcagtttccaccccagcggtctgcttagatgatggtgagggagggagatggaagaaggttgcggcgccggcaaaatgagtcatcaccggtggggcagttattttttagagttgtgattgtaaatttgtctaaaatacatgttttgatttttagataatgggcaacactcggcctctgtattcttagatgaatgcacacggccaaaatacaagttctgatagtcttggtttcttggtaagtctatattcaaaagaacacaaacgtacatccggtcatgagaacgaaccttctcaatatcctctatgggacaatggcccttttcttcttatccttgttcttcttctgcccttccaccatttttgcctaggtgcaatagatgtgttaagaggcgcgcgtggcaacactaaacaaagcgtggagacttggacacaagctagctagtaccttctgccgatgcacactgccgttgagctggttggggtcaggaacacccttcaccggaggagcccctctacctgcgccatgatcagccacggcttctcctccatacctcaccaccaccccctcgtactccaccacgaagtcgtcgttctcgtagacacgcacgttctccaggaacagcctgtactcctcttcgatgtcagcgttggcgtcgtacacggcgggcaccgtggacgaggcctccttctcctcttcccccacctgcgccttcttcttcttgcatcctgctgccccgccgccccaggaggaggaggcggaggcgctccgcggtcgacggcggatgccgcggcgtcccttgacgctggtcctccccgcggagcctatctcgccggcggcttcgggaacctggtggttcggcttcggcatcgctggggatagtggggaattcgttcgatcgagaaccaaggtgaaaacgaagcgggttgtgtttggcggtgcggggcgaagagaggcgacgaaattttgggtgatgcgcctgtgaccgtgcgagatggccctagctagctgtcggaaaactgggccaccgtaagttgggccgagatgagcattatcttttttgggcggaataagttcatctgaggtcccttaacttgtcaacgaatccgattttcgtcctccaaccggaaaactagatacaacggatccctcaactatcaaaaccggtgcagattaggtccctcgacggttttaagggtggttttggctgacgtggtgcttacgtggctaatttgactcggtctttatctgacgtggcaatgacatggcgcttacgtggcaattcgatcttaaaaaaataataaaccccgtgggacccacatgtcagtttcacacaaattaataaaaaatggtggggcccacgtggccccacatgtcattctcacccctattcttcttcctcctctcttcatctctctctcctctctccagacacgatcgagagttagcggtgcgcggcggccggcgggagaggagggagcggcgcgcagccgcggaggcacatctcccgcagctgtgggcggaagaggaaggggcggcgggaggtggcgggaagcggcgggaggcggctttgtcctaactcctgaagaactaagcagcagcaaaggacacgacgtgtcagagatccatgcgagcgaggaggagaggagagggaggggagaaggtgtgcgtgcttacgtcactgtcgagggctacggcggcggtggcgcggtgccccggtggcccggtcggacggctcgatggcaagcagcgtgtcgaggaggtcgagcgccggcggcgagaagtccctgaacgtctcggcgatcttccgccggtacggccactgcggcttgaacagcgtcacgtccggcagcttcgccttcacccaatactatttcgacggcgacctgcacagcttgaagatcttgtgcagctgctcgatctgtgtcgatcagcaatggcaaatcagatgccgatccatttcatccacgcatagatgatatcatgacatatagatggagagttgaggttataatatttatttatttaccttggtttggctgggcaagaatgcaagatgggcttgccggcgagaagctcggcgaggatgcaggcatgcagccggtgctgcagaggtcgacggcgacgccgtactcggtggcgccgaggaggagctccggtgggcggtaccagagcgtgacgacgcggctggtgagcggctgcggccttgcggcgtcgaagaaggtggcgaggccgaagtcggcgatcttgagcatgcccgtcgccgtcggtgagcaggttggcgcccttgatgtcccgatgcagcacgtcccgttcatggcagctgcggagcccgacgaggatctgcgccatgaagcacttgacctgcggctccgtgaagtgcagcaccggcgtggcggcgaggtcgtggtccatgtactcgaagacgaggtagaagggtgagattgaca

SEQ ID NO: 75156 - DNA, 8903 bp, Oryza sativa
aggtggaaaggtggtgttaaggatctggatgcagtgtagtttataatactgaagttaagtaagcaagtgctgattttttttattggtcaatctgcatgtaggctatttgagccgtggcattatggatcccttaaggactcttgcagtaaggttccatttcaatctagaatttgttaacagaggtagaaagaagcagtactatgatgggagggaagcaatgcctcgtaaacagatagaggcaaacccaaataagtgcaaggaagggagcgcaagttgggaaaatgggcaacatgctttgcacatcaagtatctagacatacgttggataaatatcagtttttttttttagagtttgtgttgaatatatgtacggtattcgccttgacatgtaaagaagtggagaggatgactctatagcattgaaatacaagaaccaagcctactagaaggaggatgaatggtagggaaaaactaatctttttcgtggaattgaaaggaaccctcaaacctgatggattgcgccagtcagaccgcttagtagtcgtcggtcagatcgccactttgtaactggtcaaattgccttgaagccttcggtaagattgcctccttcctgcctacctgctgcctgcttgcctccacccgtttgaccacctacttgctatcggttggatagctcaccggttagaccatgcgcctaatgccggtctaaccatcagaatctaaaaaattgatgaaactcttgaaagtagattaactttgttcaatgtgtttacaaagtgcatccagagcactcctctatcaactcatgaaatcgaatcgaagtttcgaagcaaaccctaacttttctcccccagaaaatcgatgttctttgagtctatacccctcatctatttatacctaaaacatggatgcatacagtagcaaatccaactataactagaaatcctgatcacataggaagtaacccttatcacataggaaaccctcaaacaaggaaaacaacatccctttacaactccgaagtccaatcttcccacacttcattctaaatttgattccgcttcccatatgcacacaatcccattggatgatgtatggaaaccttcacctatacgtgcattgttctttagccttagaatcccgtatgatctccttgaccatctaaaccacaacttcacccaagcctagtcccgatccatcatcggcaattctcccgaggccgcgagcaacacctacacatgaacaatcaaagaaaccatatccgagtacaagttcgcagcaacttggctgacgtcagcacacaaaaagtatcatgcacatacttgtagaaaccatctagaagtcatacatatgaagcaataacaaacatccacggaaacaacccaaaatcgagtccctcctagaatctgtcggtttgatcatcgcgttacccaatcagaccacagttgcccgaccggtctgaccgcctaagcaccatcgttctaaccgaccttaccgtgctcctctgactgccagcaccccgacacttcaccacgaaaacacaatttgacatatatcaacacattcacttatttatcacctttgataatagttcatcactaagactaaatcaacaccttgattttatagattccagctcggagtcatgcctaggaatatgtacacgcggagaggacgagtggtaagccttgtcgaatatagaaggggagaagagaaggactcagggacgattcggactctagaccccaaatacaatcagcaagagggatttctatgggattgcaatcaaatcaaataatccaaagcaatgaagaaatcagccctgattttttgggtcacgacgatttggggcaacgaacttcgagtggcaggagcacactgcttagtgcggaaggagcgcaagtgcctgtggagttttgtgggacacctgaagcatctaggcccccattgttaattttagtaattaatgacaaatgctaattgtggactaactgttctattgagctatatattttaagttaggttcacattatgtgtgcgcatggacgattaccgatggattaaaattgacggcgcaaagcaaaaggaagagaagacggtaaactagtgcctttttttaaaattgatcgaggcattgggcgatcaaaattgtgctagtttatttatagctttgccgtactattaagaggggtaatgacctagcaaagagatgattttaattgccacttaggtcatttgcatattcacttgtgctcacatttgtattaatacttttcacacacacatgcattcattgtgttcggcctgaccagagcaggtctgaccgtgcgtctgccgccagtcagaccaccggtccctggccggtctggccggcctaacagtggcagtttggccggtgctaaaggttggtctgaccgacggcttcggggtggtctgaccggccggccatatggccgggatggagtgctcggggttggccgatgcagagccgacggagctgtattcggtcagaccgagctgagggcggtctgaccgagccgaggccggtctgaccggccactcaacgtcaatctgaccggccaggccgatggggccctctgacagggctacaacggctagttttctagccgttgcaaagtagcacggtctgaccggccacttacctccggtcggaccggcggcacatagagttgggggatttcgcccctaacggctagttttggttggtgggagtataaatactcccccaccagcagtaaggggactctcttggcacccacttcaattgcatacaccccttgcacctctctcacacacatttgagcttagtgttcatccattgtagtggttgagggttgatttagccaagagtcaagtgcattgcttccattgtagagctagtgtggcacttgatcatctccgagccgcgtcatcgcttgttactcttggagattgccgtctcctagacggcttgtggaggagttgcccggtgacctctccaagaagattgtggaggaggcccagcgccagttgtgagtggtttggagttcaccaccttcggagtgaaggaagaactaccccaagcgattgaggcttgggtagtcctctccgtgggccggctcacgccttgcccaccccttgacgaagggggcgtgcggtggcttcgtggttgagcggtggaagtggactcgcctcaacggggagtaggaaacctgcgagtttccgaacctcggtgaataatctcttttctccttatctcatttatttgtcgcatttacatttgtgcaatttacattcctagagatatacttgagatcatatcaccctaggattgctaaacattgacataggagtgtgatttactttcctagagatatatttgagccagtatcaccctaggtttgtaaaacataacttagttgttttgaaaattaacaatttacacagggaattgaagtgaagcattttaagaactatcaattaatggcagtgaagaaacaagcattagcattgtttagatgatttcatctagcatgcaacatgaaaaaggcacattcgacttagaaatgtcgagcgtaaatgcaggcacccattacatacaatgagttgccaccttcctgttaaacaaggctccagcctctgttcaaaggaccacagctcttgcaggttaatctttgtttgttagttgctgtattctcaatgaatccacatttctgtacaaagtaaagcactctgatagtatgatcaaatcaatttgttctgtaaacttttgtggatattatatgtagcagttggatttataggctggggcagcatgggcatagaacatggtgtgcaagagtggactatgctaacctatcttttctcttaacagagggatcgatactgatcatataatcattccagcaatcagcaacaccaactaactacaagaaacaatacttccaacactaatttctacaacagtatttccaaaagaatccagattcgtcgtatggtcaattttaagggtgcttacagaaggaagatacctcatacagaagctctagcatatactcatatctgagcaggcagccatagaggttcaactagaaagagaggaaaatttgaagggagcatatcttcatttgtacttacagatgctaaagccaaagaaatgccaggctttgctcaaacacagaaacatgatactgcacagttaatttacaattcttctatcactcaaaatatttagcttagctagtattttttttttttagagagaaggctcatgcccagcttttactaaaagcatacgagttcagtacagaaacaaaataaactgctggggaagccagcgaactagagaggcacaaagcaacttgcagacctactgctgctggcacagcactaacaagccagaacaaaaaagacagacagactagctcttgattgactcattttccggacagcaacagtagtcaatccagaaattcagaagtccccaccctggagacagccctctccacaacacacaggagccaaatgcaaagcaattacagtgaaaagaactctgctcggccagacgctcgatcctttggcgccagcttggaagtcatgcctttcctcccctcgcacctcttggattctggcatacagcaagagccttgtagcctccacatcttcctccatcttcgccggtactagagtcctccatgttagatggatctccctccccttgagtccaacggctcaagggggccttgacccgcgccctgatcgggggcgcccagcccaatcgctggtgggcccccgtcacactgtgccatataaagaggggtggaggacgggacgggacaatgacacaaggaacgaggttcgtcgccgccgccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgtgcattcatctattgttgttcatccattgcaaatagaaccacccgactagatctaaacctaggtgatccaatagactaccctaacaatggtatcagagcaaccctagtgtttagattggttcgggaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgagtgcacgcgcgcgccggcgagggggcccgcggcggcgccgccatctccttcggccgccaccctctttctctcacttcgcggtgggggctagagacggtggggggagaagagaagagaaaagaaaagaaggcgccgccgtgtttccccatccaccgccgtcgccggccatcgccggccgtcgccgaagccggggggagacgagagggcgcctaccacaccgttgcaaggccgctcgacggcggcgcgctctgcctagggtgagcacgcgcgccagcgaggggccccgcgacggcgccgccacctcctccagccgccgccgatggtgctccggccgccgccgatggcgccgccgctccggtgtagagagaggagggagagaggagaagtgaaatgtacggctagggttcggccggtcgggaggaagggtttttgtttccccgaactcggcggctgaccgtccgatcctaaccctagcaaatggatggccggatggtgacggtcggctggtggccgcgggccggacgggccaggccggccaaaagtccactttaggtctctcggccgaaagaaagaaggaaaagaagaaaaagaagtttaataaaagtccctcggccgaaggaagcattttcaatatgtttaattattgtgattatttctaagcaatttgaaccaacgtgaaaattgtttagagaatagataaatgtgagaaatgcttctgaacatgtattttgtatattttcatgcaaattacaatagaattttaaattgtttttacatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacataatatgtgctatgatgttgtaatttttctgaccaacgttgataattgcaatgttatagttatggctttatgtgttatgtctattttcggcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaacaatattgggctcaatcccagagtatgacactgtctctaagtacctcgaaagtataaagagccagtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaattacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaataacagtttacagttgagacaagatcagtgtctacactgcaagaagacaagacattccaagaaagatcatcctaacttcctgacagtgatcatggcaaagaaaggtgagaacattattacatttgtaaagaatctcattatgattggttattctagatccacatggtggatttattctggagcaactattcatgtgtgtaattgtttaaaggattccgttcaatgaggactacgcaaagaagtgaaagatccattagagttgccaatggagttgaagcaaaagttgaagctgttggagatcttcgcctagaactcacgaatggcttcacacttttacttccagatgtttttatgtccattctttgcaaagaaacttgataataagtgtatccaaattggattctgatagatatgaaatggcaaatgtgaactatggtataataatgaatgtattggtcttgtgttgcaagatcagctttatttgttatctctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctcaattttagaacgatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacgagacacgtcgtcttcttggaagacgaaatgattagggggagcttggtagttcgagaaattgatcttgagaggcgggtgtctgtacccgctccgtcgactcaggaacctttcttctctctacctgctgatgttgtgcttgcaatgcatgacgttgcggtaccaacacatgttgttatctctcctgtggcaaaaatgaatgaaagtgaggaacctgttctacaggattcaacagaaattattgccacatcagaggaggagctgcaacagcctcaaacagataatgtgtcagaataggaggcccctagaaggcctgaaagagtagcatatggaggatgatcccacctcatatgcaaaggccatggaagccatgaaagatgaaatgaaatcaatgaaattaaatgatgtctgggatttagaagaaattcctaaaggagccaaaacagtaggctataaatgggtctacaaaaccaaatatgactccagagggaatatagaaaagtttaaagtgcgacttgtggcaaaagttttcacgcaaagagaaggcattgattacaatgagacttttctccagtctcttgtaaagattcctttatgattataatggcactagtggcacattatgatttggaattacatcagatggatgtaaaaacggaatttctaaatgatgatttgaagaaaaaagtatacatggcacaaccgaaaggtttcgtcatgaaaggaaacgaaaatatgggatgtcgtataaagagatccatttatggattaaagc

SEQ ID NO: 75157 - DNA, 2447 bp, Oryza sativa
tcctgcagccctgttaagagtaaaatccactgggagcaaacaagttcaaaagttacccgcaaaattaaataacagaaacaaatgctgcaaatagcaacaaagaaaaactgtgtcctcataccaacaaaccagccggtcacattttgtctctcaacttcataggttctcttcctgttggcaaattctgtacgattggcgatatcagttgttgcgtccaatataacatcgtggaaacatatcagatgtccgtcctttgttgcaagtatgtcagactctatgaagtctgcaccttcttcaatagccctctgcaatacaaccaatgcatatctttgagtttgcattaacaatcttcagagaatctctcagcaaaataatattatgcacatgatctccaagatagaatttttaaataaatttatatcatggcttgtcttggatattgttagttaacaacgttaatgcaatcaagtttcacatgtcactaaaatatgcccatgcctgtacttcttgtcacttgtcatttcgttaaccttttgtttttgcggatacaaatttattgtaattttattttggaagtggtcactcaaatttggatacaaagtaggtactgagaaatagattcttatttaccaggtaggcagccgtggtctcttcgggtatttcaccattggaacccctgtgggcaatgttgtaaggtctgaaagtttgaagtggcttcctgtggtttacatccagctgactctgctgagaggcagctggattggcattggattctccagaaagtagtacaaggacaatgatagagatgagccctgtcaagacaacactcaattaacagtactagacttgaattgttcaagtacgctgaaaagttggaagtttcattcttgatcaaggaaatagagaagtgaagaagccaattcctttgatagttatcattccacgagaaagatgcattaccatcagtatcatatgaactgaagaacatatataaggtagaaatgcttcagtgctaacttgaagaaaatatatgaattactccatgagagctacagattcagatacctagtatttcataaacatacatcgaggttcatgtaaaaagatgctgccaagaggagcattggaaccacagcatgggacaggaaaggaagatgtgaagcacacaggaggtgcatttttttcctttttgaataaacagaggtaaactattgtcaatatgaagaggaaagaaatgcaactgtagctgaggagaagagaaggattttggtcttacagaaggcagccatgcttctctctccttcctcttcctcctgcaatagtctgagctaaaacctcgtcttctcaaaagaggagcctttccttctttctctctcctccctagctctcttgaagagcttatggctgatgagcttttaagcagaagcaccctgcctgcgaatattccttggagttgacatgttcttttgtaagttgcagttctattcttcctctgtgcacactctgcaccagttaagagtctagaaaataaaagaaaggagagtatatgtatatcctattcagtcagctgcacatagcatgagcttctctcatattttactgatgaggaacgaagctgatggaagatggtaaatttgcaacttgcaaatatttccagcaaaactagaaagcttattagcacatgattaattaaagattaactgctctaaactttaaaaatggatttatttgattttttaaaacaatttttatatagaaacttttttcaaaaaatacaccgtttagtagtttggaaagcgtgctgacggaaaacgagaaagttgaagtatagaacggggtaagtaatgaaatgctgttacaattggcatagttcttgaccaaagctgggccatcaccatccatttcaccgaggactatgtgtccccaaacttatgtcagcttctgaagaaagttgagacgcggttttcatttttgtcaagttttccagcggtcaatgatcaacgccgaaatttaaatcccggccgtgtgattcgagtcctagaattccacttgcattgggtcaagtcttcttgagggaccccctccctgtagttgaagtgtttaagagtgatgaggctggaccagcaataatgcctgactgagacagtgcactagaaagaatggaagataatcctaagctaatgtacaatatccagggaaaaacttttgtgtggtctaagtcatcggattagctttgcaattcatcattatgacaaaacaatatatatgaaattttgtaggaacattgttctgaaagatgatgcagtatattccttagtactgtgtttgtataagtttgcttttgcgtgtaagtttgctggactggatttttgtatagcagggatgaagtatgaacatgacgcgtaatcgattatcaagtgccgaaattacgccacaaataactagtg

SEQ ID NO: 75158 - DNA, 773 bp, Oryza sativa
  unsure (1)..(773): unsure at all n locations
gctttgcttgtgtgcttcgcgtagcttctgtcgttccggaggttctcgaagcgtggtttgcggtcgtcgccgaaggttcggaaggccgttctctctgagtaaggcaagtcacatcatccttgaacatattgaatcctagtttataaaattattttgatttaaattattgcattatcgctttatttaaatttccgcgttatcactgttttatctagccatgcctatttacttttgttatgaccttattattgctattgttattattatcttgttcaccctaggaaaataaaaccccaactagtgggtactctattcatggttccactagtatgaatttaggtagatgcttcgctgattaataggacaacattaggtggtttttataactttagactttgggaatattcatatctcttggatactatggaatgggtggcttatggtggaattggacatacccctctcttcctctttcaaagcccctaaaacctgtntttcgatggggtttgggtgcatgccagttgtgggaagtagcaccccgaccaatataaggactaagctcgggcctctattgcaaagcactatcgtacttccacatgtctagtgggtaaggcttagtttgtggctcagtctggttataaacaaaagtacacggatggagatggacgaagtcgggggtcaatggacatctctaggacaaatgaaggctacacgagctgcggcccggtagtcgagatgtcatggcacagggccgatgtcctgctgctgggggc

SEQ ID NO: 75159 - DNA, 753 bp, Oryza sativa
agcacacctcgtacacgtgtgccacataggattggaaaaaatgtttgggcatccgcagccgctgccccctacgatttcacctccgttgctgttaagcttgtcgtcgttgccgcctaggattttgcctccgtcactgtttatattcatagcttatcattgccaccagcgagtttgatggcaagtgagagagtactgagaactagaagaactcatcaaaacaattacaagtgaaatgatttggtttccctaattccgtgtatttccaagtgctagtgttgtgagaaagggaaaaaaaatacgcatgcgatttatgcacatgtccgaaagcaattttttcaatcgtaggttgcatgccatgtatacaaggtatactcatttggatagttagataagtaaatgactcacttaactcacattagtgaactaaatgtgcattttaaaagtagagtgatctacctaacacacctaaacaagttaagtgaccttccatgcattttactcttggaacaaaatggttgtcaaggcgtcgccaaagcgtcactatgacagtaaggcgctaccaggagtcagtgcgtctagcccgccttaccatattgcttatggtgtccgccttatacccaatgcgccgttatggcgtctatatcgcgtccttggcgctacaacagctaaaggtgacgccacaggaagtcgaggacacggtttttgccccgattagttcaagggcccaaaaaattggcgccatgggtcctggac

SEQ ID NO: 75160 - DNA, 5377 bp, Oryza sativa
ttctgggagccctgtttagccgggagttcctgttccgcgcgtacgcgctaggaacggaggcggcgcgcactttcctggcgtccctaatagtgtcgttctttttttttaatgaaaattcgccaccgtatgtttctttcttttgtttagttgactgaaacaaactttcaactcagatttatccaggatgtggaaacttttcaactaagatttgaacactctcaagtctagatttgaacacagatctaaaatttttcaagtcaagatttgaatactttcaacttaaaattaaaaattttcaactcagattttgaaactttcaaatcttgatttaaaaattttcatgtcagatttgaaaactttcaactcatatttaaaaacattcaactcaaatttgaaaattttcatccaaaacttaaaaactttcatcgcaaatcttaaaaactttcaactatttaagtccagatttgaaaactttcaactaaaatttaaaaactttcatctcagattaaaaaacgttcaactcaaatttgaaaactttcatctcaaaactgaaaaactttcaactcgaatttaaaactagcagaaattaaagatgaaagattcaatttccaaaataaaaaaaacacggaaaaaaatcggcaaaaaatatttcagggcctccccggctccccacggtggaaaaaagaagagagaaaaagggaaaaaaaaaggaagagaagagctacttgagggcgtgggccgtgtgggctagaaacacgcgccagatacgctaatagcgcgtacgcctaattagccattaacagccacatcagctaaaacatggcaaaatactgccttaaaacctcgattacgtagatgcttttttttttcggtttaaggacgcgattgaaattcaactccaatacgagagacctaaagcgaaccttttccttttccaaatcctatatatttcttttgtcagcccatcaaggagcttctatccgaatccaaatttaagttaaacggagcccaacccaaggcagctagttgggcggcccaggaggagataaaacgtattgccgcatcgtctctccgcaaagccgagagaactcgcggcggaacagaggaggagagagagcgaaagtgcgaaaccctaaaggcctaaaccctatacttggaggtctctcggcgcgagcgatctgctctccgatctgagatggcgtcggcggtgttggagatgctcaagaacctgtgggagtcgcaggtcaccgacgaggagaaccgcgcgttcaactatgtccgtccaccctctcccctctcccctctccctgtcataaacttttttttttacctcttcctcgttgtcgtccaaggcgtaattgtttgtgtgggtagctgctgcgtggtagtatttgttattcgaggctgcgattttcttttaaaaaagaagggaagtaattttgctgttcttggaatttggtcgtgcgcgcgggggagatcatcacggggtcaaagcacttggaatttactacttgtttagcctttagattgggtaaattattaattttcttggatcgctggtggtcaatgtgcgattgattaggtgtaaaagagcagtggtttcaatgatccaatctaggctcgatttgctcaatccttctaattgtacgactaagatttcaggggatttagttatttccactagtttagggttggcacctatttagaggtggcaggttccgaaatgatcaacatacttttatctgtcttcggctccacatctactgggagtctggaagttcagtgctaaatcgataagaagcaagttgaaagcaaatctaatctattttgaaacattcagcaaacactatataactctctttgtcactatgaaattttcagttatttttgtagcatctactaatgtaaaaaaaaaatgttgtgcttaaaacgggtgcaatgtacgtaatcctagttaccaaatcacctgggggggtaatccaccctgcgtggtatcaagatccttctgttggctgttgtacgctaccttccaatgcagtttttgagccgggccagttgcctgcaaggttactatttttcttatacatatattttgtcctgtggttcactttgacgaatgatggacatatgttttgagtttattttttaccgcaatataaaattttgccatttttaagctgggctgcttgcctgtaagatagtttttttttttcttttgatattttatctctgtggttcactattgacaaatgatgaccatgtgttgctctacatgccttgcattttatttttcattgcagtataaaattttgacagaaactgtcttctgtctatgtatttctgaatgttggttgtcagttgtaaagtttttaaaaagatacaattatttggtgatttctcttgtatccgtctaactaatttaaattggagctagaatagaccaaacatgcgtgagtgatgagtctggattctggaagcaaaatcatccaactaaacaggagattttagggggggatcaaacatgaatatttttttgttacgtcaatcatggtccttttttttcctggtattattcgcaagtgttttgtggtgattaatgcttgctgcttttgatttccagaggatactaaaggctgtaggtctttttgctggatccatcgccgtgatgcataactttggtgaactgatgaacatataaggctgttctgggtggttgagcagggttccatcttccatggcatcattataagatgtccgccttatcatcaggcttgtcgaattttttgtttacttagattgtttttagctttttatggttcaagcacttattgacattcacaacaggagtatttttctgttggatagtcagtgtcaaatttagctgcaataccactgaaatatagtactatcatggaactttggtagacctgtcctatcagaattcattcatctacttctgaatattgctgttctgttattctgagtaatgatgcctactgaaattaggccacgtttattggtgattgacagcagatctgacgattttcagataaagggagctggcctcgtttaaatcatgcatttttgccctttcctatgcaagtccagctgttggatgagaacataagtaagatctgttggttgtgtatagataattgcatattggccagcattcctttgacgtcactgttccaatggatcccatcggaatatgctacagttttccgtattgcatcgattgaatcatgcggcaagaaaatggcgaatgactttttttttttcattgtctctttcaatgagtagttggcatatgacttaagatacttcctccgtttcacaatgtaagactttctaacagtacttccattcatttagatgttaatgaatctagacatatgtactgtgtttagattcattaacatctatatgtatgtgggtaatgctagaaagtcttacattgtgaaacggaggaagtaaagaaaatcgtagaaaatctgagaaaaaaaaagcaaaacatctatcccttgattttcacttaaatcagtggatctttaaataaatccaaacacgaaaagtgactatactgttccacctctccttccatggtatatatatgtacgtacgttagtacgtaactttttttcttttcaatgtatatagttgagacaattattattactattattagtgataataaattttaaataaaagttactttacaaacatagaataatatatcagcatataactcttttacaagtatacataaatgaattagctctacaatacttgaaaataaagtttacaccattatattatattatgtacccattattttagattattttattaatgaaaatatttgtccatttcttttgttaagtagtcatggttggttttacaaagtttcattaatttttgtgatataaattatagcgaacttattgattataatttacatgacaaaactatattgttaaccgtattatataatagaaataaactttacttaaaaaacttcaaaatttataagtaaactatacatactacttaaatctatataattatggtcttatttcaaacaaatattgtttcaaagaaaacaatcgaacatgcaaaagaagaaagaaattagcttcaaacaatgttacattttgcactaccaagccaagcaattatgtaggtgtttgtgtgcaccaaaacccttcaatgttctttaaaactatagagaaaatattgttgaacttatatagagaaaaaaaaaatctaacttttaatctacccttgatttgtttgttatgtgccttcacggggcgattcaatcacaaaaactttgagttccttgatctcataatttttgcttctagccatattttacacagcccatgtacaaattgtatgcttgataattagctagtggtagtttaatatttacttgatacaaaagttgtatgagcttactatcttctattgaaaagtcaatgaatggtttttgagatatgctaaaacaaaagaaccctcgatatattttaaaaggacattctccgactatatacgagacaattgttgaacaaactataatgttacccttcaacaatataaatgcccgcgcataggcgcggctaccttcctagttgtgtaagtaaacccttgcagtttctcttgtatttattctgcatagattctctctatctcataatttcattattttggtagttgcacatttcagttgttctttttgttgatttttgtgctatctgtaacaaatccaaaaatgctatggcacccataatggtcccatgtactaggcagcattaactgcactacaacatcaaactaataaattggccatcgagttattcttaaatatagatttcattctctcttcagttaatttgtttttaatttattatgtatgcctcacctattgggtaggagatatagcatccgttgagacttgagatttaggaaaaaggggaacatattactcttttaaaaagaggaacttctttatctttgtctatttcctcacatgctgtttcaaccagaagaggtttgggatttcttcctgcgaacaatcacagcacaatatacgtataccccaatacgtaacacgtttcttgtaccctctatgtatcaagcacaagtgagattgcacgtgtttattgtgtactgtttattcatgtgatggtatgttctatacccacccttacttcagaccttccttggctgcatttattttgccatgtttgtgttactccctccatccaaaagtcagacctatttcatttgttgatttttccaaaagtttaaggcctatttgtagtctctatgtgctaaattaaattgttgacgggaacccaagaagctatcttag

SEQ ID NO: 75161 - DNA, 58752 bp, Oryza sativa
gacggcggcagctggatcgatcgatcgatcatcacccgggacgaaggaaacgtacggtgagaatgagatggatgagggggatgcgatccatggcttggcgtttagggttggttgtttgcaaaagcaggaattttcgaggatatctatggagattgaactgattattgttgtgagatcatgcaaaaccatgtgttccactggatgttgtacgagacaagagcctaatatcgtttcctcgaaaaaaaagtagtataatatcattttttgaaagacaccttacaaaaacaggcacaaaacacacgtacacaatcatccctataacgcgctcacatgtgcacgcattaactctataataaacaccttcaaaaactggatgacatatattgagattaacgacgtaactataaacatctcgctgtcaacggatgtcatataccactaagaataattaatcgtaaatacgagcatctgcggtaagtctagaaacttgaattccgatgagctaatcccaccacaataagagtaaatcattttattcatgtttttattttttttctttagaggatttgccacttcccaataatttgggttgtgtgtttgcataccaccacttgcacgcacaaacatttgtaagtcctgtacacatgttttaagttaatgttggaggcatcaaacacccaccccctgtagcgaggacaccacgtattaacctagcatacatgcataagcactcctaaaaacattggacagctaaactaaatctaaaacttgaactctgatgaactaggtacacaccagcaccacttagccatccgtgatttttaatactatagttagcccgtacaaccaagtagcaatcgcaatacgcacatgaagatgccaaaaactgcgttgattagttgactttgcgggaggttgtgagagcgtttttttcaacaaaagatgactggagaaagacgtcgagagagggaggagagggcagagaagcgagggggggtacaggggcgatgaagcgatgatgatgacctgtgttgaaagggaaggcgaatggaccggctaccagccttcctagttttggatatgcatatggcgttggtcgcctactcgctttcagcgtataattggagccccacccggcaaaggcttcatggcttcgttggctcaaaaagagcatgtcggcgacctctcccgccacctgattttaacgcaatcttttctctctctctattctcaccgcggaagtgaaacactgtgcactgttcgtatctttacactgaagctacaacctcttctgctcctctcagttttgatgttcttgcacaggatatgagctgtgaatttcacgagaaacaattcgattctacccccagcaaaatttcctgtgttctggtccaaacaggactgtagctattcacaacccattgtcgttctggtccactaccatactaggacatctctgcttaacgaatgaatggataaatgggcacactttcccgaattcctaaatgctatgatttcttataatactgtcttaaatccatttttatctttataataattcattcgttcatttgtaccctcgaataattctcacgaatcattaatttattcagcaattctgcacagcacaaaaaaacacacattgaagtaattaatgttgcaattccaatattccaggaacttgccaacattcttggtgaaattcatcaggccccataccagaatacagctataaattataattttagactgaagaactcctagcaacagaaatgaaaaaaaaaagtatggcaaatgcacctgactgaattgaatgtagattgatttaacagtagaacgccaaagcaagtacagatctcatcagtggctacggatcaacaaactacacattcagaagaacaagtttcaggagttgctaggaatgacattaaagaagtggtaaacttcatcttcatcaaacactccaacctcagttgagcaaacctcacaacaaacagggtgataaactgcacccttcttttcaccttctgatgtagtagaagaatcagcagcctttcccttgcggtttttccgtttgcctttcccctcccgtagaatctgatcagtcttgaccttgcagttgcgaacgaacattgcacggtactgatttacatacgtctcatgcctgaacatcaaagaaagccactacagttaataattgtctgaagatttgaagcattcaaagtaagaacttcaggagtttctgaacattgtgcaaatgaaaacaacagcataatgtttcacgatataaaatgattactgaaagaattgcaaataggtcacataaacttgcctccagattttttttcccacaaatctagatttctcaattttgtattaaaaaattggacatgctcagtacaatcaagtgatataattgcatattctggagaggaaaatgatcaagcacaatatatggttaccaacacaagttccaagcaggttttattttagtttcaaaccaaagtaagtttcatgaagatttcagactttcaaggtggataattcaatttacaaagcaggttacaaataagtcatcatgaatgttccagcatgttgcaagattgtcgcagtggttcaggtgtcttcagaaatttttgaaatggttcattaatgtattgcaagtttctgaaaagtaagtccaacctctaatacaaataattgtggcatgtccccatgggccaaccaaaaatctccgatataccactaatgtattcctagagtcgccatttcatcatagagataagcaattaaacacccctgacttgtttacaaatagctatgtcttccacttgcaggagcgtttctcccatacaagcaaaatcaaactaaaaattcaggaacaactaatcctagcataaaccatttattaagaagttccattatttcttccagccacttaaatcaaccaatttgatcattgtgagcatggatgtcgattgtatgcaaaagatttgctcacatgtatagatatactcctcatggtctaacatacaccaacttctccaaacaaaattattgatagcatctaccctatacaggcagcagcaccacaatcctgatagtttcttcatcatcaggaaaagcatcgtgccaatccaagaactaaaaatagtaaatcgactaatctaaaaagaactagtgactgcttaataaacatgcatattggaatccagaagcctcctcacagagttcgaagcagtaaggaaagacaacctctggcaatccaggcacaaggtagtgaagcacgcggggcagctgagcacggcgtcagaagtcctccctttcctctgcttgctcacccaccgctcatcgacatcatccaggtcgggatcgtagaactcgggctccacggagtaatctatctcatcgtcgctggacactaacaaattcagaggtaacacaaaaccaaaagaggggaaatcaggtgcatcagtcaggacacgtcaggcatctcccatttcctgcacgatttatatatacttccggttcttggaggaggaagcaaaaggggttcgcatgaaagattttagccatctaaagcaagggggggattgggagagctacctagttctcggggatcgacggggccgccggcgtccgcttccatcggctggctcgccgcctctttggatttctcgggctccatgaaaccctcctcgcctccgccgtgcgctctcgcttccgcttctccggccttcttccttcgcgattcttctctctcctgtggctgcgaggttttgggccgaaccgacagcttggtgtcggcctaattggagaaaccgacttgagttcttccccttttttttttgtttttttttgtcagatcagaatattagattagatacgattttttgtccatgtattatatagaagtaaaaaatggtgaaaaaaaaatcaaccatctaaaaaaaggaaaattaaggccgcattttcgatacatgtgaagttcagcttgtttactcaaacaggtactgtagctttacaaatattcaatcaggaaaaagagagtatcagcggcaacatcttttcaccgtgatccagaaaatctatatcgcatattacaccagtacaattcttttgttctttgaaacccatgcattcatgagtttgtcttagaaattaaagagaatcgcacatacatcaggaataataaaaaagagcacataatttggcatgttttgcttctcaaaagccttcttaagttgtgaccttcctcttaaaaaaaagctttcttaagcgagtgcccttttgattacaagcagctccttgatgatatctttggttgacattctactcaatggcatttccccagagcagagcagcccgagtttaagtagcgaaatcagggagttcaccctttctgacggaccatccatggatgttgcaggcggcgcgttttcaagctctgttaccagctctacatcgagaatgtccatcgctcgattattcagggccatctcaacgcacttgcgaaggctaaatccttgctcacatgtgttatctgtaggccgccttccagtaatcatttcaagaacaagaattccatagctatagatgtctccgtgagttgaaaccatatttccagcaccatattctgtttgaattgaacagtgatgatgagagtaagtaaactgggtaaatgataatgctatgtctatggtgaaagagatttgacgattgaaaggtcgtaatgttttcaagtaaatttcttgtgttaaataaatcgatagatgcaaataaaaagaatgataaactaaccaggtggagcataaccaattgtccctctaaatcccatcgagctcgttgagggttgagaagacagtatcttggctagcccaaaatctccaacatgtgctaccatatcagcatcaagaagcacattacttggtttaagatcgcagtgcacaacaggtgtagtgccatggaaatgaagataatccaatgcacaagccacatcaaagagtatacctactctgtggacaagattcaagtgcctctcttccaattggttatctatctgaggatggagccactcttctaggcaaccattgggcatgaagtcgaacacaattgctttgaagtcgtttccattgaagtccatgcttgagcatgctgtaactatcttaacaaggttccggtgtcttaagttcttcatcgcttcacattccgccgtgaaactcttaagagccccaggtgtctgaagtttcaatacttttacagcgataagattttcattctcaccagtttcatcgaacaatttacctctatagactgatccatagctcccagtacccaacaaattggtcgtcgagaagccatctgttgcatgtaccaactgctggtaggagacaagttgatgggctcgcatggacattgttgaaggactttttgttaatctgttcttataccaagcatggaagaaaaggagcaatgaaaggatacatattgttgtagcaacaaggggaacaacaatcgccaaccctggaactctatgccttctcttggaaatcttaagagaacatgtaggcaagtgaagatctggaatgcccccacaaagcttgttgttcccttggaccgaaatgccagtagcatttgcaaaaacaccaaacactggcacttcaccgtcaaagttattgtaagagaggtttaaatcatagagtgtgaggaagtgtccaaagaactttggtatttggcctgaaaaattgttactagagaggtcgagaatttctaaacccttcatctcactaaaggatgatgggatattaccaataaatgaattgttttgcagatacaaaatctggagaagctggcatttttcgaaagtaataggaatttcccctgataattgattataccgggcatcaaggtatacaagattcggtagattcccaacttcaggtggtattgacccgtctaagtgattgtaggagatatccaaatatattgagagtgttgtgatgttgaataaactagttgggatggtacctataaagttattaaacgagaaacgtagactcgacagtgaaaccatgtttcccactgttattgggatgctaccactaaaattattccttccaaggtctaaagagtccatatgagttaaattgcatataacacgagggaatggcccactaaagtaattgttatctagccacaaaattcttaggttttgaagcatacctaatgatgacggtggacttccagtcagaaaattgttatgtgcgacaagtgcacctaaattgattagtttgccaatttctctaggcatgttccctacaattttgttgctagctagagtgaggattgttagtgatgcggataagttggaaattacggatggaagagttccactaaacttattggcttccaattccaaaacttctaattgggagcaatttgttaatgctttcataaacttccagtcgttagattctttggcttcaagatcattttcagtgagaataaaccacttgagaccctgtaaccctcctaactctggaggaattacaccactgaagtggttttccgcgatctgaaatctagagagtttggaggcattaaccagtgatgatgggatatggccatcaaacatattctcccccgcatcgaaagtctcgagcataggaagtgtgttgaacacgttcggtggtagcatcccactgagctcattgttttctacagaaaaatgttttaggaatgatatgttacaaatattaggaggaatggaccctatcagaccgttagcttgtaggagaagactggtaaggttgttcaagtgaccaagagaagaaggtatgccaccagataattggttatgttgaataccaagagcattgagctgggaaagattgcccaaggaagctggaatctcaccaaatagcatgttgaaccctagattcaagaagtaaagtgatgacaagttacccagggatggcgggatctctcccgacagattatttgcacgaagattcaagtacgctagattcctcaacgcggcgatctcacccgggatctcaccacggaggtggttggagtccaggctaaggctctcgagcttgctacatcctatcgccaacgccggtgggatgcccccttctagcgagttgccagaaaggttaagctctcggagcctaccgagacgccccagctcgggaggaatctggccaaccagctggttcgccccaaggtctagcacacgcaggaacgagaggttacccaagaacggcgagatgagcccggacaacgacgaggagccgaggcttagcgcgacgacgctgcccgcgtgccggccgcggccgcacgcgacgccacgccacctgcacgggtggttggaggcgttccaccaggtgagcgcgccggatgggtcggacaccatggacctgaaggagagcagcgcggctgcctgcttgtcggtggcgtttgtgctgctgctgctgctccctaccgtgcataccgccgcaggggaatacaaaagcaacgtggagcatagcaagatcactagagcattcatgcctgtttatgtttttcagcgccaatggaactgaaggtgagtgggagctcaagggtgattggtatacgggcagaaaaattgcttggaattcacagtataaatagagatagaagcgcatgtaggagtagcgacgaaaagggttggaaacagtagaaaacaatctcaactatttccataactgtttttctaaaatggaaatggagttatacggaccatatctctatttctactatttaaaaataagagatgttcctatcatctatcatccgtgcgaaaaaaacgggcaaaaaaaaataaaaaagaatctgtccgattgaaaaaaaaggaatgtggcgaaaaaaaattgggtgaaaaaaagaaaaaaaaagaatccgattccgtcgacgcgataaaaaaaggcgaaaaaaataaaaaaaagaatatgtccgattcaaaaaaaaattatgtgacgcagtaaaaaaaattgaattctcttattcgtgacacggtactatatatctctatctctacttaaaaaataaaaaacatttctgtcgtccgtaataacgaaaaagggtgaaaaaacattaaaacaaaaaaagaaagtctgattcaatttactttaatcgtctgtgaaaatcttattttatcttaatctcaatctttccgaggggaccgagcggcgcactccgtccccgcccgcgcgatgaaacgccggccaaagcaaaagaaaaagaaactgaaattgagcaaagggataaactagattgaagttcccaaaattaaaagaggataaacgatattgaaactcccgtaactcaaaaagagggaataaaatagattgaaatttcccgacaaaattccccaaattcgaagaaccctaatttctggtaagaaccctaagagtcaaaatccaaaccaattaatctaagggttcgggttacttaccggacttgaagcccctaagctcaccggagctttctaggaagcggcaccgccgcaccttcacctcctcgcagttgcgtcgggttccccgtgcgcgcgctgtcctggagcacccttccaccgtcccttgccgaagacgggaagcgtcggcttggcgtcacccctcccaccgatgaggtccaggccgctcggcgctcgtcgccatttgcgcgcctgcctagccggaccgccgacactgtggcatggctttgtgccgccctcgggtgcggcccccagccggcaaagcaggagctgctcggcggtcatcaccacacgcgcgcaccagctcgccggaccgccattgccgcctttgttgtcgttccgcttgctcgtcgccggagagaaatgggattgggagagggatttgggagctagggttttgcccctctctcctggtcggcgcttcatccggcacggggacgatcggagccatccattagatcggagatccatccattagatcggacggctcagattcgcccagtgttgggccaccaccgctgctggttacgctgcgcccaatgggttgcggaagtgcatcggaccgtccccgcatatgtgggccgcgctctgctgctcggcttgtgggcctgttgatgcgaaaaacacacactggcctgggagatctgcttaactctagtgcaggttcaagatgttgatgagatgcgggagtgccattcagtttgattctgtaactgacaagatatacaaatagcagatcaatgagccgatcggctggcaagccgatagattaattccagctgatgccgatactagccgatagcaatagggttttgagctatcggctatgattctgatgtagattctgacgcttgatgtaaataacaatataaaggcaatcgactgatgataatgtaagaaagcaacaatgtaatccaatagaaaccattcgactaacaatgatatgatagaacaagtattgatctgaaggttaaatgatacatcggctggaggttcgatgtcataaaatccacaacattagataaatcaatgaaatatttgttatcatcggctaaatccaacttatatatgcagtccttataagccgatgcaacatccagataactcatcggttgaaaccccgataaaacccttattggcagtcaacaagtaggctagggattatggttctaagcacaacttagtagatcaaacttaactaatacaacactaagtatgaaaagaaacataatatctagacgatcatgcccttgacggatttttagagtggtagatgccttagctaatctaatctagtaaaacaatttagccgatactggcagaaaccctaaagcgagagacaaccgatagagctaaattgagttactaagactagattaactaagacatatgataaataggcaggcaaatatatcatccaaaccagagcaatccaagaggttgaatgtactgatgcagccttgaacgacgccgacgtagacaatacaggggattgctagttggcgcgcgcgccagctactcccgggcctcccagcccatcagccatttttttctttttttttcgcgatttcttctttattttttcttttgtgtttttttttcgttttttctgattactttttttaatctttagcacacttatttttttcaaaatgttttgagttgaaaatttttaaatctgatttgaaagtattcaaatcttgagttgaaagttttcaaatttgagtggaaagttttcgaatctcgagtcgaaagttttcgaatctgagtcgaaagttttcgaatctgagtcgaaagtttttggatcggagtcaagagttttcaaatctcaagttgaaagtttttaaatctgagtcgaaagttctcatatttttttcaaatcttaacttaaaaaattttcaaatctatacttgaaagttttcaaatctcgagttgaaagttttcaaaatttgtcttacacatttaaatttcgagttgaaaattttcaaattaagttttaaaagtttttaaaatttaacttcaaaagttttgatatctaacttgaaagttttcaatcggttagcagaaaaaatcttccggaaaaaaggaaatcatatcttaattaccgtcattatctactaatcacttaattaattaggctaaactatcggaaacgctcgccgccaacgcgcacgcgcgcgttagcttttctgaacgatacaattgcctgggccggtggaacgtaggacttatcccttcgcaggaggtcgatttaaaaaacaattgtaaaggtttcacctcgtgatcaaatatatttgaaacaaacctacaatacgtacattgctatcatccgattgctgtccggccgtgttacggcgtgggcacaactaacaggcgcacagcaatattcattacggcctgaatcatctatcgtgtgtgagactttcatcgctgctttgattgtatgctgaagttggatagcaacatcgtatatgtatattattttcaattggagactcaacttacaactcgtatgcatatatattatgcaggtactcatggtgatggtggccggccatagatgaaaccaaaaattagatgacaaacggaaatgtaatttaatcgaactctttgatagtatgccaacgtatataattagtgatggagaacaatgctcgacggagccacttatatggacaaagaggagtcatggatggactcgcgatgtaccaatcgggccttcccgaatcccatcctatctgctaacccatatatgcgatatatatgataggactagtgtgaaagacgaacgatggatacgtatgaaagatggatgacgtaccaagcccctaacaaaaacacttttaatttttataatagtagagatatagaggtggaactatagaaacacctttaaattttataatcgtagagatagagaggtgggacggtataagcactataaatattttaagtaggtaaagataaagatattggataaattaaattgcaagctcacatatttatattaacatgactatataatatggtcataaaaattcgcttacactatgtaaatcacaaaattacctattcttcagctatgtccttaaattagagatttgatcgagagattagtggaactctaaactatgggcgaaacataaaccatagatgttgtaatattgtaaacggttctactagctaactgtcgacagctttcctgagtgaaaactattgaattttttggccgtcgattccgcgctaagatttgtgctgagatattttgctatcggatctaaaccctatttttcacaagctagtctcatcatcgcatgtttatggcagatttgtttaagttacatctaagttatattctaagtacatgctagttacattgtaactacactaataactacattgttatctctatataaatctattatattattaagacagctcgaaaagaagccaccacattcgctgtggaggctagaaattcccacaataatcgaagaaaaagaaaagaagagtccaagtagaaatacaaactaaaaaataactgaaattcggaattaaaaataagcaatactgaaataggagtccatataagaacccaatacaagatcaattaaaacctttggcaattctagattttaactgtttacagtagaaaagataagtctatagaactgtgtacgttacatactaggagtctttgtccttttctgtttctttggcggtgtacacagtacacgtataatctaattcaattacaaacctatacgggcaagagttgtgctgccaaataaacaaagcttgcactgctgcacctatatattctgtagatttcaagcagcaacgattgggctggagcggcagaacccaatgatagcgggagccgaccatagtaaaaagacatgatatttacatagacattacaacaaacagatcaatacttgcagccggcaatgcatcaaacaccaaaagtttctttgatattcatgaaagtacacatgatatcgacatattgtaattagtgtatatttttcacaggagatgaattagtgcaagccgctataaactgacagtcagataaacgtttagattatagtggattcacaatttaacgttcataatttaacggttgagatataacacctatatataaatataggaattagagttgtagtgctaatataggagtacaaagcgccctgctcgatggaataatcgagatccaattctaaaactgttatctaaacctatttgattccagtggaaaaaaaaagcaaaacaggaactaggtaggcagaaagccgtgtatatacgtgtgcacatgtaagtattattttttcagtctaatcacttcaaaactatttagaacatactttgatatatttgttgctagtaaaaatgaagcgactgtctctattcgatcctttttaatcaccaaatatacatccagcaattcagatgatttataagtaactaaatttgaaataataataataaagactatgaaaagaaaaaaccatctacaacacaacatgtgattaattaaaatttaaaaaataaattatgaaattagaaaaataaaaacaaaagtttaagaaagaatacgatttatgaataacaaaagttcaaaataaaaaaaagaaatattaaaagaacaacccgtaacacaacaatggtaaatatcaataaagagggagggataaatagggtgtagcggttgatgggacattttaaaacaataaaaaaataaatgacgattagattcaattttaaaaatctcaatgacgattaagagaaacagcagcgggcaagccgtcaaggagcgcagtcgtgacgtttgactggacttctaaaaagaaaaaaaaacaacaataatcataatatcatatttgactttttaaattccaatgacaactaaaaggagacatcgggtggattgtagaacagtacaatgacgacatttgatgtaacttctaaaaatataaatatgtcaattgacaagacaatgaactaaaaaactataagatctaaatatgaaagtttcaaagaggatgaataaaagttgtgaaaggttgggcaatcaaataaatgagtggtaaaaatgtaaggggtgacgacttattgacttttaaaaactaacccgatgataataagattcaatctttcaagatcggctagatggctatttaacaaatttaaataaaaccatgcttaaaaatatataattctggatgggtgctagccgcgcaacaaataaatgggtgacaaaggagtaagggtagcaacaggtgtgacttttaaaaattataaaattataaacctggggatgataatgtttgatctttgaaagtcctaaaacaacgagatagatatttaataaattttaagtagaatcatgtgaaaaattagataattttgtgggtgctagccgcgcaattgcgcggaccacccagctagttagatataaagttgcatatattattttaatacatatgtacaagttattattattatagtatagttctagtgaaattatatactatagttagatttgaaagttttcccctcaaaaatcactcgacattttttttagctaatccctattttaaaattactaccatattataaagggagaattgattatttgactatgttttgaagcctaattaacaatttgaccctatttttttcaagtttgcttatttgactatgtttttcaaaattagagtagccgtctgaccctgtttcaactacgccgttagagtttcatttagaaaaagaaaaaaaaatgtatttatgagtcctaatggaccaaaataaccctgagtaaacacattaaccctaccctcattccttatcctcttgatctcccctctttctttccatagctttccccacggtgcagaaccagccacgcaacggaagagtggcggcgacgggggcctcggtggcgaagctcgggctgcgaggggcagatttggtgacggagcttgggctacggcaggtgaatttggcggggaggggcggcggaggcttgcgacgagaaggagcagcgacggcaggacccgggcggcggagttctggttgcgatggtgtgcggtctacggatctggtggcggcggtcggtgacagcggcatggcggcgacaaagctcgagttgcaacggtgcatcagcaacagatcgactcggcctgcgggatgtggatccgatggcgccgaggcatgcgggggacaggttggcgacaacggtgtgtcgacggcagatctgacggcgccgattcgtgcgggcagcggagtggcaggtcggcgacggcggcggcgataggaccttcgagtgttgggcaagaaggatttgtgttttgggatgtttttttggtagacatgaattaatttattttttttgcttcaatatatgttaaatttgtgaaacataaccaaattgaagtctattttgttaaactggaatctaatttgaaaaaataatctaacaaatctaggtcaattttgaccaaaatctgacaaatctaaaatagggtcaaatgagcaagggcagtagaggcattttgtgttttctataacatcgttacatgcccttaaaagaaagaatgaagaatgggaaaattggaaccataccattaaaattttacaaaatttgagatatgccatcctgacccacatgtcattgattcatgtgggtcctatatgtcattgagataccgatgtcatatctcaaactttgcaaaattataatggaatggttccaatttaccctaaaagaatagggtcacaccgtacgttcagttttgaaaaaaagggtcaaatgagcaaaattaacaaaaaaaggggtcaaattggtagttagtcttcaaaagagggtcaaatacgcaattgcctctattataaaagataacttcaacataaaaagggtaaaataaggaaacaattgagcataatctttttcagtttagggttagccaaaatttttaatttttctataactatttggataacatacacaaataagagagaatttctttttgagagtttataagtttcctcctatcatgtttttttttgctatatccatctattaacttattaaagtaatagaaaaaggagcctccacgttttctctcacccctagaaattcccacattaatcggagaaaaagaaaaaaaatagagtccaaatagaaatataattttaaaatagtttaaattcggaattagcaaataaggaatattggaagagaagactagagtccatataggaatacaacttagagctaattaaaatttagaataaaaaaagaaaattaaaagaagaggttagagaccatatagaaatagaacttcgaaataactaaggaatattgaaaaaaaaaatctagagtccatatatgaatacaatttagattgaattgaaatacggaatttaaaaataagaaaactaaaagtataatttagagtccatatagaaatacaacttagaaaaaaaaaactaaaattcgaaatttaaaaataagaaatattagaaaaagaatctagagtccatatagaaatacaacttagaagaagctaaaattcgaaacttaaaaaataagaaatattagaaaaagagtctatagtccatatatgaacacaatttggaaattactgaaattcgtaattaaaaaataagatgtattgaaatatgagtttagattccatataataaaaatacaatttataaataatagaaattcggaattaaaaataatttgctctcacggcctataaattctcacattaattggaaataaaaaaaatagagtccatatagaaataaaatttaaaaataatttaaattcggaattagcaaatatgaaatattggaagaggagactagagtccatataggaatacaatttagagttaattaaaacttcgaataaaaaagaaaattaaaagaagtggttagagaccatgtagaaatggaacttagaaataactaaggaatattgaaaaaagcaatatagagtctatatatgaatacaatttagtaataactgaaattcaaaattaaaaataagaaatattgaaatataagtttagagtccatatagaaatacatatacaacttagatctaactgaaattcggaatttgaaaagaagaaatgaaattcggaatttgaaaagaagaaaattaaaagtagaatttagagtccatatagaaatataacttagaaaaaactaaaattcaaaatttaagaataataaatattagaaaaagaatctagagtccaatagaaatacaacttataagaagctaaaattcgaacttggaaatatatgaacacaatttggaaatttaaaaataagaaatattagaaaaagggtctatagtccatatatgaacacaatttggaaattactgaaattcaaaattagaaaataaggaatattgatagatgagtttagagtccatgtaataaaaatataatttataaataagataaattcggaattaaaaaataaggaatattggaagaggagtctagagtttatacataaatacaatttagaaataactaaaatttaagatattaaaataaggaatattgaaagaagggtttagaatccatatctctactattataaaaattgaagatgtttttgtcgatactttgatacgtcatccgtgtatgagtcagtttttaagttcgttcgcttttgtaaatacatatctgaatttgagttggttttggaaatacagaaggagctgtataagaaatctctttaaaaaaaactcacatgataatttgaggcgaacatactcttaactgtacctcatgattttctaaaaatatatatccaagcgaattcccgcagtaaatttcgtcttaactaaaccatataacaataataagattaaaataaccttcacctattgcaacgcactggtattatttttctagttagaataacatttgtaagtaacatgacttcaaaatttaaaaataaaaatattataagatgagtttagagcctatataggaatacaatttagaattgactaatatttaaaattttaaaataattaataaataccatgtatattcaatacaatataaacattacacatcagttagtttgttcaagttagtacaaaattaatttttttaataatttttaatatattttaataaagatatataaaattatatgcgctatcatataagaactagccgtgtaatctagttttagggggcatttagattcaaggggtgtaaagttttggtttgtcacatcagatattttatagggtgtcgaatagggtgttcggacactaataaaaaaactatttacagaattcgtgagtaaaccgcgagacgaattttgtcggagggtgatcctttctagcgggaggctgtgaggcccccctttgtgagttcggccgggggagcgggtgcaatactgaggagcgtgctttcacgcgagcgaggtggatccacgagaatcaggctcatgaaatggaaggtgagagagtgagagagagggattatacaggttcggaccgctatcgagcataataccctactcctgtctgtgtgatgatcttcgtgtggttacaaagacttcagatcctgggagtacaagctagggcttggccaacctcttcccagagtctgattttctaagagacgtcccctttagtcgtagggcagggttctccttttatagatgaaggggataccacatgcaccacccctgctctctccctgcgggagaggggcccacattgcctatattaaaatgcgtcttgtgccttgggctggaagcgatctgcgcggctaaccttgggtggcccccaccgaaacttttcggctgacacgggggacatcccccatcattccctattaaatgtttggtgacttcgtgggcacacgcgcattgggcggaacgacctgcaggacctcccattacacatgatgggacaaggcatacctgcccctacgctgcctgacacgaatcgagacgtgggcgcactaccgcccatcccatccattcatcgccgggtcacagactagtcaaaaggcggttgccaggcgcacgtcaatcggtctacggcgcaccgtgccatgtcgcattaaatgcgacgggagcagttgctgcgccactcataaatgcgcctggcagacagtgctcacgcccgctgacggctcccgcttggccaccaagtggtggccgagcgagggcctcgggggtggttcaacccctcgagcccgaggggtacgacgaggtaccccgagcctcggggagggaggcagccactttccatgtgagggcgtgaccccccgagggggactgggcccgccgtacgcgtcacacgggaagggctttcttcccccctagactagggactcccgggcccatatcaccaataaatttattaagcctaattaatcagttattagcaaatgtttattatagcattatattgtcaaattattgatcacttaggcttaaaagatttgtctcgcaaattagttgcaatctgtgtaattaattattttttagcctatatttaatattttatgtaggtgttcaaacgttcgatgtgaataggtgaaaaattttgaggcaggatcggccttacatatgtttggtcggataggatggagaattttattctggtagcgacgtatcgtcacgtccggagtcgtcgtcggtcaatgtctaccgacacctaacggccaacccttccctattccctccgtacttaaaaaaaaaaaagaaggcaaacattgggtttccgtgtccaactttaactgtccgtcttatataaattttttttataattcgtattttcattgttgctagatgataaaacatgattaatattttatgcgtgacttgtctttttaattcttttcataatttttttaaataagacggacggttaaatattggacacggaaactagggtttgtctttttttttttttttttgtttttgggacggagggagtacacggttgacagcaggttgaatggacttgcccgaatgcccacggcgtgctatacggccactgcagttgactccacatacgacacgcgcgttagaatcgttcaacttgaagcttcattgtccagtcgctgtgtttctatcaagcagaaaatgtctgtactagtactttggcatgtttaggtcaggtataaaattttagcgcgtaatatcaaatatacagatacacatttaaagtattaaacgtagtctaataacaaaacaaattatagaatccatctgtaaactgtgagatgaatttattaaacctaattaatttgtcgttttgcaatatttactatatcaccatattgtcaaatcatgaagcaattagtcttaaaagattcatctcacaaattagtcgcaatctgtgcaattagttattttttagcctatatttaatacttcatgctggtgttcaaacgttcgatgtgaccgggtgaaaaattttaaggtgggatttaaacggggacttagaaagtcagtagtaatggtatctattttcacaccactcttatcactgatatctataggccacaaattctcactattacaccaccttttaaaaaaaatcattccgtatttcaatgtttgctttccaaatttcaaaatcgcctacttattcaataaaaaaaattatagtattacttggactaaataagtgcttattaattgatttaatacactagaaacttaatttgatttttgttgcaatacacgagctgtaagctgactgaaaattatatactcccatgcaaagatcatggagagagtgctagcaggcggtcaggcacacaaccatacaagaaggcttgcggatgcacaatagatgcacagcacaaatcactgtcccgcgagacttccagcgaggtcgtcacgatgcacagatctctgaacagcaacactccaggtggtcctgagcttataagaaatactatctccgtttcatattataaatcacttgatatttttctaatcaaacttcttaaagtttgaccaaatttatagaaaagtacattagtatttttaataaaaaatattattaaaatatatttgatgttagatttaatggaattaatttaatattttagatagcgctaatttttttttatgaatttagtcaaacttaactagaaaaaaaatcaaacgatttataatatgaaatggatggagtagatggttggtaggtaccttatgaaaattttagttttttcaccttctagcttcttctttttttgattctatagctttatattcttagaatttaggtcagaatctgtaccactgcagtttttgctgctaaaagtttttcaaataggaccttagtcaactttttccggctaggtgcaccccttttagaatttgttgctaaaagctactatcttttcaggttataagactttctagcattgcccacattcatatagatactagccatttggtcgtgtgttgcatgactttagatacctgtaaaaaagctctatatttatgggtcgtaatatatcatatgatgaaccatgtttttattagacatataaaaatatcatgaaattatcctttccctcaatcagggtatccaacgtttcctgtattttcatgtctcgcatctttagaagcctgctccaagttcgcataaaaaaatggccctgaaattgacttcaacaggtgttttgggaattttgcttcaggctccatcttgttccatgcttgccacaacactattgttagatctgcatctcataaccggataagagtacaatatgatccatgcatcccaaaatttatgggaaaccttttagtttctatgaaatcacaacctggaacatggcaggtgcaaagggcttggcattaatcacaaccgcaacataggagcaaaccttctggttcctttcgccgtttctataggcgagctggctgggcaaaagacttagcccagtatacatataagccctttatacatagaccataatatgataatgggattaactctaaatttattttacttaaaaaaacataggacttggtaaatagttagttagaactaacctatatttgcaagtaaggttcaagtaccatgtagaagatcttttggtttccaaagttcagtcatctcatccagtggctactacatgcttattccacaatattttctcataaaatacaaaataatttaatttatgactttgaaagggactggacaaacaattacttcctccgtttcatattattaaactttctagcattgcccacattcatatatatgtctagattcactaacatatatatgaatgtgggcaatactagaaagtcttataacctgaaacggagggagtagttaaatcctgaatctacgtaaaatcaaccattagtttatcatgaaacttataatggcaccattagaccattgggccaacaaaatattaaatttaaagtaggtgctttctaaagttgactaataataataattatcatgcttgcacaggacgcaacctaaatgtaggtagaatttcacttccaggttgttacatagtatgatactgtactaagcattataagtttgaagttgataagcaatccacatggttgaacacatctcagaaagttagaatcagtgtctctaaagttctgagattatttgtacattttagtaccgagaaaaatattacctggtttggatggtgccagcttccttgtttaacagaggagatacttttacggttttacctttggggagataattgcacctgttgcgtctgtaccatcatttgggggtgtttttatcataggattcaaagtatatatttggggggaagtgaagccaaaacactctgtatgaaatggttagtatctaacctgtgaaaaagatgatcccaataccatttatttggggacatatgttcagatgtcatctgctaaaccagtggaatcatagctaaaaaacaaaaggttgagtagatacattccaatttggttaaatgggtatatacaacattccaatttgattaaatgggtatatgcacaaaagtttgggtggtttctagaaattttgaaaaatatctttggaggtacaattgaaatgctttcttaatagaattcgtgcgaagaaaataaaaaggacttgatttgatgacacagtcaacaacaataaatttcttgttctatcaaacaatattattcctcaacaactcgtatccagtttttaccattcaagaagtactaatgttcatgattcataccttagatgcatggtagcaagttgaataaaaaatgaaaccacaaattttgaaaggacgtttatttcataattgtcacttcaggtaaagaccaataacgcaaatcaatattacagtcatttcaattcctgctttaaaactcataacatcaagaaaaagaaatacctgataatacaatatttgattgctttattatttgcttcataaattatcaaaattcattcttaatcagtgaatacacccttcacagcaaaccggaagctaaatgggtacttagagtcaaatacatttgatctttaatagtcaaatttcatttaagcttaagcaaatcacattgtagaattatcttttataggtttccactcccctgcttgctgcagctttgctcgttagacacacatatatagatacacaaatatagcaatacaccagtcatttatataatgttaggagcaaccctttcttttttctaaatgcgtgaatagctagtactactccttacttttttttttgggaaattattagtattagttatatcccggtgaaccactgccatcgaattgcttcagtgagttggacgttgggcatacggaggaaaatactatttcaatccacttataaattcatttgttattatcacacatatctttgataactattgaaataattgtatgtaactatttataattaatgaacatgaacttacattttgataggatgcattctttttacagtgctcttaaatgaaatttgcccacccaaaaactgaaattacatgagaggcttaattaaggactccattatagaacttatttatcacctttttagtctaaatcaacttgttagcactaggtgaagccgtggttcctatacatcgtacatgctttaccaacatgaacaccgtgaggagcaagaagtttagatacttaccacagctgtcgatgttgggactttttgtatttcccttggccatcgttattggaggaggatgagaagtggcgctgcagagtaggtcctggggaaccagaggcactcaggtggagatgcagaagataaggcggcagtgacccacaagtgaaattccgcgtgcatcgccgtcaggtcgagccatacctcccaaatccgaatcagccccaccatcgccggatccagaacaggtaggaggaggtgatgccgcagtagtgttggggatgggaatgaggaggaataggatggggtgtggctagggcagggggaggtggaaggggagaaaggggaggtatggattcctttgcttcccaccgcaggcgtcttcgaccggcctgtccccttgcacctatcctcgtccttctcgatgccggtggctcttcttcttacctctccggtccccattgattgtggtggagattgagaggagacatagcggctttggagatgggagtggaggaagcgagcggaaacgcggagcacacgatccggcgcctccgcctcccgggagtggcgcggcgcagcgaccagggaaggggaggcggcctccggtcccgagacggtgtcgcaactcgcaacaggtagcaggggtgaaaatgaaaaatggtaagactagggaggtggaaggatcttattgcgaaataatttttacgaaggatctagaatagattttgccaatcaatgaatccaacagctcacatcatctgtaggggcaatcggacgtcctatgtttttccgatgacgtggcgcaatctagtggcgaaaaactttagttttttcactactaggcaatgcgaaagtcttgtaatctgaaacggagatagtatctaaatagggtcttagtcaactttgcctagctacaaattgatgtatccctttcagaatttgcatgcgctgcctgtctgatctcagcacgattagcggttcaattagttgaactagttggcccgcacaatcgcgcggcgcacccatataaaattatatatttttaatatgattttgcttcaaatttattaaatagttatctcgttattaagattttaaaagaccaaaccttaccatcctcgtgtttctaaatttgtagtttttaaaagtcacactagttgataccatttacttctgtcatattattctttatttacttgctcgatctactactatttctattcattctttttggaacctttaaaaactgggcttcttcattatactcctccatgaccgtccactgcatcttctctttattgtcattgctattttaaaaatcgaacataattatcgtttaagtctatttttttactttatagaagttgcgctaaaacgtcagcgactttgttctctacgtgtacttctctacggctcgtccgctgcatcccttctttattgtcattgagattttaaaatcaaacatgattatcaaacacgctgcagcagatcacctatcacgttcagttattattacaggatgaatatctaaaaacagaaaaaaaaagaaaaaagaaacttcaggctcatgtgttaatccttacccaggcattctgggtcatatactcatatacctcaatcagttttaagaattactccctccgtcccagaaaaagacaaactctggtttccgtgtccaacgtttgaccgtccatcttgtttgaaaaaattatgaaaaaaattagaaagataagttacgcataaagtattaatcatgttttatcatctaacaacaatgaaaatactaattataaaaaaaattcatataaaatggacagtcaaactttagcacggaaacccaaggtttgcttttttttttgacggagggagtacagtacatgcattgcagtgcagttatgcagactaagagcaagtttaatagtatagccctactagctccaaatcatctatagccaatgtaatagccaattcatataatagctacttactggactattaatatctggtcacacctgtcatacacacattacgtattggagtccgtgctgtagctggctacatatctgtagccagctgctcttctctcttcctttatcttcttaaaatatgtttatagctagcttatagcctgctattatacctgctctaaatctagcttctaatcaaactggtcgcaggcattgaggtttccgatatcgttaccaaaaagccaaagcaacatttggcaaagcagaatgcttcctctgaactcgtgccttttcttttggagtattccctttgttccataagtcattttagttttatcctaagtgaccaagtttataaaagaatcatcatctacaacatcaaattagtttcattaaatccaccatgaaatatatcttgatagtgcatttatgtattattgtagcaattttctatatcctcagccaaagttagagaagtttaacttatgataaaactaaaataatctgtaatatggcaccaagggagtagaacgtaaaataaccacatgtgtgacagtgaaaccatcgtagtgccagttcatgcactactcatatttgatatggaggggaaccaagtttgatctgacacctaccttgatagatacacagcataaaaggggcaagttctacagacctcagaagtttgttctggactgcaatttacaagcaaggggatgacagggacgtcaagcatgaacgatcggagccaatgattcaccgtctagtgacagtaatcagttttgcgattgactctgattatcttgcttagtagggctttgcagtgctgtcactttttgcggctgtcgtcttctcagcggcagaagtgaaagacacagggaggtgcggctggtcattcactaccaagctcaagacctcaggtcgagcatagtggcccaccacatcaaaatcaaacttggctcgcacgatttctccaaggtctgcgaatgaatttcattacaaattttaatatgaattgtctaatcacaactattcaaaatttggtgccagaaaactgagggagcacataaacaaaattggggcaaatgcatgtacgaaaaacctagtacatatgcaattattttctcacctagatcagctgtaatcagcgcctccccttcgtagttgggacctgccaagacttctccggatggtgaaatgatgacgctacctccagggcagacaacagtgtctggagaaggctcttcacctaaaccagaaaatacatactccggtggtggaggatagtcctttctacggcagaattgatttgctgacaggacaaagcatcccccctctaaggcaatatgagtcatggaggcttgccaaacttgtctggaatcagcagttggagcacaatatatctcaatacctgtgtagtgcatacaatatatgagtagatgatgaagaaattcaagtgccactgccacaccagcgtttttattttttttcacatttgcctatctgacttattctgaaaccaaattcattttgttatttcaggaatatcatctcatgaaaccatgtcacttcctcataagctgtatgaactatgaagacttctagtggtattgtagtaacaatattccaagaaatagtcttacctttaccataaagtgctgtccgcaacagtggcattttattttcccagcaaattagggctccgatctttccaagtggagtatcataaacaggaattgttgatccatctccaaatccccatattattcgttctaatgctgttggcatgagctttcggtgcttacctaggtaccgtcctagaggatcaaagaagagcaccgagcaatacagagtgtaaccttccctttcaatcactcccatcactaaaaatactttatattttccagccatagcagccaagcgtgtcacctctgggcctgtaagtcagaagatggatatatcaatctagaagaaacaaaatgtatgtccacagtgatgaaacagctagaaagctgaatttttatgataaaacacaaaatctgttttcttatgataaaacacaataaaaagcatacaaaacagcacaggatatggggttattgatttgacaacaatcaatccatgcctggaaccagaaagcatgatcataacatctagctgaagcagtcgaggcaagtatgagtatcaataatccattgtagatgtttctccattttggggaaatcctatgccttacttgaacaattaccaaagctatggtcttttttttttttacatcagattaagtaattggatagatctttggtaacatctatgacttctttcccctaaaaagttctccagagtctaatatgagatggatatttctagtactccctccatccaaaagtgttaggcatatactatttttttggtttttccaaaagagatggtcatatttgtagtctccatatgctaaattaattgttgaccagaatccgaatagccatcttaatacttataggttgcatgtatgcatatagttccttggttttgttacatgggggatgagtgaattcctccttggtcttggtgacaaaagaaatatgccttacttttttgtatggatagagtattcagcaaacacagtgttgacagaaatatgcaatttaaacaatcaacacacacatatatatatatatatatatatatatatatatatatttctttttgatgataaaagggcatgaacggataagtcaatagcaaagaacactttgtttggcagggatcaatcctagcccgttccccatgggtggcccgggattttaagtgaattgatatattccattacattaccacttaccaggcacttctattgccgccgcatgatacttccggaattcttccttccccttgtcttttggattaccaatgcttatgttggccccaaagccaaatgtggatccacgaggatagccgccaacaaaagcttctgggaacacaaccaactgtgaaccatacccagcagcctcctctatcaacctctctgctttatctgcagtatgaatagcaatgtgaataataaacaatcgtttctaatgcaatgcatcgatctggttctcccaaagtgtcagtattggccttaatgtttacatgcataaagtagaaaaataatatgcattatgtgtctttcctaggcaatggcagtgattggaggaggtagtgccatagtgcaaaaggataggcacttggacatgaatacatgatcacacgagcccatgatgcagcatgctgcaacagaaaatagcatataatagagttttaacattttgtctggcctggcagaatagatcatttcactgggtcatataatcagtgggttattttagcagaataagaaaatgtgcattctgcccaaaacctgtgatacaaatgtgctcaccatttgtaaaatttccaaaggctcaacagctttgtttaatatccaaaggtactaaataaggctcaataacaaattaaactcttgaagaaagctcctcagttgaatactgggccagcccttgctgcaaaatctttcagtggcatgatttaaatatagcaaatactactaacaaaaattttcctacagataacacgcacagaacaaaaaattgtggcgaccattagttaggtaaatgcataatttacaagatggggtataacatacggcaatcatgacaattggcaaagcaaaaatcatataacaattaacaaagtaaaatcaaagtaagagctcacaaggaccgtgaacaaaccacaagaaataaaatctgatagatgtaacctatcatgatttcacctcaaatgacaaaggacatccaacaattacctccaattctgcgcatattgcttactcattaccaacaaatgacacctataccaaatctcacactgaaccctcttaattaataaccactagctgcagcacattggtgatttctgacttattttatctaccaacaacaacaaaagaaaattcaccaaagcaagggggggcacacacgagcgttgagcgtacgtgtgctgtgcttacctagagtggccggggtgtcgtagaacacggtggaggcctgcacgacggtggccctgaccgtggcggcgcccgagtcggcgccgccgttcatctccacctccgcaatcaccggcggcccaccgcccgagcccgaggggaccatagccatcggtacggcacgcgcgccgccgctcgaagtggacgcgggagaaatgggggccggcggcgaggagggagatggtgggggaggagctgaagctgaactgtcaagtgtgactaggagcagaagacgagggagcgaaatccatcacggatgcttctagaccctacaccttctccagcctttttccatggctgtaactttcccgtttcctctttccctctcttctttggcacgtgaacgaagaaaaaaataatttacaaataaagtttctcaagtttgagtgaattacgctttagaccacattttattacctaaacatatcttttcactttggaccggataaatttgccattgttgcaatttgaaccaccatgaacgattttttttctcgtgcaatcaacgaccttaaacacatcagctttagtatacggccgatctcctctatatatggttcatatgtttgccgaaagggaagttagtcatgacgagaaaagttgtttatagtagtccaaaccgcaacaatggtaaatttacccggtccaaattgaaaagataggtttaagggtggtccaaattgaaacttgggtaataaaaggtggactaaagtgcaatttagtcaagtttttatatctgtattgttcttggtatggaatactacgaaaatagagaaattcattagtgcataaaaactggactaggagtaggagagattatttcaccaagattactgaacaagttgtagtggccgttttgaactaagacggacaagaaaaacccacgcatggtaaagtgaacccagctcattcgacttcagtggagtaactaattagggcccctttacttgaaagaaaaatatagaaaaatataggaacttttattctgtatagaaacaataaactttgctataggaaatttctctatatgattctttgaaccaaaggattattgaaaactattgagtcttatcaaatttctaaggaatgcccaaattcatacaagttttggagtatttttaacatgaggttcaatatcatgcgaagtctcttatgagtttatctctctcatctaattcttgcatttttcgtatggtccaatcaaatgattatttcatatattttttatgtgttttataattatttgttttgcgcttgatttttttgtcagaattctatgtttttcctattcatccctcaatctttgtttcaaattagccctcacaagacatatataggttgcattggaccgagggagaaacgagaaagggacaattttgtttgtacaattgtacccctactttgatatccaataccgattttaccctacattttagggttgttgttttttgccctatttttttcaatgaatgaggcgtttacccctgtttttgatggaagtgagtgggattggacttagtgcggtaaagaattagagaaagaaagagataacgattttttaaattattgattgacccttttacccctataaaatatccaagtaccgcttggtgtccctccaggcttgggcacttggcatcaactcttcccttcctgaacccgaatccccgttgtgaaacagtggcggcagtgtccgtgggccggccaggcaacggggacaactcgagcaagtgcaggccacccaacccagttgcagtgtgtaggaggaggctaggcattgcacaagaggccatggtagagaggaggacaatggcggctgctgtagatcagcgtagggaggaggtgcggctgctcgacgtgtcgaggaggcgacggggaggaggacaacaggtcaacgacggcggtggtggctcgatgaaaggaggaggcgacagtggcagcttagcgcggggaggtgatggtggcggctcgacgtggggaggaggtggcggcggctcggtgggaagaggaggcaacaacggtggcggcggtttgtgagaggaggcgacgacgacagcttggcacaggtaggcaatagatttgcttgacttgtctatttgtttttttcaagatgtcaaattttgaagcaaatttttgttgatatttatgttaaaattatcatattagtaaaagtttatcgaatttgcaaggttcatgtgctaaatgtgggcaaattctcaatcatgaacaaaaacaggggaagtttgcaacatgagtaagggtattgaatgccttctcgctaaagatttaacatcgttaatctgtccatcaaaagtaggggctaaatttatctttatttcaaaaaaccatgggcaaaaacaaaaccctaaaatactgggcaacatcaatattaaacattaaagtaggggtaagaatgaaattgccccaaagagaaaaggttatataatttccatagagaaaaacacaggaaagaaataatataaatcacatgaatacggatacaaaataaggaaacacaataattgtaaaaggatggatgtttgcaacgtagaaattttagtgggtgatttgattacatcctgttaatcctcttttagtctctaaccaagtatgtatcattacttctttaatcctcaatatccggtggtaggaggaagcaatagctgcctgagctttgccagccgtacagcagcaacgcgagaaatcacatagcctgctgtgctcccatggacctagggcctatttggattgttgccttaccaattttttggtagtgccaaaatgtagacaagttttggcactaccaaaactttggtaaggtaaaattgtacttgatcatatttggtttgctaccaatatagagttaaaatgtgaaattttagtgaagaatgttctagatgacgccaaatctagattaggtattaccaatgaataggcttcaatccaaatcaaacacaattactattcaaattaccaaaatattggtagtgcatgtttttggtagcaatccaaataggcccctaattgctcaatcaatagctcgatcaatagaaacttctggacgaccttctggacaaccgctgcacgcacgcacacgagcgtttcacgctgcacgtgcgcaaacaggatcaagccgtcccgcgaaaccggtgttgccacgtagcacattgttctttcaattttttgcatggaattcgtattataagatttggaacaattgttagccacagcgaaactgatggtagaaatggaatgtagaatactgtatgatttgttggaaattgaatactgagtactgtgttatcgcaatctacatttgggagttgggacgtcttcactaacgaataagaggaagaaacatgacacgattttcagacgagtattacagcactataggcaccaattgtttatcagggaagcatcgtctccaaatctttacaagaaactaaagacagattattcatggggatccaacactggccagctgacaattttattgcacaccggatggaagattaatggccatcaggtcctaaagataccgtcactctttgcagcaaaatttttctctgcagcagaagtaaaagaaacgggcagctttgattcggttttcacggtcaggctcagcacctcgggtcgtgcatagtgtcccacgacgtcgaaatcaaacttagctcgagcaatttctccaaggtctgcaaaacataccatgcaatttctctttagtgttcttgtggtgtttcacggttacaatactgttctttgggcagagggttataatctgatatctgtagaaataattgcacaaatacagctggatacatctacaccaactgctactacatatgaaaaaagggctgggatgtagtagtcaacaagtgagcatggaatttacttgaaggttccacgtttcttacccaagtcagctgtgaggaggccctcgccttcatagtttggacctgccagaactgttccagatggtgagacgatggaacttcctccaggccaaataacagattctggggatggctcttcatcaaggccaccaaaagtatattcaggcgctggtggatagttctttctgcgacaaaactggtttgcagaaagtacaaagcatcccccttcaacggcaatatgcgtcatggaggcctgccaactaggcgagaaatcagcagttggagcacagtatatctgaacacctgcatgaatgtagaagatacttcaggtaaaatataaactcaagcacatgatacatggtgcatcttcagagtcactcaaagtacatttctccttttttttttcaaggtagtagtgtctaacaaatgaacaaccctagtatcccttttgtggtgtcttaactcttaacttctttgcattaccaatcgatataactttaacccagagtacttgctcaggtcgagaaacatatcatattgctagaactaggaatacctttagcgtacattgctgtcctgagaagtggcattctgttttcccagcaaatgacggcaccaatcttccctattggagtatcataaacaggtatagtagatccatccccaaacccccaaaacactcgttccagtccagtaggcatgaccttgcggtgtttcccgaggtatttccccagaggatcaaagaagagcactgtattatatagtgtgtaccctaccctttcaaccacccccatcaccaagaaaatcttgtattttccagccaatgcagctaagcgggtcacctctggacctgcattcaacagaagtcggtaaaatgtcttgcaggggcactgcatagtgcatatcctctgtagcaaggaaagctagatattaagtggggagaaccggagaatagctaaaaaatgatgtaagacgtattttaactgaattaattgacggaaaaaaaaagttaagatggatatgatcaacacgaattctgaacattactacagaaaaaaaaaagggcggttactaatgcttttattcattaatgcatagctatcatatatgattatcagcttgggatctgcatcacgagttaggtctccttatcatttttttttctgttttacctttcacaatttagggaacatggttgaaattgatatttcagggtttatacttcacatttagcagtgtattttcttttttttttagataatagcagtgtcttttctaatagattgataacctaaataaaataaagcactgaactttaaaaaaaaaatgaaaatgataaagcaaaagaccttggtttggaaacactcgataaacatagcgtacgacaacgatatattaattactaaactatttcagaataccaggcacatctatagcagctgcatgatatttatggaagtcttcctttcccttggcagatcgattgccaatagtcagtccaaaggtagatccatgagggtaaccaccaacaaagacttctggaaatagaactatctgtgaaccatatccagctgcttcagctaccagtttctctgctttatctgcagtgcaaagcagttaaagaaattagcataatatcgttaccccgtttatttaggattttattcataaaaagtaacatgtcatatgatcatacatttacagttttaattccattgaactatttacttgtttcattctccactagattaggtagataggatcattgcagataaatcattaattacctcattaaggccatgttcggttaatccactagagggagggattggataggtaaccccagtaagacagccgtttggctttcaatataagccgggtcgtaagaccttatttctaaaaataaaaatattggcgcacacggagatatcctacttcctgcccagtttcagttcactcccggtgttttgcgtgtgggtaaattagtgtcgctgtgcgggcgagacaaataagcaagcaccttgcgcgcaccacctaatccaaacagccacacgggcgagacaaacaatcgaacacctcgcgggtgatactagctgcagcagcagcagcagcaacagcataaacgaagatggcagaacgcaccgagagtcgcaggggtgtcgtagaacacggtgcaggcctgcacgacggtggcacgcacggtgccggtggcaccctggtcggcgccggcgttcatctccacctccgtaaccaccggcccactgcccgagctcgcgggggccaaagccatcgctcccccacccctcccaagaaattgagcgggaaggggatctcgttggggggagggggggaggccgtgtgctacttgtcgtacttccttttgaggtaatcgcggacgaactggtcgcgggcgagcgtgcgcgcccgctggggctcgacgtgggcgtaggagaggtggacgccgtaggcgaggaggcctgcgccgaaggcgaagagagcgacggtggagaggagctgacgaggagtggacggggagcacaaccccatccgcgaggagtgtttttggtggggggaccggattgtaaaaggtgaatgcgacggcgacggcggcggcggcggcagccgcgactgattggaagaggacgagtggacgacccgagtaccggctgctctttcgatcctccacctacgtatgtttcttgactaacaatttcttttaattttgtatactttataattattagcatataggagattttaactctgtatattttccatactttacaggagatttttatctgtattttttcagtggagtgataaccatttgcttatagtatattccctccatcccaaaaaaaagataaaccgtgggtttccgtgccaacgtttaactgtctatcttatatgaaaaatttttataattagtattttcattgttgttagatgataaaacatgattaatgctttatgcgtgacttatctttttaattttttttataattttttcaaataagacggacggtcaaacgttggcacggaaacccacagtttgccttttttttgggacggagggagtaggggccaggggagaagtttgcacatgtatacatgcacactcacacatcagcctttatacccttacaccgaattttttaaagaaatactagagtacacgttaaagaaattctacccatcgtttagctaaattcagataatacgacatattaacaaaataataataatttatggatacgtgttcttagtggcataaatgctaatgtaaaaaaataaacctctatgaaaaactttaaaatcaaattttaaaatttgaaatttgaaatgctgtacagaggaaactacgatggggcctgagctatttcctgtatatgttttaacagctcatattattttgcatctacgcagtaacgcagacatgcacatgttttacggatgcaaactcaaccaagatattccttcgtgatctgttttgactgtttcacaagtactgtcagggcaaatgatatgtcgggaggagacacaatatatgcgccaaatacctccttagaagagaaccaaatacaacattcacccaacaatatcttgtttacgatggggattcaaaagtaggtccaccacttcatctcatgcatatcactgaagcaaatcagtttacaataggtttaagtgacaaatggtaagagacaagaagcctcatgactacggctcaagagtgtcacttagaacagtaaactatcaaatgtcaacagacaatttactccacctcttccaagaaatccttgatctctgccggggttagaactctgcattttgtacagaaagtaacttgtcagtaacttgttatggcatgttcacaagacagaagttgcattgcatatacgtggcagtaaaaaacagcttgatcaagtctgtatgacatacttgaattcacggtcagatcgaataactccaatttcaatattgttggctgagatttgaccctcatatctgcaacccccgaatcagtcagtaactcagtaaggatgttccggaaatagaaacagaagcacctacaagacatacccttctttcagagtcaaaatggcagtatggatggcatcatcaagctccatgtcttctgtgtatctgaaatgaggacataaagaggttgaacaacagtacaagtgcagtcatacaactttggaaagaagatatcctcgtaaacaaatccactttatttctgatcagattgaggaaaacagagtgtagtacaatacaatattagtggtatgctatgtaccttttttcaagaaatgtctttgcattggagacatttttccccatagctgatgctttccaggagaagtatgatcctgagggatcaacctgtagaaataatacagcacatctggcattataccaattttacaccataacaaaatatgacaaattgacaggtaaaatttcagtccagaagaacaaaactagcacaactaatagtggtgatctgctattagatgctttgtgcaaacaacactttgcagcttattattgagacaagggtcaacgtacacattaattttgaaacagttgcaacaaaaaagagcccctatcacgcagctatctgcatacctgatacagctgtgggccattgtcatcgtacccggcaatcaataatgatactccaaatggtcttacaccactgcaacaaacaagttggccgtgagtcatgcctcagaaattcggttacatcatatattcatatctttaaggagtgaactgtacttcaggattcaccaatcaacataagaaccaactaccacatagcatgtaatgtgatttataacaagatgtatgtcttaattattcctctgatgtttttttttcttttttgtttcaatgatgtcaaagtgaattataaaatgcaaatgactggaaaatcctatgtgttacaggtatgaaactacccaacttgcttggttacattagcaatttaattctcaatggcccaatttcaataaaattttatccatccagtgaaaatccaagtggaagttcacacagcagatcatatatattcttcccagcaggtcaattaacaagcttctgcatcaacacacatcaatgtgatgtacatgttgaaagttttcggtactgaacatctgaattatcgaatacaatattgaatgaatggtactgttaagttatagtaaaaatatcccacaaatatatccatacaaattaattaggtcgaacaagtgcaagaatatattatttaacaatatcattgatagaaatggaaaactctgaagtagcatacccagactgtgtgaactcctgcataacagcagcagtttctcggacaagctgagtaacagggatagtttcctgcattagaaaaaggaagaacaatcatgagaaataagtaaatgatggaaaagatcatgactgtcgtacatgaaaaattgcatgctatccgaaatagcaatttattgaaaaatatatgtctttacaaaacatacaatagttatctgaagtataaatcaaatgaactgtaaaaaaccaccttgtacaaccgataatactgctgtgcttgtttccgactttttctcacaagaacacggaaatcgggacccatcccactgaaagaagtgcacaggtaagtaaacatgtattattgaattgcaactgatattaacagcagcaagctgagagatgtaacaaactaacaaataatttaaagacagaatgcagctgttctctcagaccactgtacaaggctgcagatggattgaagaactattttttatgctttagtccagtgaatagataaactataaataccttacaagctaatcaacaaaaatccagagatctgcatgctcattcaccaagttgcctcaaatgtctagatatggatttccaaagttactgcaatctgatgtgcatataactataagacacagtaaaataccaatgcacttatcctcttgcaaagtttggagagcaagatagatatttttaatttgtgcctttttagggaagattaatatgtgcaaatttctcagggcgaactgtgtcacttgttcactaaaaccaggcggttcaaaccaattatttatattaccattatattcttacacaatagctcatctgtgaactatgtactgctaaaattgtagaagcttacagcacagctagtgctcatataaaggatcaagaacataactaatagaataacaagttggaataactcacaatagcatgtacatgacaaccataatatatacaaaatagaaatgtattccaacaatgaagccaatgtaaaaggttacctgtagacaactccaatgttcggagtcaatgactgaatcttttgcacctgaatttgcatataactatgtattagtgcttctgagaaacaaacaacgaatagcatgtcgcaactcactaaaagaggaattcagcattaagagtgatgttagacttacagatgtttcatcgactaaaatagaaggcaatttcttctcagtggcgataactacaccattagcagctgcaaacataacaaatatacctcagaatcaataaactaggctaaaagggaactgaagagaatcaacagactgtagtctctgagcagtaactacacaaaaacatatgatagaacaatctggtaaaaacatatgcagtatgttctacaccacaaatttattacatacaacaattacatctatcagcgtgaagaacgcatgtcaaatagtttctttcaatttttcatacaccaaaacaaaattcatgggctaaaaccccaagactttaaattgcataaatactgacaagtggcaacaaaagctgattttaagggtatgtaaacctaccagtaaggtggacgttgacagggcaaacaaattagaattttgcactgatactaaaatgggcttccaaaccctaataggcactagatcagactgcacacacatacaactactaatgggaaaactaggtcagcatatacattcaacgccgtaaattggcatagaaaacttcatcatcacagatgaaaccaagcagcttgtatttcttatgtggttataaaggggagcacttgccattgctgttacaagacatacatttatgtagattaataatgattttccatggaatccacaagcatttgtaagcgaaaacgaagcaaacattacaaaattcccaagtatcactaaagcagaatagcagatgcaagtaacatggcacctattagtaacctaagccgtagcaaacttcacactccaggtctccagaacaaataaaagctctgcaacgacctaaagttatgcgaaaagtgcaaaatccccaacaagcgccacttcgtcatgtgaaccgaaccagccaaaatctcaaacctcccctccccttctcgattctcataacgcaatagaagtatagagaagggattgcttcacgggacgcacctttgatcccgagggacgtctggccggatccgaccgcggtgagcgcgtgctcgatctgcaccagcttccccgacgggctgcaaacgaaatcgccacaaaaaccacagatgacgaaaccgaaaccgcaccagatcacgcccgatctccgggcgagggaggcgcaaggcagcacatacctgaaggtggtgagggagaaggagtactggctgtctcccatggccgccgacgcgcaggcctacctgtgagctgctgctcttcgtgtctcgcggcggaagaggaggcgaccgagcgagcgattgcggcgagacggcgtgggaagggagagggaggcagagcacaactcgccaaggaagaagaggagagagagaaagagactggatggatggattgctccgcaagaaggtggtgggtcttgggccggaaatctggcccatctgttattgggtcagcccatgactcacccacctccccgtcacgtcgtcttcctcctcataacttcttccccacgggccaacggctgcgcgtcttcccgttcgtcctcctgtccggtccgagtccctctgacgacgcgactttccccacgccgggatcgagctccggggaggggagctgcgagctggtacgtacgcttgatttcttcccttgccaccgcgatattccgatgtatccgtgatgtgtcgttcatgggtagatcggctagggatttggcggcgttgaggaaagcgatggctgccgggtggggggaattgttgtattagactctcgaagctgatatctggtgtggatttgcggtggaagccatggtcggaggcccagtgccttccgggagttgttgggttatcgggagcccggagggcagtgcggctcgccgactgctgccatgatccccgtcggcaaaatctccagattgggggagatggggggtaggaaccatttggattagtagtgtatacacggggtttcgtttattatatttagagcgctctacatgtagacagcacacagcagctttaacgtatggatggtgtatcgcagggaatgtatctcgaagacattggattaggctattattacatttagagaaccagattgggtttgcgataactagaaattgagtctgttatgaatttattgatggagcggacagggaattacgattactatctgtttagcttttcagttgtgaatgatgattatttcaatttagctaatcaaggttcctcaatcaaaccgttctaactttttctatttatgctcttggttacattttgacagaaacactttgtcatatcagtcaacagtagagaggagaccagatgcaggtcagttctaattcatctttggttgcacatttcttgtatagttagttaggtatgtaatgtgatggccaactcttaatcaactaattattcgggttatgttttactggtctcactgagacgtccatgctaaggtggtaacatttaataggacaatccacatttggcagcaataactgtactcatcttttcctttagtaaacggtttggcgcctagtatagggctcgcgtgtttgcatggaagagttggcactcggtagttggagagctttgccgacggttaccaatgtgaccagtactggtttttgtacacccatactttcttgtcgtcatacactagcaaaagtttgtgtacatcccttacttttactaatggctcaattatataacttgatttacttcactacaataaaacttataaatgtttggaagatcatgtccaagagactttcagtattattgttaactggaatgagcttaactactactccctccgtttcacaatataagtcattctagcatttcccacatttatattgatgttaatgaatctaggcatatctatctatctagattcattaacattaatatgaatgtgggaaatgctagaatgacttacattgtgaaacggaggaagtatgtgaattgctcctttagtttggttcctaacatgctatctgaatgtcttcaaaatattttctatcgaaaggcatctagagctaggctctttaaggagtataaggaggtgcagcgagaaaagtcagctgatccagatatccagttaatctgcgatgattcaaacatattcaagtggactgctcttatcaaggtggtttttatattgcaacttgcaaggtgatgctagaaacagcaatataagtttttaactaatgccttttctgattgtatatgttgttagggcccttcggagacaccttttgaaggtggtgtatttcaacttgcattctctattcctgagcaataccctctccttcctccgcaagttcgcttcttgaccaaaattttccacccgaatgtgcatttcaaggttacttctgcattgccttctctgcgtacattttactttaggaaatttgacctatttgaaggcatttgtctctttcaagtgttggtgagaatgtaaatatgaagttgctgtcatcttcttcattttatcaggttttcctgtaacaatctgaatgtactaacatgacagaatttactgtgtagactcaactgtgctcttcctgttattgtttttgtcaagtcgcttctatattgttacatctgaattaacagaattgaaggagtaatttcagttatcattctttttaccttgtttgtgtttccagacaggtgagatttgcctggatatcttgaagaatgcgtggagcccagcatggacactacaatccgtttgtagagccataattgcattgatggcccatcctgaaccagacagtccacttaactgtgactcaggtagctccaccttcctactaattctgccacatatagttcagccattattttgtaatgtgaaagtaatagatgttcatgctctcactgaatcaagctatggtgcatgaagatttccatcttcgaggcctcaaccactccatgatgtgatctttttggagtagtttgagacatgaaaatatttggttctaattattgtcacatggtacattagccagttaaaaaatatggagaaaaacttggctatttactctaatggagcccctctatataaccaaaggaattacgtgataattgatatggtcagactccagtatcaccgttgtcctaggcgagggccaatgagtcccaggacgaggctgagtccacctcgggtggcgggtgtgcttgggatgctgattagattagttcgttacattgaaatagtatatctttccaattgttatctcttcccagttagagtccaacttgtaagggccattaaaaggtgtttgctacatcatcgcgagtttcaagttccttgtcctcattctttttatgcctcatagttccatgccgcctactctcctgggaagcctcatcatccacatgtcctaatcttccgcacacaacagaagaaactgatttatgtagttacaatatttaattttgaggcggtcagagaaaccattcctgctgatccattttacgcaatatggattgaataattgccttgtaaatatttcattgttggttattagcatttatactaatgagctaagatgtgcagtgtcacttatattgtatagttcctcattatgaattagaatgtaattttcccagtaaatttgtattggtcccattcaccgcctcacggtttatgtttgagattttttcagatggcactttggtcacattgcatccaaaatatgattatcataggtcaaaattatgaattactgtatttgataacttagggagctcttgtgtaatttcatcatctgatgatcatatacagtttgtcgcttcaagcattttgcaagtccgatttctgattgattatatagcggtttaaattactttttcatactttttacttggttgtttgaaaagaggcctgctgtgatattttaatccttatcttagtttctgctaattttcttccgtaaatataggcaacctcctgcgctcaggcgacatcagaggctatcaatccatggcaagaatgtatactaggttggctgccatgccaaagaaaggttaactccagggtgcaaaaggaaatatgcgccaagcgaaggcatggctgattcatgtgatttgctctgttaagtgtaactcttactgtcaccatgtgaacatctggtacttattttcttacctcactcttatggatgtatgccctggagtgaagagaagaaaaacatgcattgtaatgcttggtctatatgatgtcataaatataactgggttcggtacttctaatgcactgtccattgttcaattacttctcctctttttcctgtccggataaaagaagaatacttgtcctgtatgtttctgaaatcgccatacggctcctataaaacgccaggttagagccgcactactctaatcttctatgatgctgtcacgccgagaattcctttcatatttgctggtgttcagtttaattaacgccgcacacatacagatcacccgttgttgtattgcgagcatcgaaatcaatcaacactatatatgattttattgttatcgattgttccaatcgaatttccactgtgttacatgacttggagtcttggaccaaagaaaagaaaatttcctgatcagttggtatcgctggaaaacaacctagtgggcgcacgacgcccgttcctcgccatcgttgaagaaggcagactgcatgcgagcgactaggggaacgccgtcggaggcatcttcttgtcagccaagaagtggctgaagaggctgagcgcctgcctcggcgcgtgcaggggaacctcgtgcccggcgccgcggatcgtcacgaacgtcaggccctcgtagaggatcgtccatcctccaacctgcataaatggttcagtttgatgctcacaacgacctgtttctgaatatttctttgttgtaggatggtttaattacctgctgatggtcgtaccacggcgtccactcctgcaccgtcttcagcccaagcttgttcagggtgagcctcgtcgacgtcacggggatccttccatcggtgtcaccgctgcacccagtgaaactcattgtcagctcaattcaaacgccatgcatctattgctgtgtacacgttgttcagacatgctgaagtatactacaaggatgtttttttcacctgaaaacccagaccctgatgccgccggcgacgagcttacggatgatggggagagtcgagaagggagcatctctccacttgccgatcacgtcgctgcaacaaacacaccgtcacaaaacgattctgtcaactcaaagcttcaaagactcaaaagagaacagaggttgcaaacgcttattgtttgcacctgcagtgcgtccagttgtagccgatattggtcacgttggcgtgcagcgcctcctgcacgtcagcccggttgaagtacacctcggcgtgatccgacgtgcacggatcgtaccccgccggcctcatgtaccacccatgctgttacaaaatgacaccaaaaaaaaatcatgttgtttcttctctctgaaaaaatgtgatcgttctgtgtgccgatgagttgcctacgcacgtatttggagaagatttttggggcggcgccgtggacggcgacctggcgctggccgaacgccgccgacgacgagacctcggtgcagacgggggtgtagaggctgtacatgtcgatgaggcggtacacggcgaagtactcggtgagcgcgctgtcgcacgcgtcggtcacgttctccatgctgaagttgcagtacttcttgacgtcggcgtacacccggtccgagatgacggcgtggtcccaggcgtagtcgatcatgcccgtctggtccgtctcgtcgtccatcagggcattccctatctgcgtcagagtaatgagacgacgtgatcgaagaaataaaattgtatgagatcagtattagttcgaggcagaattgtgtagctaccatgaaacccttgaagttgatgtagttctccttggggccttgcttgttgccgtcgaaaatcttctccgaaagctgtggaacgtaatgccctgacaataacgcaatccgggaataatgagctcgcatcacgattttttcagaagctagatgctgaagtgtgtatgtgtatcagttcagttaccagcgtagctctctccagcgatgtagaagtcgtgagatttgtactgagggaagcgcttgaaccagttgagcaggaagatgtaagcatcatcagctgcgtgcatggcaatccgagttcagatactgtttggatcatccaaaattgaccccttttttttatcagagtattctgttgttgatgtagaggttaatttaccggtgatcttgtcgccaagctgctgcagatcggagcttgtgttagtgtatgagaagccgacacccacaggggactccaggaacatcagattggcctctgcagatttttaacagtgaacattcagttgtgccaaaaaaaaaaactctgaacccctgttcattgcgaggagtcagtgacagactaacagaatgcagggtttggcatgaacaagcagtacgtgcctttgttccacgagtacttgttccattttagctccggcttgcccttctgcaccaagaatggaccgagctcctccgcttctccatacccaacagacgaacacccaggccctgcagcaaaaacagcaacatttgtcatcctaactcaaacactcagtacacactcctgacgaagaattacacacagggtttttaagctactagctcataatcacgaacgaaaagagagaaaaaaaaaagaaacttcacatgcatggtgaacgtcgaccgttaaaacgttgcagagaccagtagatcagtcgtgtccatcccgcgcgagagacaacgacgcgatcacgagcacgagtacgacacggcacgggtcgccatccagtcataggccacaccacagcggaagcagcagcagccagctagcttagctaatggaccgaattattcgcgcatttctaacgagaaaccgagcttagacacagctcactttcgcgctcccgatccctttccggcgtcctgcctgcctgcacgtgaacgtgatccatctcattcgaccagttcacggcgtgcatgggtgactccgcgcgcggcacagtacgcagccacgcgcgcgcccggtgagatccagcaccgggccaccggcacaggcgcgcacagccgtggcccccgtgggcgctcgcgtaccgtcgtttcagatattttccccggccggcaaggcaggcagggaaggcaggcagcggcagtagtagcttcgatccgttccgtggtggggcgcgcccgcgggttgggctcgatcgggcacgcgaggtggtggccgtgtcacgacgcgcggccggtggtggcgcatgcttttgcttagctggtccccgcccgtgtagcatgcagcagtggccagcggtgtgtagtagcgtacgcctccgcctcagcgcgccactgctcgctatagaagtagcgatgattggtggccggtggcccggtgtgcgcgtccgtcctcctcggtcgcgcgtgaaagcggcgccataccgaccgacccgctttgtttcttgtctccatgtacatgatactacgtggaccgttggtgatacggtgcgtgcgtgcgtgcgtgcggccgtgcgctagcgagcacccccgtgcagtcgtgctccgtatgcctttccgggtcgatgggtacgtacgcgtagtgcggttccaacttccatataggcagaaacagaaggcgacgacgagtgaacttttctacccttttactcttttagtctctggaagcttgctctgagctatatatgtgggtaaaagggaatcggcggcaccaacagctgacggttgttcgtttttcacgtgtacgtttccaaactatatgtacatttttaaaaatattttctgtagaaaagttatttaaaaaaattacgttaattcatttgttaagtttgttttaactaatccttaattattatacgctaatggatcgtttcatattacgtgcgaagagatggaggttgccccaaccttcacctctaaacacagccaacctctttgttgacctttagaattttaagaagtaattggtaaaaaaatttagctggtgagaatctagaaaagctataaattctatctatttattttctaaattatataactacatatttttaaaacctagataaaaattagactatttatgaaaagttttagttttgaaagaaaccgtagctaccataaattcctaaaacaagacctaaacaagcttgttttggtctcctctaaaaatattaaataataggttaatactgcacacaacagggccaagtttcctttaaaaaaaagaacaacaacaacaagaagaagagagcgcaagaacagtaagtgtctctcctaaccactaatcggactttgtcggatggtgtgtaattgttctttcctaacaaatcccaactaacaaccataactacatagaattttcaacgttactaggttctgactgacatatcacagatgcttcgacgccttctgattgagtgcaaccaaaaaactcaactgatgcaagcaagcaaaatgatataagcccccagaccacctctgccactttgcttcagatgctggcaaaaaccgcgcggcttaattcagatcccgatgaggatgtgaattgtgccggaagatcagcttatcgccgggaaacggacacccgcgaggccccattggctgcgtggatctccctttgttcccggagcaagctagctgctagcctggctcgtgttgaccatgccaagcaggattggctatccctctggttgctaccagcaaccagtccaaatgcagaaatccagcagcatttcgttctctagctgctgctgcagctagctcgcatggatcgcgcccatccttctcgatcgaacgggggtattcatgcagtccatatcgtggggggtccccgggcggcttgtcttggaccagctgctaggagagtacgatatgctcttggctggacagcaaatccgtctggctagcgagctagctcatcgatcaagcggatggattcaccggtacgttcgtgaggatgagcaggccacagtgacagtggtggacctcgtcagacttgttctgtgctaacttgaacgtgtatttggctaatttttcaaattggaggtgaatggggctcggtctgtagtataattgaactgggacaaacactgaactcaattcaaaacttaatcctgccttctctatctagtagattaacttatctcatatagcaaaaaactgaggcaccacaaattatactctggaccgtgcaaactttctcctaaagagaacaaactagctagttactttccaacccttcaattttccaactcttcgtctccggcgctttcgactgggacggcgcctcagagcagctacatatgtatgtgtcctctagttgtgttttgttactctcgttctgatttttttctaaagagaaacacggagatgagatgttgacatatgcaacgaataattacaatatgcgctgttggatgagattcattcggatagagtgaacattggagggtttcaggctgagtttgagaaagaggagatagagaagattgggaagatacgtaaaacgaggtgagctattagtgcatgattaattgagtattaattatttcaatttcaaaaatggactaatataattttttaaagcaactttcctatagaaaatttttataaaaaatacaccgtttaatagtttaagaagcgtgacgcggaaaaaaatgtgcattctatctccaatctcccagaacgaacgctgcctcaatcacaggtttttggaagccgttcaggggaacgcccggttttggcctcctaaactagttttagcatctgaaccgttatggtgcagacaatgattttcttttcagattttctgatagtaattttatttttgaagagttttagacaataaattttttgagacaatttacatttttttaaaaaaaggataaaaaagatgaattacatcaccagcctctgcaactaagatacacagccaattgaaggcgacgagttgtagactaactaactaatatttctttttgttacgtaggcttcaatttgcacaggaatattctggccagtttttgtgagcaatagccaattctgaatccggtgatcactgacaatggcgtacctggctcaaagctacggccggagctgggttacgcgtgtggctgaatattgtttggcaatgttatgcaagttggtcaaataaatgtgataagtcgactgtacattagccattgaaagagactctacgcaattaaggtgtactcttttcgttctaaaatataagagattttgggtgaataagatatattctagtattacgaatctgaataggctctctgtccatattcataatattatcatgtgtctcatccaaccaaaatcttttatatattttaagatggagggagtaggagtatgtgactaaagtaggtacttcacttgagttagttataatagcatacagactattactccatgaaactgccaatagtgaattatgctagctggaggacaaccatttgatgggatagcagatggctcctcttttcgcttgaaatgctgattaattgattggttagttgggcatggtgattgtactatgatagacacttgaaacatgcattcacttacgacatgtcacaattcacacatactgatattgtcatctctacccgagcctcttaatcactacgatatcatcaatgtatatatacttcaaaacattaaagaagaaatgtctagtttgagttttagaggtaacgagaagatcacatcttaggattagtcgattagatcattcccagcaacatttttatagaaaacccagtatcatttttgtgctccagaaaacctttaacacccagcgattttaagttcttagggtaattttatcatccttaaaaagatactagacgtactactctttttagtataaaatttgctgtaaaatcttcgtacctccagatactttctcaagaagtaaaaaaattctctcttacgtaaggtaaaaaggtatcatactttttaatattaaagatacctggcacacaaaatttcgcactaaaaataattttagaacatttcggaacttcgaattttccttaaaacactccgttagaaaaaagtgagatcgccattctatcttcattcgtaattaacatcaatataaatataagaaatgttagaatgacttaaattgtgaaacagagggagtgattaataccgagttaatgcgcacacaaattttgtggagcaaaggcaaatggcagttggtggtagaagtggttaattgtgtgtcgagtgctagtattacgtaccgccgttgagccagaggacgaggggcttcttgtcggcggcggcggtggcctcgaagaaccagtagaagagcgcgcggccgtgcgtctcgttcaccgtcacgtacccggcgtactgcgcgaaccgcacggcgggttgccccggcagcctcgtcacgcggtcggcctcctgctgccgcgcggcctccgcgtccagctgaggcgagccgccagcggccgcggcgcagagcgagagcaacgcgagcgcgaggaaggaggaggagacggcggcagcggtagcgccggccattgttgtgtgtggcgcgctgtatagctggtgcctaccgtaccgcgcgctagctgctgccggtgcatcgtcctcggcggattatatatagagagagcaggagcagtgagcacagtttgataatgacaaaatttactaaatacattgtttactatcgacaaaatttgatcaaataacctctttgtgatcgcattgacgacataggaaaaatcctcaattctaacggaggtatatgaccaaatatttaatatactgtaattggaataatattgcaaccgtatcctgcttacggctactccagtagagtttacatagccgaggtgataagtggagcgcttctaaattataaatgaccattcctcaatcctaggatatatgatactccattcgtcccatcttaaatataactattgttttctgcgtctaattttaattgtttatcttattttttttaaaaaaaaattaaaacataagttacgagtaaaatactattgatttttatcatctcataaaaaatactgattataatattttttaaataagacggacgatcaagttgaacacggaaactcatatttacatttaaaatagaacggagggagtagtacaggatgtttgtctgacacaccaacagaatttgggagaaaacgagaaagcaaatctaaaaattaaggcctgggtatgcatgtacgacacatatacacgtaaatggtgccgtatctaaaaatactaatcgaatgaaattgctcccaatcagaaaaaaatacaaaagttggtttattgaggacaacggatcgaaatacatactatgtgtttggtttatttaaactttagtctaatactcaaattaaaaatatcccaatgcttggacttcctgaaactcaattcaaaattgtgtttggtttgaccgagcaggaattttagaagatttttagttgctataattaaaaatacccctatgtttggttttatgtactcttgtgctcactctggttataaatatttagtgtttataacaaagttcgctcatacctttaaaattccgaacaccaataatttctcacatgcttaaatttaaaaactaaataaatggtttaaggttgttattgaatgttcatactaaatatttgttggtgctatctatactacttataaaataacaagttttatacttgattttcatacattttaattctttttttgcgaggtcatattttatttatgtcacactggagtgtcttttttttgctttgattgtcactagttaaagccctttaatgagtacatatcattatttgctttgattgtcaaatactctgtttcatgttgttattgtactctacgtatgatgctcgctgcagttaatcacatactaaattcgttgctgatacgctttttttttctccagagagaatcacatgcagtgctttttcagtaatttgagatatcacagcattttttttatctcgtactgcaaagcaactattgagtggcaagcaaaaattgttcataacttgttttgagggcagtacatattcgaagctgtcatgcagatatcttccgtgcttgtttactaacttcaggagatcataaaagcagtctctgaacttgacgttttgtgggtggatttagcgtgtgcagctaacgagtaagaactgagatcagtgttttttttttctgtgtacaacatgccaaaacattgcatggatgacggaaagaacagtattattttgagattcgaagttctggatgaactttgcgccggcctgacagagctttgccggacaactttggtcttggcttcgtcgttcaaaaaaaaactttggtcttggcttcgctttttgtttcaacttaaattttaagctaaattacagtaagaaggtgtgcgtgtgcgcagtatgctactacatcgttttgtccgtttggaaattacagagaatgcacttccaagctccaggaatcgattcggcatttcggccggcacatgtctttcctgaatgtttttgttttgccaaaactttttttttacagaaaattcgctccctgcaatttaggcaatttggtaaatcttgtactaagacaagcaagtcaggatgcttaattttagagttaattttgatgtttaatttactttttttattggtttttaataagtcgctaaaaacatatatatatatatatatatatatatatatatatatatatatatatatatatatatatatatatatatatatatatatatatatatatatataagttacattgataagtcatttttttccattaataagtgtgacggctgatagaaaacgatggagctgttaactgtcaaacttgtattgggaagagtagggccgcatataaaaaaaaattcctaagttatcaccagaaagatgggctatcaagattcaagcaggaagcaaattctgatttggtcaacagaatgtgtttttattctatgtgattagattgaatacatctctctctctcgtattccgtgcaaaggatgatgatattattttttttaaaaaagagagaagtactataattctagatttcttaagatactgcaaataaatatttcttcacaatgtttgtacttcaaaaaaaaaaaaactccacgatgataacctaagaattgcacatatagcgacatcatcactgaaaatgtagcagtttcagttgtgacttgtgggcacaaaccaaaccattcttaaacttaataatgaagcaaaatgtgatttggcctgaatatgtttgttctagatggttaaattcaatactatatctcaaaatgtaggcggtacaagtctactttttatatttgacaattaatacacgtggaaaacatgtaatttggttacatagaaatagtattggccatcattttttttcttgagtaatacttatataccttaatatgctattataaattgtacttctaaaacttcgacaaaaatctaaaacatcctattatttgtaacaggtgaagttcagcaattaaaaacatcccttatgctcgaagcatcaggattctttagtatgttttaaagaaaagttcaagtaagaaattagatattcaaggaagagaaggcacgttaaactaacaagtcaacagctcatctcatatgccggaccatttaggcctggtttaattcccaattttttttccaaaaacgttacattaaatctttgaacacatgcatgtagcattaaatatagatataaacaaaaactaattgcatagtttgtatggaaatcgtgagacgaatcttttaagtctaattagttcatcattagctataagtgctatagtaacccatatgtgctaatgatggtttaattaggctcaaaagattcgtctcgcggtttccaggcgagttatgaaattagttttttcattcgtgtcaaaaaccccttccaacatccggtcaaacatccgatgtgacatctaaaaatttttttttcgcgaattaaacaaggcctgaatcaatcatgatcgtcatcccctcaagaaatctcattagttgttgtcagtatattgcaatatcaagctttgatcaggtggagacaaactccgaccgaaactaatccccaaacactagctttagtacaataatgtgtctcgttgtgctgttgctaacctattttatgtcaacacgttgcgacaaactgacagcaagcttgcttgttctctcaataatttggttttttgttccattcccaaatgagttggcaacttaattaactcgcaggaggatagatacttcctgtaatgataaacttgatttgatgctcttcatcaattgaatattcagctccaacagaaaatgaatattcactattcagcatgttgccaccaatctgaacaagtgatgctcgatgtgaaagcgaaggcacaattgcaaccccaaaataccggggaacaacacaagatttaatcctggagatcataaaatacattggccagctaacttggtggatagtcttcctccgagcaaaatcaaaatcttaaggcttcccggagtaaccatttgaccaaagtacatttcttatcatcttagcaaagaacagtgtgttctttcagaatcgattgagatagcaccagtcaccaggcaagcatattccaaggagatgagcagaaacacgtccatctgcagacagcaatacagcatggttcaatggagtgcatagtcagcagtcaacttgcatacatgacattcagtgaagcgggaatttcacggaagaacgggtaatgcggcaaagaaggcacaattagataaactttggccatgcactatagcatgagttcagttcaggacagatgagcaccacaatactggatacccatcatgatattgagcaacttgaagcagccctaccagcactactactactactactactctatatgacgatcatctcaaaggaaatcactagataagaaataaaagctgtatttgctcatctttcatgtttcagatgtatggatggctatagcaccactgcaccaatgaactaatatttgcttggcaaatgatcaagaaaatcaaactatcaaactactattggactctatgccatgatattctaatcttgaaatgccaaaactagctggcgaacattctaggacaactctagtacttgacagtcagattaaaaggtaaatcaattcaataaggaaataagttttgtacttgttacatataagaaaacaacgaaaggcaggcagcaaaaatgtcaggattcccttttctatgcacaaccatatgatagtacttatttagcaaccgtaatgatatatccataaccattgatgaattatttccccgtaagaatattgggattaagaacacatagttcccaggactaatgaccatgtaactggtagtttggtactcatattttttatgcattacaaaagccttgtgagaagagtatagaacaggcactctaccaaaatggtaattaagatcaaggactccagatgagcataataaaattgccatctcacttcagaagctaaatcactcccagttgcaatttgccgatcgacaccgggacaaaaataattgttagaaagcaatgcaggaagaattgttacaggctcacagctaagatgtgcaaaactagctccatcgtctcttatcctcttcttcatcaactgggatataccactctggtcgcttcttcgagttgctgtaccggtagttcaggaagagctcttcatcacatatggaccttgtactcaccagcactagagtcttcagaactggagactccccttcctgattaccagaacgtccagacttgaaccagaatgaaccaaatcgtttcattgtaacgggctcttcttcaccaccaaaagtaatgttagggatgtagactctcatgtccttctctgtcaatggaaaatcatatgggcagatcatgacattgggagttgacccttttggtggatggtttgcaaagtgaccaaaagcgagtgggtttcgtcgttcaagcacttccccaaaattttcagtgtgacccttcttcagaggcttgctgagcatcctccatgccctatcagagttgctctcttggcttttggatggcactgcattgtaatccaccaaatctgagccatcccatatttctctgctatcaccacctaattgccatggtttggcatcaattattgttccatcataccttgtgatcagatagttgttgcacgcgtcgatttttgggtatccagggatatatcgataataagcaggtgaatatacaactccagggtagatggctaggacagcaccagcattagtttctccagataagaacagaccttgccctgcatctttgtgagggatttgtgacggcctgatgtcaagggtgtattgaaagtgatccctaaatttatttgacaattcagcgcgatttaaaggcctagtagaagggacatctgcactgcagagtaaatggatcagaact

SEQ ID NO: 75162 - DNA, 3436 bp, Oryza sativa
  unsure (1)..(3436): unsure at all n locations
aatttttcaccaacgtcagctgatgcacggtgtaattttggctcagctttgggtcccctagctgttgaccacgactcttacgacaggtaagtgtggtgtgtggataaaggtgggcccaagcccatggcgacgggcccaccacccagcggaggctgagagggacaccgtgggtctcggaaaaaaccgtaacggcgtctctctccgttacaacggacaatccttcgcaaacactgtacgtttttttcgtatccaggtccacctcagcccctatccttttgcaaacaaaaagagaaaaaaaaaggtgacctgattgttttatttgctttgcaccctgtcaatacttctttgttagataaacacccctgggaatatttttccttaggcaaatcttatctgcaaggaattgagtgcaaggaaagccttagaaatgacatagcaactcatgtttttcctatgtgatggattgagtaagtcaataatgtgatattttttattatgtggaaggcgtggccatgcataaataattattcatgtacactgtattcacgagtacatcgctgacactagatacactcaaagaatgtattcacgaattcatacactcaaagaatgggaggctaacaatagatccgtgacatcaataaaattgagggctgctagcccacgggataccgttgcaacggaatatttacgaaatattntaagtgactctcctttntccttccctctgtctacgtgtgctcccctagtacctggtaccttacgtaccggttggtacttgatacctgctatcttaggtaccggttggtacctagtacctggtaccttagataccaactagatatcgaccgatacctgatgcccagtacccaagataccgggtggtacctaggtatcagaccttggtaccaaggtatcaagcctgatacttgtggggtatcagagggtaccgtcaaaaagaggaggagacgtgggggagggagcgccgcaacggcggaggatggcgtcgaggaggcatggcgaggtgagggacgtgtgttcccctagtacctggtaccttagatatcggttggtacctggtacctggtaccgactaggtatcaaccgatacctgatgcctggtacctaaggtactgggtggtacctaggtatcaaaccttggtaccaaggtatcaagcctgatacttgtggggtatcaaagggtactgtcaaaaagaggaggagacgtgggggagggagggccgcaacggcggaggatggcgtcgaggaggcacggcgaggtgaggggtgaggcccaagccagagagcgcgagaagtctcgaggaggagccgaggaggaggttgacggccatacctgttgcaggtcgacgcgggctgtcagcgtccatcccgaaggcgcaaaagcgccagcccgcagcggggaccacagtgacgccaggccgagggccgaggacgaggggagctcccgcttcttccctccccggggcgatgactccccggcgcacacccgacccgacgagggcggcgagccagagcggcgcagcgaggggaggcgagctcgagggcgaccccgccgagggttggccgaccttgccgacgcagtgccgtcgtcgtcctcctcagccgccggagacgacgacgacgaccccttcctcccggccggcttcgtctccgctcggtcttcttcagagagagagaggggggggggagagggagagggagggctgcagtgctgtgtgatttgggggaggagagtgaggtaggaggagaggattcggatgattttggggagaggagtgaggtaggaggaggggatcccgtctccacgggatgtcgtggtgtaggttttctgataaatttttattgaaagtagcacatgagcaaaagctcgcgagctttaccgagccgagctcgagcttctactgagcttaaccgagcttggctgtgtatagtttatattgcatgctcaccttattgatataataaactaatagataaatatatatattagtatctatttacacaataaattagcatgtgttagcacaatatatttattttagtcattttctactcttttattactgcgattaactagaaaataattatacttatcaagagattatcattaaaatatatattatgctacttatggccgagctcaagctcgaacgagctcgaatcgagcttgcctaaaagctcgaaggtgcaataggctcggcttgagctcggctcgagcttgtgtcgagttcgagcttaggcaaacgagctcgctcgagctcggttcattgacagccctagcggggagttaaactatgtatatttcttgattttttccactacatattcacatgaaataaaatgtagagaagtcaaatctttcttggtcgtggtgaaaaaacttatgtgatgatcaatgcggaatggagggagtaataagtaacatattgaagtcttgaagcctcttttctttttgacggtttgcaaaattgttttttttttatcagaatgatttacgcggtattatgtctcatttggattgcaatcatgcttatagtgtatagtttggaacattttattacccttgactttgcacctatgcatgcatatcctctcaattcctccgaatcttaaaaagatactttattgtttatcattaattttgttgaaataataattccaaatagtaatatatactccctttgatctcgaataattgatacttgcactattcaaatttaaattttatcaatttgtattttcattaataaattacaaatatggacacgactacagggagcgcaagcacttgttagtgctaaccagcgaccatccttttttacccaaaaatagtacagtgtgtatcaactcattacccctcttactaaaagtagtagcacctgccacatgcatcctcatttaaatacttatatgatctaagatccgattactcagttgtgttcgttgcagttaaatttatacaacaagatcttatatgattatattatgatgaaaaaatatttatgtttgtaaaatacttttattatatactaagttacttttatcatatatataaattacttttagatttagatttgattaaattacttcctatacattcataatgctatgaggtggttacttttattattgtttttagtcaattccataatttgtgctgattaatttagtctctagatagagttatgtttttatccttacaacagatttacttctaatgttatgacaaagttactttccttttgtcttaagttacttctattataatatatgtaaattacttttagactttattaaatttacttttatatgtccaagaagtactttagtgaaatctaaaaataatttagatatattataaaagtaatttgtaatttttcatcataatataatcatgtgagatcttattataaag

SEQ ID NO: 75163 - DNA, 2462 bp, Oryza sativa
tgagccattgaattagtcagcttagatttatttaatcaataagttcttacataaatggagagacatataattggcgacaatttgttaaaaatatattgagaaaatttgttcaaaaaaatcgaatggttggtggcttcaagttgagtatagcttctaaatatctagtgaataaagttaggaaaagtgcaaatgaaatagttgaaaaggactgtgtgaccgaacatgggtgtctgaaatgtttcttcatcattcgtgaactcctatttttgaatatgataagcttgtccagatagcttttttgtcttttgttcatgtgtgcctcatctggatggtcatatagctattagttttgaaatggctgtgtggcaactgtccattgggatattctagattttagcagtaatgcttattggatttaaatctgaagtagtcaattcatgctgctaatactattctgatatatccacttgctaaatatacgtgacatttaaagatgatttgttgctttgtgcagatatgctattgctatactgatgaatccatgatgcaaccttctctcagttggagtgacctgctctgagtggcgtgttgatggattgatttgtgatgaacaccagtccaaactgtggcaccatcttgcttgtcaaaccttcttatacaagttaaaattcccattcttgttctccggtgctttacttgatcacagaaatggcatatcaaaaggaactggtgctggtcagctccatctgtaactctatttctcctagcaagcagcgatgttcatacttcaaccaggctgactctactaactaaaagctcacaaatataccggaagaaccttgcagtaacaagcctttgctgtactctggtcattggttaactattgtgtctcattagtttgctttgtggatatatgtcagcggtttgacagatctcctgatgctctgtggtggttggcagtctccagctacatggccactttattggccatcagttatatattaattgttgttaaattgctgcgttagttgcttggttgcaacaacattgtagtagatttgtaccatatgattgatgattcatttggtactgggtgaccctgtagattatcccggcccttctgaattgcaaatcataccttttctgtaaactgtaaaaagcaaacagtgacagttgtgaagaacagttatcctcgcactttcggctgtgcatttgttttgcctggatgcgacctggtacaggcatcctgatcctgccaagttgtgtggacttcttgtggatgttggcaagctgggtaaacgctttctgtgtgctttgtgataggtgggttcatggttgcacctgacatgtgtgtccatcttatccatttgcttgcttaggagtgaggttttctccactctctctttattttatttgataaattcctgcaacatgttattctccaagtacaagtggaaatatattatttggaaataagcaggcattgtaagcatagctagttctctattattttagttatattgacggtcgaaatttgtcggtaacgaccgtcaacatccacccaaatcccttataatatggacagagggattacttaacaatggcaaacaaacaaaaatagttgaaaaagtgattagaaattctttagaaatgacttgcatttaagaaagagttgagaatttcaactacttgcatttgaaattggatgagtaatataacataaatttaagaaataacattgacaagtgcccaaatttcaagaaatatcattgtgtctgggttacggataaaacataccttatatcctacgacttatggaatacatcgataaggtataccttcacgcacacggatcatttccatattcaccatttggaattctttctaaattacagaaaatatctctatgagtcgaacgatttccaaagtcctactcggaagggatagagtttttgttataccgtaccagatcaaatatctccaagccttacttaggagtcaagatgatccacggtataaaagggacccctagggaggggtgcagggcatcgaatttcaccgcctacacacccaccatagttcacgaagccggagtacgtggagccaagtcgttgggagatctcgtcgaattcatcgactacgatctcgtcgatatcgtttgtttcgtttacttcctttgtaatctgtgattccccatcatcaatctcatatgaactagactaggactattacctgacaaggggcctgaaccagtataatcctcgtcttttgtctgcttgatgtcgtgctatgtagaccctcgttctaacgtaccccagtactcaactcatctggtccacgagtatcactcgtcgacacattgtatgcctttgacaagcgctcaattccaaaaaatacaattgacaagtaagagtttcatgaaatgccatcgtacatgccactttgttccaaaaatgccatta

SEQ ID NO: 75164 - DNA, 6912 bp, Oryza sativa
ttatggaacttgcactcgtcgatgacatttcttggattttctcctaatagaaaatatgtgatattatgatatttttttcttttaacactgaatttgctcctaccttgataatagagtgaatctactcagtatcacagagttcgtcacaattcaacaatatgaatctgactttgtcgacatccataatataccatcgcctttcccttaacctctaaatttaccatcatgaccacagaccgttaatttgcattgaagacctagagtgattgattttgcccctctagttgacagaattgagagaaggctcacctccagctctatgttcctgccctatggagggagactaacccttgtaaactctgtgttatttgctatccttacatattacatgtgctcccttcaactaccagtcactgtaattgaagcaattgacaaggctatgaaaaactgcttatggagagggaatgatcctagctcgaaaagaaagtccttagcgggctagcataaagtctgtagaccgaaggaaaaaggaggcatgggtgtcattaatctagccttgcagaacatcgctctccttctcaagcatttggcaaaattttatcaaggggctgatctcccttgggtaaagttaatctggaattcatattatcagaccaaggttcctcacagagtttttaacaagggttctttttggtggagggacattatcaatctttcagattacttcagaggaattgcaaagtgtgaggttatctcaggtaacacagttttgttttgggatgacatgtggaatgaccaaattaggagcatcacttacccacatctctgtggccatgcaattgtcagaaatgaatctttggctgtcacctgtgctaaaccttttgaggactgctttaagttgccactaacccaggaagcttacacagaatttctgcagctaaagggagagctggatgctctgtccttagcaagtcagcaaggggataattggagctttatatgggtcaggaacaattacacctccaaagctttgtacaagttgaattttgcagccatgcaaccccccatacctttccgatggatctggaagaccaaatgtgtgatgaagataaaagttttcatatggcttcttttctctgataggctgaacacgggagacatgttggacaggagaaaatgcgcccccctaaatgctgatcttacttgtgtcttatgccctatgcatcatagagaaactttgtctcacctattctttcaatgcccttttagcagaaaatgttggcagaagctaggaataacttggaacacttctctagaattctttcagatgctggtgctagcaagattgagatttcagagaaaaggattcttggagatttgtttcattgcatgttggcacatttggaagcaaaggaatggaaagattttccagaatatagatccttcttttgacagctggtggaattgttttaagcatgagattcttctacatatgtgtagaatgaatgatgatcttagacaattggtttctgattggttacaaactttatagtttccatagggggctgtagccttttgtaatttttctttttccttgtaaatacctttttggcttctataaaatacactactgggccaatgcctggtagtacttctttcaaaaaaaaaaattgcattgaagaaaggacaaatatgcccttaggatatgtgaagaccagtagcactgagaccatgccatgtagggcactaagagcaataacaattgagagagaatgtacaatatgactacacatgtgaaaaatatctttatttatacaccatgattaagaataataatgagcacatattttaggtatgaataatgtacaacacgtgtgcaatataaaatgtgtacaactaaatcatatgagatctcacatcatattagcaagattataggacaaaatagagtatcagtgaggggtttgcaacaaaaatcatccatgaaaggtgcatagcacaatttgacaaaaaggtgcataaaatccaatgtccaagtttggcataaccaagttcgatcttacaagagctaaataaataagttaagtggcacagatgttacaagcacatatcccaagatagaaaccacaacatgtaacatcaatctattaatttcctcttgcttctacttgacatggatgggttagttgatggcaatttcttcttgcttctagttgacatagatgggctatctggtagtactgttatggggttagtattctttttccccttggcctttgcttttggtggtggtgtgctcgcttctgttacacaaagaagggcacattggctttgtgttttatttgggccacttgaattacaaggaaagaagttcatgcatatattagaataggcacaacacaatcacaagaaggaatatggataaaaaacatttgaagtacgtatacctcactgatgtagcatttgcatttgcagaagtaattaaattacaactagaactatctggtgcatctgtcctcttctttttgctgcaccaaaatgaaaaactagttatcagatttaggaaattgaagtgcaaaggagtaccatgtgatcagatttaagttatagtagttaccttggtgggccaaccaaagttggagttggagttgaagtgccaatgagtaatgtattaacagcacatgtacttgaatttgatggtgttgttttcttcctcttttgcctagatcgatttatttggcaacaattataacaaaagtctcttatagcaatgtaatgaatgcgaaaaatcaaatagaggaagaaaaataccttgtttttgctaaaagagcatatgcttccttagcatctagatcagctccttacatgcctgccatttgtgaccaaagttgtggcaaatagggcatttttggctacctggcctacctttactagtgtctttcccttcagctccactcttacaccttctattcctatgtctccctgcactcctctttaaaattggtggataaagaaagaagccatgtgtactctctggctgttgtggcatgttagtaagaccaggaatacatggagcatatgcagttacaaacttggctacactatagcattcatctacaaacaagtctatatgcaaacccctcactgatgtcaaggccggctctacattttttagggccctaggccaactccatgacatgggcccttaggcatacacacacacactctctctctatatatatacacatatgcactttggatttttaaaagtatacttttaaagcattcatccgctaatcatgctgaaaataaatattgataatatcctctatatatgttgctaaaaataccaaaagagcagtaaaatggaattactatggttaccttgaattcttgactaaggatcaagcttcagggacttcattaataatacttgataaaacaaaagatgacagacatccatttgcttctcataaaaaaaatactcctttaggcatttcttgatgcaaaatcattaatgcggtatcgagatcaatattatccaagacattcttctcaatgcagcacataaccaagccatttaatctttcttgtattattacatttaaacattgtcatcaaatctttatcaaaagaaattgtgcgaaacagattcaaagcactatcaaggtaccgcattattacagtttcatctatgccccatgtatacttttcacaaatgtcaccaacaaagtcattaaaattagttgtgttagaatcaattggccagtcaaacacccatgcacagccaaatctattgcccgcgcgaataattctcactatgaaaataaaagtggaatatggatccatcttgtggatccacacattgtaaacaaacataacaaccaactggaaatgcacaaacaaacaagcttaggagaggagaaattactcatcttggatgtcaatggagggtgcaacaacggcaattggcacgacctcctttgaggctacaacatggagtagagcatgatttggtgactgttgagaagcatccgtaggttgcactaggaacaacagcagctctctagcaagggagtcgtgcccccttggttgcgacgatggcgttgacgatgacgacagcatcaactctcttgcaggggagccatgtccccttggttgcgacggcagcgctgatgacaacggcaacatcagcagcagctctccagaaggggcgtcatctcccatcggttgtgacaacgactctttaacaggggtgtcgtctcccatcggttgcgacgacgttgaggatggtggtcaggccgccgctggggacgatggttgggtgatgaggacacaactaactcagatatgaccatgactaccttatgtgttaatcaaccaaatgtgtaaatgttctatattagatttatagcaaaaatgcccgtgcgttgcaacgggtaaaaataatttacctattccaattatagtgacttctactgttagattgatacatcatagcaggctcaaattataatggtatagattgactgaatatggtgcttctgcgtgagtaagcgatgcggatgagaaaaaaggtgtcctaagcgcacccagctacgttctcgtgcacacacgacactttatcgagtcggactcgaacggccacattatcatgcacacacgacacgtcgctttatcgagtcagacttagacgatgctttgcctttatatgccaataaagcacttgctacagccctctctgcccgagccatattctaccctgatgcgggcatggaatccttccactgcgttccaaaaagacgtacaaaatttccccaattagactcttgatgagcatgcgataattcataatgacacacaggaagctaagatgacacatgaccgatgaaatgtgaacctgtgaacgagttataaaccagccaaatagagaaagctgtcctaacaaaacgacaactactacattgctctagtggctagatgagcacagcatgcagcatgtaccctaggagacgagagtctgaatcccacaaagacatgcatgtatccctgaattttgcataatatatagttcggattttataagtgtttaactcggatgacggacacaaatttagatgagtatgaaatcatcttcaacttttataatatataaagatttctatttttttaaactctagatcaatagatttatggcgagaaaatttatggttggttatttgtgttttgatttcgttgctgggagtatctatttattgctatgggatgaatcatgtacaatttggaaacgtataaacaaataccgacatggatgctaagtccatgcatgaatctaattatgattggtttgttatatctttacactgcttaggtgtttcacatggtttcgttgctgagaactattatctgtttcctacactatgaccatgcatggatatttatttctatatcacgtttccaaaaagtatcatgtccgtttgttttttcctttaatttttcatccgattgagaatccgggtcgccagtagattttttttcccggtccgatccgtgttttatacgtgtttaactcggatgacggatgaaaattaaggtgagtatggaatcatcttcaattttataataggtaaagacttgttatatgaacaaacgttgctacacaatgaatatcgtgtgttttcatttgtagaggtacttgtttgggtgaaggaaaagagatcgactgtaaggaacgcatggatgatcaaaaaagttgattgggtaccaaaccaagaccttctccaagtctactcctacctcaccatgtcacttttggtccatagaaggcaatagataaacttctatacattttggattcggattcggacctcctaatagcattgacttcaaacagacctagccgctaatctagaaggaatctcggggcccatgagtacttgctggaaagcttatgttgtctactttcagatggttttggtcccacgttaaaatttccaccaagctgtcgggaatctgtaaaacaagccacgtactttatcctatccgaatctgatttgggtcttaggctttgtaattgtattgtgggctaagcccaagggggtgtgcgccctagggcaaccctaggacgtccctaatcatgtatattcagtagttgttattgtttagagtcgggttttgcttagattatttctgccattgcagttttgccgctagatcggtttgtggaaccccaaattcgagtgcttaatcatttatatgcaattgtgttgcaatctatcttgttcttgcttgtatttgtcgattcgcatgcagggattagcctccttggcgaggtcaactgggcagtgcacgtttgataaccagaggagacgtggtgctgcaattgtagggttcggatcgtgtgtgtgaaatttccaccaaatcgagagttatcaataccttttggaagatcgggacctattttcctcatcatcgggccggtgcaaggaatggaggcactggggacggtggtcggggctgcgttggggatggcggtcacgtcgacaatggcgagggagacggctctccggatggagtaggggcggccattggttacagcggcacgggggttagtggggcagccggggggaagtgggaggggtccgggagacatatcaaaggctcctccggcgagggcacgcatgcgatggcgtgcggagatgcggcatggtggcggacggatatacgacgtggcggcactgggaatgtggtgctcaaagaggagaaattggggcgtgctgacttcatgctaaggttagatgactcaaagggtatttggtcattacggaaaaataacagtataaacggcgtatagctgacagaccgtggacggtgatagtaaagtgtagagattaagggaaagccgatggtata

SEQ ID NO: 75165 - DNA, 2284 bp, Oryza sativa
attcctccaaaatttacatggcattaggcaatccataggaatttcataggattccataagatccattcctttgattcaaagggctgtatagaaaaaattcctataggaaagaaatcatctaaaattcctatgaatttcctttgaatcaaagggggcctaaaccttcccaccgagagagttgtcagtgacaatgtgtgtgcacacatagaacctagcaaactaaaggaactttcccctgtaacagagaacaacaggaagcaagtggaagcttcagaagaagtagctcatgaagaaatggccataaacacatcgggagaatcatttgatagagcaacagcaaatgtagatatctactttgctaagaaaatagcctctgtcgtgaatctcgactgcgagcccatatcactcacagaatgcaagaaaaggtcggattgggacgaatggaagaaagcaatcacaatcgagttaatttctctaaacaaaagagaggtatttgaccctgtaagccgtatccctcctcatatacgggcataaatggttatttgttcgaaagaaaaaatcagaataacgagttagtgagatgtcacgtccaaaatttctatccaaaattccaaacgcttacatgtgtgttaaaccctcgtccagaaattaaccgaggcacacaataacaaattgataatagagtgctacacaaacaactaattaatattggcccaataataaaataataaactattatagaggtggatagttcttctcaaagaataaaattatacgcagcggaaataaaaccaaaacggaacagttatggggattccactccacaagcaactcgaccggaacaaagcttaatcctccagatcatcaccttcattgaagtactcttcttctgacgaatgaatattgcaataatgagcatatgacatactcaccaagccacccagcaaatatgcaagtgcacaggataacaaaagatggcatagtaaagctcatttgcataaacagcatttaataaacattttaaagaataataaaccagttgaataattaatcagtattaaataaacactatacaacacacccgtgctgcataggcccaacctcatctgagcaaccaaccccggttgtacaaatcaaacctccataccaggaatataccattccaaaccaaaagtcaaattaattaacacaatattatcattaatgaatagtgtggggctaatcacgaaaaacattgttaaactcacccataaccgcgggcacggctattcgaatagttttactctgatcagaggtgtaccactgtacccacaagacacaactccacaacatgtcatcatgcgcctcagtaccactacggtaccttggaaaggaactgtgacaatacccctcgcacaacacaactcatcacagtgcaccgttcctggatcatgatctccccctcaaaaccagaggcaatggactccccagcgacccccacagacttctcgccgcttcacagtctggcacaccataataaatcatgctatacaaaagataaagccgttgcccatgctggcttgtggttggcacggtaaatgtttcacaacagtagctcgcgaaccggtccttaattgtcatgagcacaaccatcaaaaccatatgctcacaacccaccttaatcaggttttagttatcaattaattaacataacacaattaaccattgtgagctaccattaaatataaccataattaataatgtagtatgattcatcccattaatgagctaatgtttctaagcatggctaagcaattatacatatagcatctaactgaaccaatccaatatataaggtacaagctaatcaatttattacccataggaaaataaagacatctttggccattaattaattgggaaaggctcaccacccgatgacattcgaaaataatgcataagttaaaataaaacattagctttaaacgggttcaacatgctcaaagggttgtttgggatctatattacttgccttgagcttccgcaaatgcttccgaaccttcctcaacgaaaacgctctccttcggaacgtcggaaactaaagccaaagaacaaaatcaaccaaaacagtacaaaaacaagcataaacagtacatgtggatatttttaacatgtagatctcgattttagaaaaatttagcaacttggaccactcgaattcgagttacgatgatttagttatgaatttccgaagtttaatcgatttgcatctaataaagaaaaccttaaaaaagggatttatgac

SEQ ID NO: 75166 - DNA, 8023 bp, Oryza sativa
acactctcccccacttttccccaaaaatcggcgccggtttgaccctccacgagcaccacgtcggctccggccattgcgccgattccaccttccggccacgatctccctccccgcgcccatataaaccctccccgggctcccttcccccgtttccccctctccccgaagcgccccatgcccggaaccccctcctccccgtgaaacctatgcgccgccgctcgccggcgatctccagccacacgccacggccgctcccgccaccgccgcactgcgtcgccaccaccgcccaccttgccgcacgatgccgcgccccggcctccccttcgagccctcaatccattgccggaaccccctccccccaacatcaccctaccggccgccccgttcatcgccttcagccggccaccacctccgccctagcggccgctgcgctgcgccgccgccgccgtcggcatcgccatgccgagctccaccccggcaaccgctcctcttccttcaaccaccaccgaaaaactagccccaccgcacacccgaggccgccgtcgcttttgctgcctccggccgcctactgccgccatccctgtccaccgcaagctacgccactgcctccaccacgttcgccacgtcccaatgcacctcggctgccactccaagccgccgaaatcccgccgaagctcggtatctctcggtcgccggtgagctccaccattcctctcctctccggcgtggtattctcaccgctccggtcgcctatgttcctccctaacccttctatcttcttccccagggaatcccggctgccgtccgccgcttcgtgctcgcgggtcgccatcggacctccgccaccgcccttcccgagggagcgcctccactgcccgttgcccctcgccgccccggcgcatggtgagcactcccctccatctcccctttctcctcttcggcggccacctcccatgctcgccgccgtgccgtgtcatgtcgccggtggccgcgcccggccgtgagccgtcgccgcccctctgccaccgtgtgtagccgcctgtggaccaccgtggtccgggtccacggtgccgtcccggtgcgcgcgtggacttggtccaccgtgcgcctgcctcccatgagtcaccgatgggtggggccctcttgtcggcgccacccttcctctcggctgacgccataaatggttaataattgcgtcataaatcgataattaattctagaaattcattaaaatggctcaaaacttataaaattcatatataattcatccgaactccaaattgagccattcaacttgcaaaattcatctaaaattgagctctacatgtttgtttactttttatgtactgtttccttggtttttattagagtttttcctcattttgcgtgccagcgtgtagattccgctgtttcggaagtccgcggtcacgaggaaaagagttcagaagattgttttgaagaagcaaggcaagtcacacattcccccttgagcatgttgatcctaatttataaatgttttaccgtttgcaaataaatatgcatgttttgctaattacatgggatcagggtttacctatctgctcgcttgtgccatgtttacttgatatcggtcctttgtcaaccttgggtgataaatcgactagctcgtgctacttatgtgacctagctagaactatatgcttagccatgcttaattaccactagctcagttgataggataattacagttttagacatctagtatcttgacgagctgcgtgctcgagacatctggccatggttcatggttgtaattatcaaactaaaatgcgactgaatggtgggctgtgggtgcatggttttgcgagtcgcacccatggcaattaaggaccggttcacgggaaaccctggaagactaacagtgcttaccataagcgggagtgggtaactgcttgatctgaagtatagctcgaccctttcctaggcaccggtggcgagggtggacgtgatggagttgggtcggctggggtgtccggttgtccagctgccggattcaccgcgccgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccatgcctgcggttatgggcgatcaaccagattcaccgtgattagtctcacacttaataaatcgacccaatgcactgtagttcaggtgggttggttgggcctgttcaacgtggtgtagcgttgatcagtggagatttaatattaccttaattactcaactgttttactgttttgcttaataagatgttttacaactgcctttatgcaaatagccacaaaccgtccttgtatccccttgcacgtctgcatcatcggtgtggcttgctgagtacggtggttgtactcagccttgctattattccccttttcagaagtgtagtgcttctgagctgaagacgaagttagaggaccaaggctcagaccccagttgagttttgcctgtggagtggagctgaagccccgctaggatcgcctttttccgctgctgtcgttctctttcggtgtgaggactaagtgcctcttatataagtattttacgctttatttacgtttggaactgtatattacttgtcgttttgtgtaccctggctggtcctggacagggatttaatacacaaaatagtctgaaaatttagggctaaatttctgggcgtgacaatggtggagttgcgcggcgacgacagcagcggcgaccggcgcggatcttgggtttcgggattgggagttgcagcggcgggtcggcggctccctggtggagcagcggtggcttagcggatcccgatgcaatggcgtgtcagcggaggaggagctctgtcgaggagaagcgatggcctcctactcgcccctctatctcctctaatcatctcttgattccgatttgtatttgtatttgtatttgtattttatttggattgagatttttgttttttgtttggacttggatttgtgatgagatgatgtgggattgtgaagatgttgcggacgaacgaaaatcgttgtacgggtggaaaattggtgtgacaaaaggaaaaatacaaatatttatattagttaatatatgaaatacatagtttatatacttaccttttgtccaaaaatcttggtatacatctcaataccttgaatcactagtgggcctgcccctgccgctcgccgcatgcttgctacctcctcgacctcgagtcctcgtagcttacggagctggtggtcgggcgacattggggacttgggtcctggccggaggcgcgtgcggcggaaagccgtcgacgtcgacgcggcgtgcggtgcggctgcgttgggggcggctgtgcgggtgttgctgcggcgttgggggcccgggtggcatgaggagttgggagagaatgggagggagtcaatatgtgacttttgggttgaagttggccacatgggccagatttagacaagggaatcagggttttttttcctaggacgattggcttttttttttctgttcgtggtttaaatacgagaaagctaattggcggcgtgcattctaagcccataaggcgcatgcaactggtgcgtggctgattcgtccgtacttttttttccaagaaaaagctaatgtccacgcgttttttcatttctttttgccattttttcttggtttttttattttagaagttgaatctttcatcagttgaaagtttttaagatttgagttgaaagtttttaagatttgaagttgaattttttagatgaaagtttttaaatctggattgaaagttttgaattttgagatgaaagttttcaaatccgagttaaaagttttcaaatctttagttgaaagtttttaatcttgagatgaaagttttcaaatccgagttgaaagttttcagtcttgagttgaaagttttcaaatcttgacttgaatttttttcaaatctggatttgaaagttttaaaatctgagttgaatttttttaaaaattcaaattgaaagtattcaaatcttgacttgaaaattttcaagtatgagttaaatttttttaaaaaaatcttaacttgatagtattcaaatttgaacttgaaaatttttaaatatggacttaaagttttcaaatcctaaataaatgtgatttgaaagtttgtttcagtgaactgaaagaaaaagaaaaaacacgcacataaggaacttttattaaaaaataaagcgaaacaaagagaggtggatctaagcgctaagcgctattagcgtggaaaaatgcgcgccgtctccattcctggcgtgcacgcgcggattaggatcccgcgtataaatattaccgttttgttttcattttttcatgttcactagttagtgaagtcgcgcgttctcgcgaccatgagctgccacctctttttttactataacggccattggtgttaagtttactgataacatctaattaattaaatgaaccggatttttttttctctaatctgatcaacaccctcaaaattatgttgtaattgaaatgaaataattgtaggttgtctaatatctaaaaatactactccgtacgtatttaatgttgcaagatagcggtgcagatcctccccgccataagcaaactcgctgatgtagaagcagaggatagcaagaacagctcgcttagctcctctgtctgcattggttagtgttgatcagaattcaagatcgacgcagcaagtatctgaaactatcccctctctttactggatttcagaatggaggttgtaaatccatgcaaagtgtaaatgttattcaggaaaggtaaacagcagcaagcatgcatttgttaaaatataactgataatttcaacactaacaaatttagcgtaccaccaatttccagattagctgtactgtagaagtaatatgagagaataaatattacaaactttttacttgttttagtgcacctatcaacctctgatatctttaaacaattactatgtgagaggataaaaaaacattatgtcagaagtttcaaaagtttatctttgtcatattttactataggtaaagctagcagatctgtcttctactaaaactgcacgtagtatcagcatgtaaattattatttgaaggagatggattgggtgctcgacgggagggcgaggctgctgcagcctcgctgccccggagcctaggtgaggccgagcagagaagaggggagactagagataggtttaacttctttcttgattaattccaaatgactgtggtgcctctccttatatagagccggctcttaacaaacatcctaacaatcttatctaataaagcataacaaacctcctaacaaccttatctaataatgaggggctgcataacatcttcatccctccttcgagacagctcgtcctcgagctgcggtagaagccatgcctggaggttgaagggtgtcggttaaccacgtcatcctagtcccctttccctcctccttcgaaagcagctcgccctcgagctacaagctagtctgcacacgatgattgttttggcatctagactcatcccatattattaagccttttacatctgggctccgaacattatttggaaagaaaaataaatctaaaattatgttggtggtccctgccattcttccgcagccaagctcaggtgggccccacccggaagcacatagaggaaggacaccagaaccatgcagagaggaaggcgccaccagaagccacatcgcacgcgccgcacatgccgcgatcgccgcccgaaagtgcggcttgcgtggcccgcctagatcccacgccggtggcgccgcactcgattctccccgccgttgagcagcgcgtagcgtaatcgctgtcgatgctcgaggaagctgcttgaagatgcctcgctgccgtcgtggtcgtagaagggaacggtcatgacgcgacaagatagtctcccttggctgcgacggggttgatggtgccccaggaagtgccggcccaactgttgttaggcagggcagcactgccgcagccttggatgcaaacgacatctgagaagatggtgcagcaacaaggggctgcagcacctccgccgggtggggcaatggcagtggagaggacgccgtcatcaccgtttcctctactgtagccgcgaacagggacgatggcagagaaggtggcgccgtagcgagtggctgctgcacctccgccttcggcagcgtcggcattggagagggtgttgtcggcgtagtttccaccgccgccctcttggcctcaaaacccgcgcggagcgctagcaccaactctgtcaccttgtcgtgcccagccgcaatttctgtgatggaggtctgcatggccatggaggttcggcgcagtgtgtggagggcatggatggcagccatggtagatggtaaatgatgtggcttagtgggtggcaggatcgtggtcgtctgataccagatgttatgtgggtagatggattgggtgctcgatgggagggcgaggctgctgctgtcttgccgccccggagcccaaattcttcatatatgttcttgtcagtcaggatgttagatttgatatttttgagaaggccagatggatcaagtagagctcattttttttcttgtactaaatagattgaggtgacatggatattagctttaatcttagagctttttgaatgcttaggacatccataattaattatagtattatatttctaaaagttaaagtttgggtctacacacaaatttagcacctatagacgaaataggggaaaattgccaaagtttggaaagttacgggtttccttcacagggccggtcagaccacaggtgtgtgggcggtctgaccggcttgtagggccggtctgaccgcaggtatgtgggcggtcagaccggcagggtccgagtccgagtctgttttcgtcaggtctcgggtttccttgctcgggaaggtatgtttcgtgttttctttagtttctattccgagttggacgtggagaagggtttgtagagggcaagaccaacccctatttaagggacaaggccgattcattgaaaaacccccgaatacactctacttgaatcgttcttttactatgttttctattttagcctagttttagtccatctttgtcggtttgcaccgtaaaccgtccgccgccgctgcgagagtgcgacacctctttgtaggtttatcctgaaaaccttccgttttgcccacgagacgggtagttatcctcatatcgatctaaatcggcctagaggctgattttgatctctaaatcggctttgctagccggtttagcttttctttttgcaaaacccatcttgatttggccctttggctagatcgaggtggttggcgactccacatcaccgcaaggcgtttaggtgttgtgatcgtgcttgtcgacttgtcaaaaaagttgccaacacgatttttggcgactccgctggggaacgatctaatcggccatatcacggccgaatttcgtttaatctagtagttaccgtttcatcaaatccaagtttcggctaaacggccgaaattaatctagtatcgccggattaatctaatcggcggcgaggttatttggtcgtcactgaatccatctgaacacttgccgtgtgtattgaagatcatcatcagggagcagcagccgactcagcaacctcctttccttttgtttcacacggcaacagaggaaaagatcaggctactagagccgatctgctgagagacaagcagcaggagcattgtttccttttattactgtatacgtgcatagatcaaaaagatcaggctataagccgatctactactgttcacattaaaaaaaaaaagaaagacaaaaaccgattcaatttgtatcggttacactgtg

SEQ ID NO: 75167 - DNA, 3357 bp, Oryza sativa
gccccccccccgaacgcgcccttcccccgccggcggcgccactcctcctcatcggggtgccgccgccgccccggcagctctctccacatggatccgacggcggggaaggtggtggaggcgtccgccggcggtagcgaccctctcccgcaaggatcgggtggcggggagggtggttgtaacgccccgattttcgttcgggattaaaaatcattaaataatgcattttctagaaattaaataaaagttaaatcaatttaatcaagtgaaataacgggagaattaaaattttcccttataaatcattggccgggaatattttgtaatattctttgtgacctaaaatactctccagatttttccgcgaattttcggaactcaagaaataattttagaagtcacaaagttcatttaatcaattaaataaattgaaaaccaaagttaaatctccccttcctccttgggccattttcggcccaagatattttccccctccttggcccgctcgcccctctctccttccctcctccctctcgggccgacccctcccttctcggcccgatcgactttccctcgcgcaaagttgtcacgcccggaatttctatccaaaattccaaacgcttacatgtgtgttaaaccctcgtccaggaatcagccaaggcacacaataacaaattgataatagagtacaaataaataactatttaatattcgcaaataataaattattacagaggtggatagttcctctcaaagaatacattctacgcagcggaaaataaaataaactaaagcaaactacggaacagctatggcaactccactccacaggcatctcaacccggaacaagcctaatcctccagatcatcaccttcactgaagtactcctcctctgatgaatgaatattgcaagaatgagcatatgacatactcaacaagccacacagcaaatatgcaagtgcacaggataacaaaggatggcataaaatagctcatttgcataaacagcatttaataaatatttaagagaatagtaaaacagttgaataattaatcagtattaaataaacaccatataacacacccgtgttgcataggcccaacctcatctgaacaaccaaccccggttgtacaaatcaaacctccataccaggaatataccattccaaaccaggagccacattaattaacacaattaccattaatgaatagtgtgagactaatcacgaaaaatattgttcaactcacccataaccgcgggcacggctattcgaatagttttactctgatcagaggtgtaccactgtacccacaagacacaatcccacaacatgtcaccatgcgcctcagtaccaccacggtaccttagaaaggaactgtgacaatacccctcgcacaacacaactcaccacagtgcaccgttcctgatcataatctccccctcaaaaccagaggcaatggactccccagcgacccccacggacttctcgccgcttcacagtctggcacactataatgaatcatgctatacaaaagataaagccgttgcccatgctggcttatggttggcacggtaaatgtttcacaacagtagctcgcgaactagtccttaattgtcatgagcacaaccatcaaaaccacatgctcacaacccacctttaaccaggttttaattatcaattaattaacatcacacgattaaccatcgtgagctaccattaattataaccataattaataataataatataatataatatatctttaatcccctttagttagctaatatttctaagcatggttaagcaaatcgtacatatagcatttggctgaaccaatccaatatataaggttcatgctaatcaaattatagcccttaggaaaattaagtcatcttcggccattaataattcgggaaaaggttcaccacccaatgacatttgaaaataatgcataagttgaaataaaacaatagctttaaacgagttcaacatgctcaaagggttgtttgggatctgtgtgacttgccttgggcttccacaaaaacctctgaaccttcctcaactgaaacgctctcctccggaacatcagaaactaaagcaaacaaacaaaaatcaacaaaacagtacaaaaacaagcataaacagtacatgtggatatttttaacatgtagatctcgattttagaaaaatttagcaacttgaaccacttgaatcggagctatggttaattagttatgattttccgaagttttaatatatttaatctattaaaaaaaactgaaaaagaggggattatgacgtcatgatgacgtcatcgacggcagccacggcacgggcaacgacctcgccggcgctagggtggtcggccggggttttggaggacacctacacgtacaggacgacgacgcgaacccaatggtgcttaccgaagcgacaaacggcgaccgacgacggccggcgacaagaggcgcggcggcggcggctcggacttacggcggcggcgggctacggcgcacggcgacgacggggaagtggcggccgggcttcctcactcccgtgcgcacctaatggcggcgacggagggcgacggcgacggcggatgcggcggcgcggcgcggctggcggttggccggcggcggcggcgaggctacggagcacgagagaactcggggaagggggcaaacgaaagaggacgactagggggtcctatttatagccttggattgaagagatcggactcctaccgcgtggaattggcccgagaaaatctaaattcggtttttggggataaatttgaaacgaactcgattcggttgaaatacccaacggtttgctccgattgttgaggggatagatagaggaggatgaggggattaaaacccctcaatcaatcggactcggggtggccggatttgaggcggaaacggcggaggaaggcggcggctcgggcgactcggcatggcagccggccggctggaggaggaagatgggtccgacatgtgggccccacatgtcggtgacccgaggaggaggggcgggcggcgtcggcttgggccgactgggccggctcggccgcgcgggaaaaggggaaagttgggccgaaatcggcccaacaacttagggaaggatttttggaactttttcaattaaaataattcgtgaaatgttgtttcatttattaaaaatacttcccttgctcaaataattcccagaaaaatctaaaaaatagaggaacaagcaaagtatttgatgaaattttatatagctcaattttatgttgaaaatttccctagattattagagtttaacttgaaggcttttaaaataatttctaacaatgatttaaaatatgcattt

SEQ ID NO: 75168 - DNA, 6915 bp, Oryza sativa
tatatgtggatgtatcaatttccaaaatctcaagcggaagatgaatagtctagcttttaagctgagaagtttcaactttcgacgcttctggcagttccagattgcatctacttaacaatcatgagaaacaaaaactgctgattggtcaatgtggtcaccaatataggctgcaacttgatgatgcacatgatccttgaaaaatgccacaacagttacacatttgcggctttacccataaaaatagcattgtccaacacagtacagcccatctattgactgtcaaaattaatagtagatttaatttcaataagcttgccacatgacaagttcatcagtgtatcaagtcaacaaaaaggaaaaatggcacccccatgcatattaacttacagtagtattcaaatggatattaacttacagcttcttttcaagctttttttgttatctcactggccgcaagctcctttttcttctcataatccttcttagacagaccctgccatgattatcaggactgaataagtatgttggtacagaaggccttggtctctcataattcaaagtaaaattagatggcagctagaacacatccatacctctcaatcttctatccctgcagttgtaaaaatatgaagtatacaatgttcttcaggatacttacaaatatgcttccacaaggcttctccaaattagctcagtcatcctgccaattgcactcagagtcttagagttaagttattttagactcaaagctgtactcaactttgccattttccaaaataatattggtcacattagccttgaatatttcactaatttccctgaagtggctatcgcactagacctgctgttttgcccataggatagcagaagtttaaataaacaaactaaaggcaaacaaatatggagcaacctaaccttcctattcgcccttcagttctccaatcaaaattttacatataaattgcataaaacaagaagaataatacacaactataatatccataaacaagaaaacttaacggaagaataatatacaactaaaattccacagacttcacggaagaatctcagccctcaaaaactcccttctattctatacaatgttcaagcaaaactctctcaactgaccatcctaaatgaaaggggcaagcttcccaatgaacagtagacaccagacagcttctctgatattttccttgcacaaatcaacagaagcattgttaaccttcggagcatagccacacacctttattttgcagttatctcatcaagcttcagaaggatcctttcatttccaaaattttttcacctccaactgcaaactgatgaacactgccattcagctccatccaactgcaacctttcttcttccacgtcccctggacttccattactccccttacctccttaacatcattccagtttccatattctgcatatatatttgataagagcacttgtgctccaccatgattagggtccaactccaaaattttctttgcagcaaacgtgccgagctcaagatcaccatgcatccggcatgctgctaacaaagatccccaaatgaccacatttggtcttaagtgcatggactgtatcaggtcagcagcttgtccaagaagttttgctcttcccaaaagatccaccatacaaccgtagtgctcatgcatgggctcaatcctgtattgctggaccataattttgaacaataaacggccttcttcaactaaaccagcatgacagcaagcatagagcaacccaagaaatgtcactccattgggttgaatcccttcacttttcatgttctcaaaaagggttaaggcggatcttccatcaccatgcatagcagatgcagtaattatgcttgtccaggtgacaacattcttttgaggcattgcattgaagacatccaaggcaagagtttaaactcccacatttggagaacatatcaataagagcatttccgatgggtaatatcttacacatgctatgattctccacgaaggaatggatacatctagctttttcaagggcaccaacattagcacatgcagatattacactcagcatggtaatttcatcaggtttgacaccactccgttgcatatcatggaacaaattcagcgcttccataggtttgctgctttcagcatatcctgctatcatagcactccaagataccacgtccttcgctggcattccattgaatatggagtgagcaatctcaacttttccattcttggcgtatccatacaccatggtggttgataatacaatttccttttctgacaccctattgtacagcttttcagccatttccatgtctgcacaactagcatacatgttcatgagagcacagctgacttgagcatcaataagagtatctgacaccaacatgtatgagtggatagcctttccaaatctcaagtttcttgtatgagcacaagttgaaaggacagtagcaataatcacttgatcaggaacaactcttgatctcttcatgctatgaaaaagcaacagggcttcttcatagtttcgggcctgacaataactgacagggtaatgttagagaggttatcataactatagtgaaagtccaattaacatattatacagaagtataaaaaataacagtagaaaaaatattagcacaaaacaaatgtatatatgtaaaatggtttgcaaaatacttagagttgagctggattagaaagaaatgtttctccacgtgccccttgaatttcagcacgtaacacagagatctagaggaacccacatataaatgtatgtcaaaaatctcaagtagaacatgaacagtgatgttttaaaaacgagaagttccaaccttctaggcttctactggttccccatgtctactcaaaatttacaagttgcattgctgcaagctgagtaatttcataggtcgaggtgatttcagtttatatatttttccccacaaaataaatcagtatatattttaagttccacattatttctgactatgccaagactgattctgttccaatcaggatttggaaatttcactcctgctcggtgatgataagattgagtatatggttccgatggccttaggacatactagttggactcactctgacatacagccatgcaaaacgttctccgatgtaccatgcattgaactctcaactaagcacaagcaactgaataaaccattttgcaggcagccaggcatacacagaacatgatacttacgagatagatcaaacaactaggattccataggattgcgtgaagaaatggagctgttcacagtgcgttaccagtcaagcatgacgccccaggcgacgaggtcccggtcaggcatcccatcgaacaccctgcgtgcgtcctccacacgcccgcacgccgcgtaggcccggaccagcgcggtcccgacgaagccatcgacctctgccccgaccctaaacgcgagaccgtgcgcggcccctgcggtgccaagggagcgcgcgaacgcgatggcacggagcagggatgggagcgcgcggcgtcctggcgcgggcaggcccacgcggcggaggcaagcgaaggccgcgagtgcgagacgcggcgcggcggccgcgcggattacggagatgtaggcgcggtcgaggtcagggtcggggtgagccgccggcgggaaggggtggccgcggcggaggaagtgggcgtggagctctccgagttggcgggaaaggcgctctcgaggctgcattggggcttggcctgcgtgggtagccaacgggttgagtggttgtatggtctagtcgagcggtctgagcagaggcagacccaggatttaaaagttgtgtattcaaaatgtgaagggtggaaaaaactttttatagcaaaagactaatattcgacatgtataataatcacatcgttgtaaaccactaattatatactccatccgtttcacaatgtaagtcattctagcattttccatattcatattgatgttaatgaatctagacatatatatctatctagatacattaacattaatatgaatgtgggaaatgctagaatgacttgcattgtgaaacggaggaagtattatatagcagatataacataaaattgagcatgatttcagatattcatagaattgatcataaatctgacattgttattgacaactgttcaacagtggtaacatatgaaatatatagaagatagaatatgacaaatgataagaaatcttacaatgtagaggacaactttccgatgcttgttcaacatatcattggaagaaggatccagattggcctgatcccgagtttcattttgagtctttttctttgcggcaactgtttcaaaataaacacttcaaatcaatagcaggaccttctttcttttcatatttcagacctgaaatttcaacaatatgggattgatgtatctggattcctgaccaattgaaagccgccctaaatttcaacaatgtgggataaatgtatctaaatctattgattctgactaaaaaatgtaaatcacagcacataaagaattggggacgtggaacaaacctgagacaaacagtgagagcctgaaccaacgagacaccgaaacagacagacagtgagggcgctaggcgcaagcctgtggcaccaccgacgcaccgccgctcgccgcccgcccacactggggctggtggttgctggcccagccacagccaggtgcccaggcctggccacgcgggtgacgctcgcccaggggcggcccaggattttcaggttgggtatgcgaaacgtgaaggagtaattatatagtactaaactacaaattgtataacatgaattgggtataatttcatatatttatataaatggattaactactattggccatggtcacaataaaatactcactattttgatatggcaccctaaaaggcatttgaaattataaagatgaaattgtcatgttgaggcagggacttcgaatgctgattaaaaatcatgaacaaattgttcaaagagcaaagaccatttcttttctcttcatatttagacctaaaaatccaacaatatgggaatgggattatgcctctggattcttatggaagaagaatcatgcaacgcaatggtagtgtgccgaacgcccttgccaatcagtgatacggtagctctgctgcataaattgatttactttctgtagacaggggaataatagccttaagtacacatgccaaaattatcattgctgagaggagttgcaactgtacttagatctgagtagcatcatacgcaagtaaatgcatgcagaacttgcagatcgagggaacagtgctaccggatgaatcgcaggatcaaccagcattcaacactacacagacagatagatagagattaaagcttactgttgtggctcgatgacggcggatgagtgctcgacccatcggcgctccaggggaaaccacttgagcaccctcccgtccgacacgcccgtgtacgggcggtcgccgtcgccgtcgccgtcgaacgccacgctctccggcccaaccgcgccgctggagtccacggtgatcagcacgtcgtcgctccgggaccgggagtccagggacaagaacaacgccgccgccaccgccacggcggccgcgagcaccacgaggctggcgtcggcgcgtcagcgcacagcgcactgccctgccgccgccgcctgctgcccgcctcgcccccgcgtcgcgaatcgccagccgccgtttggggagggggaaggggaagaatcgaagaaaggagctggaatgggctgagagagaggagagggggagccggggaggggaataggaaatttgggaccagaagggtgaagaaaggcccaaatgagaagtttgtttacctattgggctgtttaaggctttctttttatatttttaatactccctccgtttcaaaatatttgacaccgttgattttttagcacatgtttgactgttcgtcttattcaaaaacttttgtgaaatatgtaaaattatatgcctacatgaaaatatatttaacaatgaatcaaatgacaggaaaagaattaataattacttaatttttttaataagacgaacggtcaaacatgtgctaaaaagtcaacggcatcaaacatttcgaaatggagggagtacatactagcaaaatagccgtgatttactacggtgtactaaaactaaaaatatttctttttaaccaaagttattttcacactgctttggtacttttagcttgctagaaaaagtctcaaatgacagagagaaatatagtagctcatattaaattatttttcacaaataatttcgaagaaagggagataaaaaaaaagacaaagccggcttgatttccacctttacacggtgcaagtcaatatggactctgaagatatgggtagatctactgggtggaattaattttattaaattctccataattaaatacaatctttgaaattttattggaatttgcataagctaattttgaacatcatttcaatcttcctttctctctaggccattttcagtacattttattctttagcccatagctgagccgacccactttcctcccttcttctctcctccacctcaacccgcacatttgtctgcgccagcaagaagtctagcctccccctacttctcctctcactgccattaagcgtgcggcccgacgtgaccgatctgagccgttcgttttgatgtacggctcagatcggctcttaatccatcaaaaccccgaaccaaacaaaccctaaccctaatttccttttccccttcattccctcaccgcaggccgcctctctcggtctctccccaccgccgcctctccacgcctctccctcatcggcgtcgtcttcccgcgcccctcccccaccggcgcctctcccccaccggcgccacctacgcgcccc

SEQ ID NO: 75169 - DNA, 812 bp, Oryza sativa
caacgacgatggccggccggacttccttttcctcacaacgactggtcacaaccctaaatcctctcactccctctttgttcattcatctattgttgttcatccattgcaaatagaaccacccgactagatgtaaacctaggtgatccaatagactaccctaacactccattgcttcaaaaatgaaacagctttataaggtaattgaagtacatctgacataagtttgttgttaaacacccaatcattcctaaacagccaaattgcccaggttcccgccgcaacaaggcacaacaacggggtgttgcgagcattgcctgggcaaagcagcttgtcaagcagctctgttctagtgttcggcactttagcccagcctaatgcatctctaacacaacaccaaaaaaatttagtagggggacattggaaaattagatgatcaaccccttctaactccccacaaagtttgcactccacctcaccaggccatttcattttttttaattgctcagctgtttgtatgcgcccttttatcattaaccagaggaaaatcttaactttcagcggcactgggatacttagaatttcttgggctcttctgtctcttacccctccaaaaatcatctctttataaagcgacttagtagtgtaccaccctgatttagtcagaccccagctcattttgtcatcttcttctgttaacgtcaccctctctagaatctcatgcaaattatcccactcttcaaggtcttgctcacttaatgatcttcttaattcgatattccactccccatttgtacaaatttgtttgatcgtag

SEQ ID NO: 75170 - DNA, 7110 bp, Oryza sativa
ctgcagcccatgctaatctactaacaatccaaagaccagctcgcctccaaccatctaagatgtatagtaatttgaattagaatcccatgcagtgatattgtacaaatcaaaagcgagtgtgatgtttaagaaaaagaagaaagaaagctgagtgtgttgtaccactgcatgccggtgaggttgaactttgaaggcttgaggcgaactcgtgttctgcgtccaccgaaggttggaataggcgtccctgtcaccgtcgctgtagaggtcctctgacttgctagtcggatcaatatcagatggttccctgcatgatagagagtaacagacgaagatatcctcaattagtgcatttaactctagatggattcagagtaaacaacacatggaagaggtcctaaagcgcgggccagttcaatggagggggaggacttggtgctttgctgctgaggaaaagtcataacagtttggctaagctttgctagctacgtcatcatcagattcaacaatcagccacctcttacttttaggatcagcacagtatccgtcttcggagttcgggctagctgctgctctcttttttttcaccctttgatcagttccattgatctttggaccagtagctggtttccatggggactgctgtcccatactcggagggcgagatacagttgattttcatggaaatttaaggaatgttacattataggcttattttaacaaggaaaattgtaaaaacaatgatgatagaaaaaacttaggagtatgaacaagaagatatgtattgagcaatgatatgtgttcaaaggcttttgttcggtagtaggaatctcaattccgttagagaatattttatgcatcctagccttcaattatccaaagattctttaatttcacgagatccatcttttgtaggttgcaaccttgattttatgaagtgccaagtgacatctaccccaatcaatccttgccctctcatggcagtaaatctagcgatgagtgtgctgactttggacatttctttgtctgaaggacgcttaatgagcgatgtactaactaggggaagtcctattcaagaaaagaattggggtttgagaagtagaaccacttaacatgccaatcctttggaagatttcaatggaagggaaaagtattggtgaaaggaccttaatgtcgcctagagagggggggtggtgaataggcgttcctaaaaaaattatcacacttcatagcatattagaaaaatgagaactttcggttcaaattggaactttcctgtatggtttggaaattccggtctcaaccaaaaaattcagtggataatggaataaagcactagctatgaacttgtaactcgaataaacaaaatatatatgaaccaaaaggtgacaaataaggtacctaagtaagatatacagcttgctagcctgcaccaaaataggcggtggtctcccatatagattttaggcaattttttccttgattcaatttctgatttcagttcattgttccatttttacttgcacgaccctttccaaatgcttagagaatcaaatgatatcaaaatcagattcaaaatgatttttcaaatcattgtttaggttctcactcaattgtgtacttctcattcctaatgtgatgacatccttcatatggcattcaacctaatttttcttcaacatgtatacgctatcaaaccaagtttgcttgctcatctttttcctcaaaatgtcaaagtgatgtattcttcaatgccctcatactcaaacatgcatgtactaaaaagcaatagaacatttgtgtcttcattcttcagttcatgtagatggttgatagcattctacataatttgaaaggtgcataacccatgccatgcttatgtaaacacctcttcaaccgccttttccatagtcaaatcttgatcgatatagaatgttttaggccactttccattatgagctttcagaaaagtctcaaacaatcacttgaaagactcaaatgtttcatcatacatgagtgcagaaccaaaaaccacggtttctctaaagtgattgaaccctacaaacacacaaaaaggcctgctctcgttatttgtttcaaaagtggtgtcaaagctaacaacatcaccaaaatgtggtagtccatgatcattttagcatcagcctagaatatatttgcaatttgctcttcatagtcaattcgcagtgcatattggaatgatgggttctcaacaattttgtcatgaaaatacttaagcacactaccttcttggccatatgccatctcccattggcgcttgctccgtaaatagttcttgttatcgtgaagggtgtagctaagattgagtgttccgccttgtgccgcttttagcccaattcatgcatcatccgtcgtttcaatttaaaaggcattttcctttgtgacaccattaaatatagagtttcaggcaagtgtagtgggtgattgtgttccaataccagatcagactctttgtatatatccttctttccatctactttcagattcatgtagacttgacaattggttcagtttcagctcgagggcattttgttaaatgattccttttatattgtaatcgataaccctcatttgcacaaacaaatctacattatgtgatcttgctatcggattgccttttgttttaatacatttttcttacctcgaagccttcttgcccaccgtagctaagccaaaatgcgcaagtttcatttggatttgtaaattccattccaaccttagataccagattaggaacctatgattgctgaccaaaaaattggaaaaaccatactatgattgttgtttacatatcaccacacatattgctaaagacacaatcataacattgttttacacaaacctatgtccttccatcgcatgactattagacttgctttagtggcaagtctcagattgacaagcgacagtttcttccatgagaaaagggaaagctcgatcaagctgaaagaaacatgacgatgtatgtttgattgatttagtgagccatttatgagaaagaaggtggtcgagagacagattgttgagatttacctagaggattgaaggacggagaagctcaccccatcagtgattgcctcctcagctcctcgcaccaaaactctcgtccatggtgcctcttctcgtgcctttttcttattcttgtgcctctactcgctatgcttatgggccaaaccaagcagctgggcgcctgagctaaatcaatcagctaggccaaacaagatgtatgggaaggagctgctgttggatatgaatcaagttgaaggattcaatgttatctgtgcaatttggccacttttacaacatgtccaatttaaatgattaataaagcatatcagtaaaaaccaagagcgcatcagcgccacatgctaggccagcaacacatcgtaagtataaacggcacgatagggcgcgctataacgacatgttggctatcgagagtcgatgatcgatggttgggctgcgtgagagaatggacgctatggagaataacgtccacgctagagttgggctgcgtccatactactttcatagcatctagattggatgctatgatgcagttggagggatccggctcctctgactttgagtgaaaacgtcagaggcacacagtgttttggggcttacgctacagtacaaaacagttcctctactgtagtcactgtagcaacggcagaaaacaataaaaaatattgtttatatatcatattgtagcgatcgatcttgtccgttcactgcagttcagaccgttaaaaataccacaattagaggactgtgcgcctctgacgttttttcccaacgtcagatgatctcattcccagttggatatagtgtccatagtattttcatcagtcacctcacctatccgatttattactacttatttaattcaaatgaaaatgattagaaaaattaaagagtaaatttcacaaaactacacattttgtggtctaatttgcagaaaactacacactttgacacttggtacttaagtatatatattttggtagtgtagtttcaccaaaccacactatcaatgaatgtattcacccgtgagatggcgtggttgtttcaactaggacgaggacatggcatcctattaccagccatcgcacgaaattaataggatgcaacgtcctcatcctagatggaacaactatgtcatctcacgggtgaatccattcatcaataatgtggttttgtgaaactaaactaccaaaatatatgtacttaagtgctgagtatcaaaatgtgtagaactactattaggagcgcagcgcgccaaacatgcaccagcccaggccccccccacctcacgtcccgtcatcccactcttaccattgtcggaataaacgatttactcctatcgcgcgcctcaaccacccacctttattcgagtaaacaatttacttcgataataaaaacaactccactgcttccgatcccaccccacgtctcgcatcgtgcacccaccattatcagagtaaataatttacttcgataaaaacaacttctctactggcggtatatattctatttttctcgtacccaaccaactactctcgcccccactctgttttttcctttttttttcggatctgaatcgatccaccatcccagcccacagatcagcgacacaccatggaggaggacgacgacaccgtggcggttgatggtggtggccggcgagcggtggccggcggcggttgaggcgaaggcactatttcgagcctcgctgccggacgctaggcaacaccttaaccagcaaggaggtgttcacctgggctaatagcaacaaccaacgactgctccacgtcgacgacattgatagaacaagcaagtaaggaaataacactctgatttgcatctgcatactttccttcaacttcacacatgaagccctaattttttttgcaaatcaaattaacatgcaatctccaatattacctgatctcaattgatgggctgcacaggttctacatttgcacatcgtgctccatgtggctggccgcagaggatagggtggagtccactggtgatggagattgtttgctatttttcttttgctcatcatctgtattacatgaacgagaatgtttttgcattttttttgtgcttgctagatgatggatagctgctattgcgcaacgtcgagctcatctctataccacaccgctacatccttccatgattccataatggattttcggctgaatcatttattttcttttctagtttgattcacctgtgagtaattttatagtttgtgtgtgattgagcctgtaactttttcattcatacgactattttgtgatacagatcaataatactcttagtactagtttttacatattactacacggtggctacaagatcatggctatatcgagaggaaggtggtaattgttttactcgcataccacaaaatctcagtttttactcttatactgtgtattgaacacatcagtaaacatattactacacggtggctattacatcatgggctatatcgagagaaaggtagtaattattttactcatagaccacaaaatttaaataatattggtaaaacaattactagcgttgtaagctagtagtaattcttttacgaccatctaagtatggcgttatacgatgtggaggcattcatgcgagtaaatttattactttagaatgaggcattcatgcgaataaatttgttactctagaatgagcagatgtgggaggctaggagtaaatcaaaaactccacggagtaaattcgttatttttgagacgtgaccgggcccattaatgaagcatgataagatggaaaagagaaaaaaaagaaacacacaagatgggtggtaaaaaacgaaaaaaatcaaacgagaaaaggtgcgatgcggaggaaatgtggggtggtaaaaaagaaaaaccgggaggagaaggcggtgtgcggcgctcgaattattattccgcgctgtagcacgtggaatagcactaccgtcaaaatatgtgttgttttatacaacttaaatcacaaaacaatgtatttttatgaaatttactcaaaattaaaacaatcggcatatcccctcccccgttccccacactctcctcacagtcaccaatgccgaagcccaaccatcgtgcccgctccgccgctgccggcggcggcgggggcggcgggggcccgatagacgcggattggaagtacttcctcgacaatgtccgcgaggaaggccactcctacgccgtccgcgtccctgccgacggcgccaacccttcctactacctccaatacgagaagcccctcaccaacggcgccgcctccacctcctcccggggcggggctgcacgcaagcgctgccggatggaggaggaggaggaggaggagagctcgtccggcgaacccgaacccgcacccgaccccgacattgaagaggactaccgcgtgttccttcagaacgtgcgcctcgttgggcatggcggcttcgtgctggagcatgagggcaatgtgatcaggtacgatgcttcgggcgcggcgctcagctcggatgagtcttccgatgagtccgtgatgggtgctccggagcccgatccgcgtcgacgaaaggtttgccagctcgttctactttccatcttcttgtttactgttgttgtgcgcgtctctgacatacatgtttgcttgctcttaggcgaaaattgtggaggaggatcaggaggaggaggaggatgtgaagaatgaggttgccgttccgtctagaaagaaagattttaccatggtaaaagaggatcaggagaagaaggggaagagagtggtcgaccttcctgctaggggggaagatggtgccatggtggcggaagaggatcggaagaagaagctcagaaaagagttcaactttcattcctttcattctaaggggaaagatgatacaacaccagtgaaaaatctgaaggataagaagaaagaggttaaaaatccaaaggataagaaggttcatgggaagaaagaggttgccctttctgctaaggggaaagattgtcaattagcagagggtgggtaggttctcatggcccaatgttggttatt

SEQ ID NO: 75171 - DNA, 1965 bp, Oryza sativa
ttggtaaggttttttttggtatcaaagtgaacaggcccaaagttatacttcctctctttcacaatgtaagtcattctagtattttccatattatcaatataaatatggaaaatgctagaatgacttaacaatgtgaaagagaggaagtatatattaatgacaggtgcatgctttcatgcacgtggctagtcaagtgaagtcacggcaagcacagggtttcttgatctagccattctctactgtaggctacgcttagatatcttatcccttgttagctactccagtttgttgacacccatgcatataactatatgcagcaacagtggaagcatgcacagcgcatcagcacatacatgcatgcagcccgcggcttgtagcgcaggccgggatgatgtgcgatgatcgatgaaccagatcgagatgagatcaatcaagatgagatgagatgtggtgaggtgacaaaactctcatagaccactactcatcacgatccttggctgatatatcttgcctctgcttgacgatggaagaccgaagtgtcgtttacctagctagctatatactccttctgttccaaaataaattcaatcatagagaaaataaatccaatattactaattaaaaataaatatggacacactaggattggatttattctgggacagaggaaatataaacagttaattttcatagtcagaaaaccaacatcaatgtcagaatcagtcttcttaaattctcccttctggagcatattctcgaaaaacaagatgatatcgtatatatatttgcaaattggtataaaacttatgcaaatttgatgataagaaatttcaaaggaattaagtatatataaaatgctagctatagcttaagaaaaaatatagaaatatgtaacattatagtttataagaaaaacatgacatacagatattgtaatgtctaatggtgaaaacataacagtacatatacttcatttttcttaaacataatttagagacacaaccacaaatttacgggatatataatatgtttattaagcgcacgcgcgcgcgcacatatatatatatatatgatccatgcatggtattggtggcctactattgttaatttgcctaattaattaagggaatatttaaaagattgattgtgttttatgatgtcgtttcaattgagagtaaatatgcatttatgcatggatatgcatgatgggaggagtaaatgcaatagatgaaaatgtgtatcactcaaagaaatctaagccaactaaaatgaatccaatggtaaaaagtgactttagggtgatttgggatgttgagttccaatcttttgttaagatgatgaaagctttattaaattcaaacaattacatcaaggtaatacaaccatctgagaacacttccagcgtctgcattactaatataaacacagccaaaacgcacacccacacactagatttttctcaaaacaaaagagaatacaagaaatgttaaggaccatcaatccgaagactacaccgccacccgtgctcatgggtaatacactccctaatcactcgctccaattgctgacataccatcgtaataaaatcatgtaatcttgacttctgcataatatcccaagtatgaagccagtgaacaataagggagaaataacctgcaaaggagagtatatatttttgttgtaaaaaaaaccacatcatttttgcataaccataaggaccaacgcaaaataattaaggtgatggaagcactacgtgagagagaaatactaataactactttaagtgaggatcaattgtatgggttatatgaaactattagaacaagaaaaacaggttacatctccttttcgtttgcaaagtaggattgagtctattaaataaaaatgtgattacaattctactgatacaagaaaagatatacgtagcacctataccaacacataatataaataatataaagaggc

SEQ ID NO: 75172 - DNA, 10998 bp, Oryza sativa
cttcatgtggctctacacatgtcacctcctctgaatgatcaaaacccctggatctgaactctgagggcccctttgaatcatatgaatgaaaaaacggaggaatataaaaaacatagaattctgacaggaatgtaagtgtaaaatagagaattgtaaaacacaggaatgatcgtttgattggaccacaggaaaaacacaggaatcggataagagagatagactcaaatgatttttaccaagaggttggacctcttgctaagatttctccaaaacctatatacaacaagccattccataggaattttatagggtttggaaaacttgaatcatttaaatcaaagagctatataggaaaatttcctgtaggattttaatcctatgaaatttctttataattgctttcattcaaagggccctgaactcggaacaccggcgacgtgcatgcacatgcagcattttcagttcgtctcctccccgccgtcgacgcacgacaccactctgcagatcacctgaccgccggccgttggtagggacgagaccaacttgtttgactagctagcattaccagtaattaatacttcctccgttccaaaatactcatcgttttaagtttttatctgtaatgtttgatcattcatcttcaaaatattatgaaattattatttattttatttatgacttgttttattatcaaaagtactttaagtataacttatcttttttatatttgcactaattttttaaataagacaaataatattgcaagaaaaagttaaaacggtatctaatttagaacagaggtagtactcaccttgtttacttttccagtggcccgtagagtagcttagccaacgtgcatgttgatactcattcgtcccataatataacaatatagaattatcctactattatgaatttggataggtgtttagattcatattactgtgatgagtcttattatttgataatagattactatattttaggatgagtttagattcgtagtactatgatgagtcctattatttgatattagattactatattttatattttgggacgagtgagtaactctacagtggctagagggaaaaataatagtcgatgtttatcggctgccaatcgccaggcagtaggttatgatcaaatcaccggtatttagggatgctcgttatgtcaactttactattatagacgtacgtggaacgcaactaaaaagcaaactctcgggctgtgcttaaggtgagtgttaagaaccttttctcctgacatgagaaaaagagtgacgcggattaatatatgattaattaaatattatctaattaaaaaaattaaaatcagttaatatattttttttaaaaaaacattatcatagaaattttattaaaaacacacattttaacagtttgagaaatatatacgtgaaaaatgatggagtagaagttagaaaagtggagagaagaataaacctttaggctgtgtttgttgcaaaggattcccaacccctctcgctcattgtttcgcgcgcacgcttttcaaactgctaaacggtgtgttttttgtaaaatgtttctatacaaaagttgcttaaaaaatcatattgatccatttttgaaaaaaagttaataattaattaatcacgcgctaatggaccgctccgttttccctgcggagggaatgagttctcatctccagatccgaacgcagccttagagagtttcttgacatagaagagagagaggagagaagagaaaaacattgttggtgagaacaccgagtctaattttgctatatgagggtgaggagaaagaaagaaggataataaagaaaaatgttttggtgcacttcatatggtagtccattcgaatgggtgtcttttatcattgttttatatggacttgttgcataatgatattaggtggctgaatagaatattaattgtcaattgactatatatacatcagattgtgaatgctctaaaccgtctgtgcatgtccttaatcactccatcacgagttatcattgtctatgtgagatccttacgatgaattaatgcactttattccctcaatccttaaatgtgtttaccccgaagaaatttcaatgtctaaatttggttgacattgaccaaaagtaacttgttttagaatatgtattttatgtaacatcaaatctttattgctagatttatgataaactgggttgcaccttttaagcacctatatcccgcaagttagccagaaaaaaatgatggtgattttcttttagataatagaaaatgaaggtgatacttcgatcgatcagttagtaatcccttcatttcatattatattataaatcgtttgatttttttctagctagtcaaatttttattagtttgattaagtttctagaaaaatatagcatttttaacataaaataaatatattcaatgttagatttaatgaaattaattttttaatttagatgtttcttaaacatattaaaaaaaatcaaatgacttataatataaaacggaggaagagtataatatattcgtgaaggtagaagggttcaactaatccatcacgtactgtcgagatatgtacacagaatacaaaaaggaaatgatatctgtccacattcaaaaaatatcttggggggtctttcggtgagaacatacatcgatggacggatgtataggtacgtagtacacaactacacatgcgtagcagacgaccggacaaagaactagacactttggtatcttattatgcttccaaccacctttatctcatgggcgaacaagattggatgttacttctcttctttcagaattcagatgactgaattctagaaacatcgaaaggttacatgcgctcaatcctgctgcatgcaaacacatgagagtccaaccattttaaactactcttattaattatcaaaatgtctagatcattaactcgtgaaaaaacttattatactaattaaggtatatatgttccctaacacaattatagaactttcacttatatcaaaatagaaagaatttagcagcacttaagcaaacaattttaacagtttgtagtagcaatccactcactaccacagaaattaatggtcataactgttgcctcatcattacagttggttttctgcccaaatgttaattgtaaatcttgatgagatcatacatcatcaaggttgactactgttttatttggaaccatttacatgtctaaatgtgcattatatataagttctcagctatttgaatgatttcttttattgttttttcaaacgaagttctatataaaaattatagacctcgatgagatctacaacatcttagtaaaatatcgtttcatttggaattttttatatgcccaaatatttgtttgtattacatgcctaaattttaaaaatttgcaaatgactctggatgaagacaagctttataagaaatttttgtgttgatctcaacgtgaaatctacaactttgttaatgttgttctcatttgaattcatttttagtgccaactacgaattataagttgtggacacgaatagtcaaaacttaaaataatagcatgcgaatttcaaacaagaagatctatattgtagggatggtaaggtggttgtgtgtgaagtgcatgtgaggtcttgggtttaaatctcacatccatgtatgtgtgaatcttgggcaaaaattgtatggctagtgaaatttgctagtggtagtggtagactggtatgcatagtaaattagaaatattttttcttgaacttcttttgttcctaaaaatttcaaaaaccgagacaccactccgctgtcaatgatgtatatatatatatcggttcataaatcggcagtgatgcctttttcggtggtagtggaatatactctctccatttgagatgtcattttagatgcagcagtcgaaccttaaaaatattaattactactacagtagtataagaaaaatattatgatttgacatgtaaaaaatgatattagtttatttgccacaacaatactttcatgcagtatattttcaataattttttaaagtgtatgactagaaaatgcatttataaaaaactaagatgacgccgctgactttttgtcacgcttttgaccattcgtcttattaaaaaaaattatgtaactataatttattttgttgtgagttgttttattactcaaagtattttaagcatgatttatatcatatacatttacataatttttttttgaataagacaaatggtcaaatatttgttcgaaagttaacagcgtcatctattaaaaaaacagagggagaatgtcactagagattcagttgatttcctgaacgacgtctagttgaaaagaaccagaggcagtattgaggagaggaaaacacccattaataaaccatccatgggaagtcctaaaattttcccctatacctagtattgcaagagatcacaggttaatcagagacttcgagagcacacgcttcaataatgctatggagctactatgtcccataaaaaataaatctaatccagaacgttacacattccactactaagaatctgtacagctttcttactagatttgtattactacgatgtatcatagtttttttaggacatatgaagtagacatgatggtgcgaagcaacaagagacaaccagagccacactgatgagggcatcactaactcggatataaccatggataccttatgtaatcaacaaccaaaggtgcatactttctattgttgacacgaaaaacacacactggcctgggagatctgcttagctccagtgcaggtccaaagctttatgagatgcaggcgtgccagtcagtttgatcctataactgacaagatatgcaaatagcagatcaatgagccgatcggctgacaagccgatggagcaatctcagccgaggccgataccagtcgatagcgatagggtcttgagctatcggctatatatccaatgtagataatgatataaaggcgatcggctgatgatgataaataacaataatatagcaatataatccagtagaaaccaataagctaacaatataatatactacaacaagattgatccgaaggttaaagcatacatcagctggaggtccgatatcataaaatccacaagattagatagatcgatgaaacctttgttgttatcggctaaatccaacttatatgtatatgcaatcctataagccgatgcaacatccagataacttatcggctagcaccccgataaaacactagcatgaacctatcggcttataaagatttatattatcaacaacaatctaataagtcgaacctaaccaatgcagcacgagattgtatatgataatctaatactcgatgagccgatagatctgtctaatgtgatggatataacaaatctatttacaacaatattgtgaatgtagagatatatcggctaagacagaagatcggacctaaccgagatagtcccaagtaaaccgatgcgtctctaaacacaatgcaattagagatagaattgagatatcaggtaggcaaatagatcaaccaaactagagcgatccaagagatcgaagcaatgcaaccttaaacaacaccaacgtagccgatagattcaccagggccagcggaacataggacttaccccttcgctggagatcaaactgaaccgatgcagccccgcgtcaggtgccaaattccgccggatgataagtaaaaacctcggtaaagagggtagcgatgcgccaagagtagttgtattgatccagagatatttacaatgaccccgggtgtacatatttatacccatgggaagatactagtccttgtaggacaaaactttcctacagataaaagaaaaaagtctttattggacactaaacacactttcctaaagataaaggaaattaacaaactatttctaattaatagatacaattgccttcttcggactcaatccgcacgtggcaatcctcatgaagcacgtcaactcaatctgacaatggttccaatctcaccttgccagaatcggctacatcggcttaccttgtccgattcggtatctgccgatgcagtcccgaagccgatttatactctgtttctattattgatttccttccaaatccgcttcggccttaactccaaatctgatgcacgatttaccaaatttggtcgttaacatctatatacgatttacatgttctatatttaaataaacgatattgcaccatgagttttgtgtgttttcgtttacagagatacttgcttgggtgaaggaaaagagaccaagcgcaagaaatatatggatgatgaaagaagttgattggggataaaaccaagaccttccccaagtctactccaacattactatgtcaaaattcctaccgagctgtctggaatcttcaaaacaagccttgtacctcatccaattcgagtctgatttgtgccatggttcttttagttgtgtcgttgctaagcccattggggtgtacgttctagggcaaccataggatatcccttatcaaatttattcagtatctgtcataatttcgagtcggcttttgcttagattatttctaccattattgcagtttcgccgctagttcggtttgtgaaactccaaattcgagtactgaatcatttatatgaaattgagttgcaatctaccttgttcttgcttgtgttcttcgatttgcatacatagggattagccttctcggcaaggtcaattgggcagcgcatggttgataaccaaaggagatgtggtgctgcgattgcaaggttcaaatcgtgttgatcggaagtcggatcgtgtgtgtcaagattccaccaaatcgagagttatcagtacctatcggaagatcgggacctagttcctcatcacacacacaatgtggatggaatattgaaataagttttttttaagaagaattgtgtaggtgatatggctacgatatataagacacctgaattgagtttagagttttattattccggctctaatgttagccgagaacacaacatccatatgatcttattccatttcctcaattccatgccaattgggccaaccattatatatgaatcatcaaacctcaattatagattctcttcttaactccaacacctctctaaaaataccaggtctcttcttcaaggtttaaattacccatcaccttctcttcctgaaccctagctacgcacttttagtaatgattaaggtgcacgggcggtccttaaacttatagcggtgtatcatctagatccttaaactctcaaaatgcatatccaagtcccagaacttgtcatagtgtgtcatctaggtccgaaatcaccacagccccttcaggatcctatgtggcgctgatatggcatgtcccacggatatgacgtggcataattttgactgacaaatgggaccgttttaaaaattttctttttcctttttttcttctcttgtattttcctttcttctcctttctctgtgacccgagcagaagaaaggaaaaaaaaaagaagaatgagaagaaaacggaaaagaaaaggaaaagaagaaaaaaaaaaggacacgtcatgtccatgtggcaggttacatcagcgccacataggattcaagaggggatgtgtcgatttgggacctagatgatacgctttgataagttctaggtcctacatatgcattttgagagtttggagatatagatgacacactgctacaagtttaaggattgtccgtacactttactctttagtaattatgtcatctaatacttaaagagggagtcgcccttcttcctccctccaacactttatcctaaaaacttctctcttcccataaaaatatctatcctgaaaaaccgatttcttaaaaaaagaccatggtataataaaccgaacagctcaccctatccaaatccttccacgaaatttaataaaaataatggcttataattaactagtatattaaaaaataaaggtagtaatcatcaagcttagcttcctttcttatctccagcacatctataaataatgacaggaggacggaggatctgataataacggttagcccttaatttattgtgtggccacgatggcatacgaacttctattttttcctgataaatataaaatcgcgaaaatacttagtgtcggacgtctgccgtaagatgaaaaattggatgagaaaactactacttacatccctgtctaccacacatcggtacacactatatgattttcaaaatattttttcttctgaactacgtatccaatctatgatatgatcacactattatatttgttataattaaatctttacaacaagatatcacatcgttaaattccgataaaggaaaaaatatatgtttcaatccgttaaatttaatgtttcagacgtgatagcaatatatttcaacatgtgtcttcattatgtttcataaaaaaatttaaatgtttcaataactgaattttgtgtttcaccacgtataactcaatgtttcgctaatgaccgaaaaagtgtgggacgctcatgtccctactctctctctcctgccattctattagctctctcaccatgcatgcatgtgttagtaaccttaaaaatattttttcttgtaaactacttatccaatgaatgattcgatcacaccgttgaattccttataattaaatttttacaacaagatatcacatgattattggtatttcttaatgacattactagaaatataattcccagcaatggcgcagaaatacttctggtatattatggttacagaattcatccgcaagcgcacggatatactattgtagcatttcacctgagagtattccaaaggtatcgtatttatcttatcccgtaggaagatcatgtagggaaaactcaactaataatttatatattacttgtgataatcatattctaagaaggggttaagataatccaagagtagaatgacacacaagcatttaactactcatcctcataatatattatctaagctaagtggaaagaaaagagaaagagaatctattcctatacttataatatacatagtatacatacattctagctaactgacatactagctaataccccctatccgatgccctcctggtacttcgagaagccacccctgactaccgagttctttacgacagcccgtcatgacccatacaatcggggctaaatacggaggagtaccctccctaggaaattaacttaggattatatataggcgcggaggaatacccgtactgagctgtcaccatcagcggcccacctctcatccgcaatatataaccccaaataatgatatcccgtaatctagacaccacgtctaaactaccagatacaactctaatatcatcgtcatgacatagaataattgcataagcaaacattatacccgcaccaaagcttcacccagataagctagccgtatattcagtataacaagaacataatgtaaagtaggtactcatatactcggagagtatttcaataccataaatgcatgtagaagagtattctaataaaagtacaaagcttacaaaagaggaaagaaaagctgctagagccatacccgaactcttccgaaggcttccggactcctgactcctattctaattctattccaccagctagatactactaaactaaacttgagagaaatgagagagctattgtttgaggtgtgtgagtgaagtgagaatggcaactccttttatagcctcccaatgacggttgtggcggttggaatggtcgaaaatgccctccaaccgtcattgggggctaatccacaccgtctaggcaaagccctggatcagatggcgctaaggagggttcggccgaacctggggccggcccgatccaatccaatttcggctggcggcctcctctgttgcttctctttgcagacttgtgaattttggcccagtttgtcgtgtcaattctgagttcttggcccattcatgcataagcctggttctcgacatctcttattgatttatcgttggtgttgatgtcgattctcctccactttatgatcattctctgcaaaaggttagtaaacctaacactagtggaatattattattctaacaaatatatgcattgaaagcatcactagttctctcctgttttagtaatattgacggtcgaaactgatcgataacgaccgtcaataatgattatattctgataaaagaaaaacatatgtttcaaacaatacaaatttattgtttcatacgcgatagcaatatgtttcaccatgtgttctcattgtgtttcacaaaatttctaaatgtttcagaggctaatatttctgtttcaccatgtataacttaatgttgcaccaacggtcaactgaaacatttgaccgtccgatgtttttacaccatcggacgtccgatctatatctctccttgtaacgcatgagcctataactacttcctccgttttataattttataatgtaaatcattttaacatttcacacattcatattaatattaatgaatctatatatatatgtatatatgtatatatatatatatatatatatatatatatgtatatatatatatatatgtatatatatatagagagaatgtaagtcattctagcatgacttacattatgaaatggagggagtagtatattaaaaaacaaaggtagttcttttcttatctccagcacatctataaataacaggtctcccctccttgaaagtactcatcgggtcatcaccttctcctgattcctaaaccctacacacttgtagtaacttgctttgaagtaaaaaaaaaatggtgtccttctacctcgactccaccttcctgcctctcctcgccaccaccatggccagcccactccacgcctgcctcctcctcgccctcctcttcctcgcgctcgccttcttccaccccggcggcgtcgcgtgggcgctgtcgtcgtccggcggccacggcgccgccgccatccctggcccgc

SEQ ID NO: 75173 - DNA, 624 bp, Oryza sativa
aaacgaactcgatttggtttatccgggcgaaattggtctccgaaaccttaggggaaaggaagaggataaggaggagatgatttcccctcaactaatcggactcgggggcgaccgatagaggcggatttggcagagggaggcggcggctcgggctcggcttgggcgaccagccggctggaggtaggggatggccccgacatgtgggccccacatgtcggcggctaggggaaaggaggggcaagcgggtcggctgggccggcttgggccgctcggcgcgcgcgaggagagagggatgttgggccaaatacggcccaacggcttagaggaggatttttaaaacttttccaattaaaataattcgtgaaatgatgtttcatttattaaaaatacttcccttgctcaaataattcccagaaaaatctagaaaatagataaacaagcaaagtatttaatgaaattttatctagctcaattttatgttgaaatttttcttagattattagagtttaacttgtaggctttaaaagtaatttctaaaaatgatttaaaatatggattattaatttaggcgatttttagggcgtggcatgagatataaagcaatgctagtagctcaaggtttca

SEQ ID NO: 75174 - DNA, 3050 bp, Oryza sativa
cgcttttggaccacataatctccttgtaatcttaatcgatcgctcctgtttctcatcagaagtagcgagagggcaagatccggagaagtaatcaaggactacggaagtgatggacgccgtggaaacgatcatctcaaccgggatcaacatctatgaagcgacccagctgagcgatgaactgtcccgcctgcaggccaccttgcccaaggctcgcttcctcatcaatcgcggcgagtggggcaggttcaagaacaaggacatggcgatccttctgtcgcagctcaaggacaccacctacgacgccgaggatcttctccgcgagttcgatgaccaggcgctgcggcaaaagatggaggacgctgaccggagctgggcaggtcaactcttatcttcctctctaaatcatgcaaaaactttgatccgtggtagcaaaacaaggataaagtaggcccaggagaagctcgacaaggctggggctgatttagagggagcgatcaattcagtgggtcttagtatcgaggcagttcaacacatgccggagacaagttcagtcatagatgtgtctcaagtgtttggccgtgataaagaacgagatctagtgattgagaagctgggtgtgcgttcgatgattggacgtaatagtcaacgagatcaggtgattgagttactgggtgtgccactcaccaggggtgctgctgcacgggctaaagagaagagagcagcagccactgtcactggcacgaaatcagcatcctgcagaacgaagaaactgaagggagagagcagcagggcccctagacttgatgaggccaaatgcatcggcaatgtttctgtcttgccgatttttagcattggtggggtggggaagtctaccctggctcagatcatctacaatgatccaagggtgcaagctcactttggcaagaggagggtatgggtctgtgttccacacctcttcgacaagagaagaattacaaaagagatcattgagtctttcaccaaggaagagtataagccactgctcagtttagatgctcttcaggtggaaatgatggagcagctagggagacgaaagttccttttggtgttggatgacattgggcaagaagctattgacgagtgggagtcattttatgcaccattcaagaacggacctaaaggcagtatgatcttagtaactacaagatttacaactgttgttgatcgtgttgccaccaacaattgtaagcctatccaactcgaaggcttggatagagatatattttgggagttctttagcaagtgtgcattcggagaagagtgtccagaatcatatcctcaattacaagatattggtcggagcattgcctctaggttatgtgggtctcctttagttgccaaaactactggacgtttgttgaatatgaagctgactgtgcaacattgggagactgttcagaacagtgaattgtgggagctgccacatcgagacaatgagatattaccggccctccagctgagctacttatatctcccacaagaacttaagagatgctttgcattttgctccatgtttccaaaagattatagctttgaacgagatgagatcgttgacatttgggtggccgagggctttgttgtgtcaagtggaagcacacgtcttgaagatatggggattaggtatttggatgatttgaggagcaggtttctttttcaaaccgaccccaagtaccctgatcgaactagatatgtaatgcatgacttgatccatgatatggcacaatccgtttatgtggatgaatgcctcttgatgcaagatttgaggtctcggaatgagaggagaatgctacatgtagttcgccatatgtccgtgaaggtggctgatgaatccctgaagaacggaatgagaggcattcaggatttgaacaaattgcattcacttaggtttggaatcaaactcaatgttgagattacctggttcaatcagctctccaacatcctatatttgagcctaaagggttgtaagctggtcaagctacctgagagcataggcgagttgaacagtctccgttatcttgatatttctcgtagcggtgtacaagaattgccgaagaaattctgtagcctttacagcctacaggttgttgatgcaagtcgttctagtctgaaagcaattagtctggatgtcataaagctaatcaacttgcgtcgtctagcattgccagtgagttgctctccaaagttatcagagataagtaggcttggaaatttgtctcgtctatggaacttatcacattttagagttggaaaagcggatgggcgaaaaattggtgagctgaggggcatgaatcagctcagtggaacgctaactatcagtttatttgtaatgttaagaatgataaagaagccgctgaggctagccttgttgaaaaacaatacctccaggaactagttctactctggcgagggcatggcaaagagatagggaagagcagtgagaatggagtggtcgaagccttgcgtcctccaccaagaattgtacgccttaaagtccaaggttttgggggtgatagcttttctcctagttggtttagaccagaatgcctgttgaatttaaggagtctggagctttccaagtgtgatggcttgaaaaatctatcgatcgcatcgttaccttctctcgaacggctaatgctagaagcaaatttacggatggaagcagtaacaattcttggtggttcaactggtggtgaaaagacgaagcatacaagcagcagtagcagcaactgcactgcatgccttagaggactcactactatacgtcttgtcaactgttatcagctacagaatcttgatgggtgcttgtccccggaatacttgccatccatcgagtgcacagagatcaacaaatccagccatctaggactgtcaatacatgtcgatagtttcgtgggattcgaacacctacaagagatgaaaatatggcgctgcaaattggtgtgtccgcaaggaatggttttgccaccctcactccgacgactctctattgtgaattgccgtaagcttgattt

SEQ ID NO: 75175 - DNA, 4660 bp, Oryza sativa
cacggcgcgggagatcctcgccggcgcggcgttcgccgaccgccccgtgaaggaggccgccgcggagctcatgttccaccgcgccatggggttcgccccgcacggcgggtactggcgccggctgcgccgcctggcgtccgcgcacgcgctcgccccggggaggctcgcggcccgccgcagggcgatcggcgaggagacggtgcggcgcgtggcggccgccatggcgcgcgacggcgccgtcggcgtgaggcggctgctgcacctggcgagcctggacaatgtcatggcgagcgtgttcggggtcggcctcggcgagctcggcgcgggcgccgtgtcggagctggaggagatggtggggcaagggtacgagctgctcggcaccttcaactggggcgaccacctgcctctgctgcgcctcctcgacgtccatggcgtcaggaggaagagcagggcgctggcgtctagggttaaggtgttcgtctccaagatcatagaggagcacaagacgaggagagatgccaagtacggcggctgcgacggcgacggcgatttcgtggacgtcttgttggggctggaaggagaggagaggctggaggaggaagacatggtcgccgtcctatgggtaagtacactgatttaattaccatgtgtttgtatgcatggcacgtactttagcaaagcttagtactccaataagattcagttagtaagattttagatttaaacaaagaaatttcttgctaggattttcttgtttcttgtaaaaaaagctcttactgtcatgtagacatgttgtaaggaaaaataatatggaaaaaatgttttcatctctcgaggaaacatccatcatttctagatatcacctaaatagttataaaaaaattaaaaaatttacaaaatacattaatatgagatatatcattccacaaatatacaagtttaaattcgactactataagttataacaaaataataaaataatatatgtatactagttttaggtgacatacaagaaacaaggatatcgtctgtaaagtgatgaaaatccatctccaatttaaaagagaaatcaattaataatttctaagttatgttaatactttaccctgcaagttggttataaaaatttacaataaatccgcagggggccaatgtccaaaacatcacttttttttactcctagttgactaggagctagctacccacatatacacaggacatgcatatgagctagccacaaataagctgcatacgtacgttttaatataagtaataaaacaatatgcctggtcaagtagtcaacttatagtcgtgcatatatagtacctttcttcttgtagtctacacatcggcaagaccatatagtttttttttttctgaacttgatgtgatgggccacatattaaccctttttttttgcgggaatattaatcctttttattattaatattttttgtgcgcctgagtcactgtcaatgagtgagtgtgcatgatctcgtcagtatcttgttcatgtggtcatttttctggaatctgcgatacaacataaggtcactgtcccttaatggatgagctcaaactagctaagctctcactacacgattaatttacataaattaaattgcatgtgtccggttgattgaagcaaattgttttagatgacattaacgtaagagtatatttattacgtactgatcatgacatgcatgtatgattttgacttacatatactaatctgagccgtctgattttttttcttgttcactaattaattagttaactagacttgcatatcgtatacactagggccaattccctacatgcccatgtaatttcacctaatctcttctacgcttcttaaatttatttgatctcttatatacccctgagtttttatatatttggatcccttacatacccattctgttaatttaccattagtttgaccgttagttatcgtagaaattactttattgtccttggtatattgttaaaagctagaaatgttttatgtgtaaattatttgatttgtgaaaaccaataaggaataaattactaaatatttgttatgaatttttaaaaataaaacattatttcattaaaataaaaaagatttattgtaaaaaaagttctgcataaaatttgaaaattatttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaatatcatttagtttttgctcttaattttctagtgaaactaatgtatagatttaatcataatttttaaaaaataaaaaataataagttttattttttaagttgggcattaaatgattatattgctagtattttgtataagttaattttttcatatgaaaatttattgggtaggtaccacatatgtataggatgggtaatataatcattttaaaatatttaacggtcaactaatggtcaactaacggagatggatatagaggagatcaaaatgaaaacttaggggtatataagggatgatgtcaaattcagggatatcgaagggattgagtaaattttcaggggtatatagggaattttctctatacactactcactccgaccataagtatttaacactgttgatttttacccagagttcaaaattataaaatgaaagcaaaaactatttaagtttgatcaaagtttgctcaaaattttaaattattttggaccgcaatatttcaaagtatcgaaaattttgtccatatcgcagtgcccctgatatattaaaacatactttcaacatgaagtttgactattcattttattaaaacatatatgtaaatatcatttattttatggtatttcaaggtgacttatattttttacatatttattctaaattttaaaataaaatgaatattcaaactttacggtgaaagtcaaatgtgacaactattatcaagtactcgctccattccatattatatgtcgttttgattttttttcctaatcaaccttatatatgttttattatatttatataaaagtatagtagcaaatctattctacacccctcccctaaaataactattctacacaccccccctcccatgggtcaaacccacctcccccaccctcccaagggcccaaaaccctcttcccacctcggtcaaagcgtcctcccgctaatcaaacccgcccaccactccctcccccgtcaaccactttgttgttctcgtcttgcaggaatcgtggagtaacaggacggtcatcgggtagtaacaagacaattttcttgcagtaacaacttcaaaagattgtcatgatggatctagtttcgttaagcgttttttatgaacgtcgtggtgcaaacggattagaaaaacaagatatgatatgagagatattgctctctaaagatcgagatgtacctctttttagtcctcgtcttactggaacatcgtagtaacgcaacagccaatctatagtaacacgactgctttctgcagtaacgacgttaaaaaatagttatgatggttctaatttacgaacgccatgatacaaatgggttagaaaaataagacatgacgtatacgttcctactttctaaagattgagatttaaaatattttaactctacaaaaaaattactactgtagtgccactgttagtatgcatattctctgttacttcaatttttgtcatgttgttactgccaaaagtgcagtaacaacctattaattttgcagtaacgtatcatgttactacccttctatgataatattattgttgaattatagtaacaaggtataattcttgcagtaatataaatgatttgttctcacacaatttgaacacacatgcaaaacatacaaacaatgttttttactcacataacatcatatggtgaactggataggagaacttgccacgaactataagatcatgagttcaagtcttgatttcaccaatttatttttaatttttctaaaaaaagaaaagaacaagaggaaaaatatcaatttatttttaatttttcaaaaaaaagagaaaagaacgagaggaaaaatgatagatgggagggcgagaaaaaaagaagaaaaagaaaaaaaagtagaagaggagggcaccgggaggagaaaaaaacgaaaaaaaaggggaaggagggagagggatcggggctgagagagaaaaaaacgaaaaaaaggaaggaaggagggagagggatcaggatgagggagagaaaaacggaggggggaaggagggagagggattggggctgagggagaaaaaaagaaaggaaggagggagagaaaaacggagggggagagggggtcggttggaaggagagaagaggaagggtgcgcgacacgagagggaggaggagggccgcgcgcgcgagtggggatcgggaggactgaggagggccacgcgcggggagggtccaaagtatagtaccattttttaccaaaacaaaaatattaccaacatatatttaatgctacatttaataaaactaatttggtgtgttagatgttaatttttttataaattgatcgaacttaaaaaagttttgatcatgaaaaaca

SEQ ID NO: 75176 - DNA, 2129 bp, Oryza sativa
tccttcttgaagcgcacccacctcccccccctcgccgccggcggccgctcgccggtggcgcggagcatgccgtggttgtccacctgcaccctcacctgctccttcctgaaccccgggagggcgatctccaccacgtcctgctcctcgccggcctgtctccactccacctccggctccacctcctcgtacactcgccgctgctccatcgccgccgccgccgctcgccggagttcgatgtgtacacgtcaactaagcttgcttttgtgacagcgacgtgttgtaataaacattatattacactttatatagatgcatgcaaatgtgttgtgagaatggaattagatagatagcttggattggttgatggagatggcaggagcatatgcaatgcaacctgggttaggttagctaagctaattaaggtagccatggatggagatggagtgagcttgacgccatgggtgacctccttccttggggcaaggacatatgcttctttgcttccaggggcggatccaacgtgaatgtaggggggactcatggataccccggagcaccccttcgattttttcaccataaatgataaactaaaggtccctaaatagctggatattgaagaaactgtgtaattgagcccccccccaattttttttttcctggatccgcccctgtttgcttccttcatggcagatttttttttttttttgctacacctggtgtattggatcttgggtaataccaaaagttcatcatagttgggccaattgggccgcctatatgcttttcaggaatttcagcctatttgttttttttaaaaaaagaaacaattttgaattggcaatacttcatttggagttcttagggagaaaaaaaatatgttagtgctgattttattatcatgtagtattagtaataagcatctgtgtaaggtgtttgtctatgtccatgtggcttggatttgggtaataccaaaatcagaattgggcctgttctgttgggcattggacttccagggacagcagcctttttattttctttttaacgaagaattttgaattgagaatgtttgttttgaaattagttcttcagatttgatatttcttttagctgcaattcctttcagggagagcagtctttctttttgttttaaagaagaatttgaaattgaccattattgtcctgaaaaaagttcttcagacttgatgttacttttagttgcaattccatttctgtttgttttaaacaataattcgaaattgacaatatttgccctcaaattagttcttcaagcttcatgtttgttttagttgcagtttgcaaaggtacttcttcactttccaagttttaaagttgtacttctttttcagcatagttcttcatgagtcttatctcttcagcctacctagcaaaacttagtaatttaggcatgtttttttttttggtgatagggaggaaaccatattgctaatccctttttcttcagttaatcttcttgtcagttctgaactgaagctcaaacagaagggcacaacgatttgtacaagaaaaccaaaaccatctgggactctgtgcttgggtagcattattcagttaagagatgatgtacacatcccatgagtcaagtgtttgcagatcaagcaaccagacaagcaaagcatacgtggagaatctgtttgcatcttggggtggatcaaattctgcataattttttaatactggtccaataccagtacaggctgctgatttgttcacacgctggtcaccccctctgaagatattgttccttggatgattgtccttgctggataaagctccttgcataatggagcacagttaacaagggggaaggacaataagtttcacaagtatcaatcagttatatgatggtaatataaggcataaaggcttttccggcacgcggaaaattagtaggaatgtctcaagaatttcagaaaaaaaaatctcattcaaggagttagggaatttcagaaaattcagagtagaagacaagatcatgtgagatcaatcaactgtacaaaagaggtccccagcttgttaggacaattccaagctgggattcaatgaatagtcctagatcagggtaccaggctacaaaaagagtaaaatgc

SEQ ID NO: 75177 - DNA, 11151 bp, Oryza sativa
gaaatctcctgacaaatttaaggaccgctggtgcattttactcctacaaaaaagtcagtctagtgatcacaaatccacttatactactacccaccatgcattgtgttcatcatttctgacagacaggcactggctcactagaattctcactcctgttaataaatcagaaacttaagttgcaaatggtggttccttcttgagatgatcatcttgatcttccagaagaacttgactggagaagagaagagacaaggtgttgatgatcctactgtaactcatggatcaggagaagatatatagtcacctgtgatagcttatctgaattacttactgcgtggttccaatctaacagtagcatctcctgatgttgagacctcgattagatggatggatgttgaggctaatagttgttcatccgtgtggtgccaatctgacagtagcatctcctggatgctcttgttcatggaatggcgtgtcgtccatgcattggtcaggcaatttgacaatttgttcatcgtctagcagagaggatatatggtcaggaaagagttgatgagataaaattgcagttcgagtacggttatactgccgtcttacctgatccaataattggatggagaatgttgtgccggtaagtaaacagtaacaagttgtgaattttcattatctgctagctagagtgtcagctctgaagaatatatcagcatatgtagaaacatgatgaacattagtttcagctgatttgttttcttgttactgtcatacatctctggtaataatagaaatgggataggttttccactctgtctgaaaaaaataattcagctgatattccaatctcactcacctcacctgctgaattcccatagccaaataaattgattccataccacctattataggggatagaaaggggagaggttttcctctctgtctggccaaaaaatatttcagctgatattccaatctaactcacctgctgaattcctatagccaaagaaattgatttattagacatactccctccgtttcgaaatgtttgacaccattgactttttatcacatgtttgaccgtttgtcttattcaaaaaatttaagtaattattaattcttttcctatcatttgattcattgttaaatatattttatgtaggcatataattttacatatctcataaaagtttttgaataagacgaacggtcaaacatgtgctaaaaagtcaacggtgtcaaacatttcgaaacggagggagtaccaattattgtatcttcagattagtgagctgcatcagaaagtagtatgcatgatggaatcagagaaacaggagtagcagctgcagcatctctcttccaaacctttaaatactaatccaacaatgttacttttgcttaccagataagttaacaccacaatgaattatcaaatcccaaatggtactgaatcaacacaatataatatggcatataagttgacacaaatgcaaacgaccaccacaaagtgataatttagtccaaagagaacataaaaaaggaagatgagaggaattcagaagaagagttttgagtcagtcagtatcaaggtcatgtgattgatgattcagcatcccttgaggctcagtggcctaatgagctgccacttgtcctaatgactccacattttcctgtcaatttccacactaactctgaaacaaagctcaaaacacagagcaaaaatcaaagaccaaaacttccatctttctctctagaccaaccaagaacactgcatttccagtaccaaaataaaacaagaaaaacaaagaaaactacttcctccgtttcagattataagatgttctgactttggtcaaagtcaaactgcttcaagtttaatcaagtctatagaaaaaaatagtaatattttcaatccaagctaattttattataaaaatatatttaattattaatttaataaaaaaactaatttgataatgtaaatattactatatttgtctataaactaagtcaaacttaaagcagcttgactttgatcaaagccaaaacatcttataacctgaaacgaagaaagtacaagacaactacaagttcccagctttctcttcccatttcgattgcggccatctatgccatcaaaatcgtcgtagcttcactactctctcccaatcatcactaagctccaacctcctctctgtcatctcccatggcggccttcttgcgaacgctgcaccggcgaagaacgcgcaatgccgccgccgccgcgttcttggctctcgccgtcgtcgtcgtcgtcttcttcttgtccgtgttcgtcgccacgcggaatgaggctgacatcttcttcagtggcgtcgcggcggcgagctcgtcgtcgccggattcctcgtccggtgggtgcagggagctgcaggcgctcgacggcgatggcgcgaggtgccggtatctgcgggcgcacgcgccgtgcgcgccggtggggtacgtggactacctccggctgctgtactgcgggttcgggcgggcgccatggctgggctacgcggcgctcgcgctgtggctgctcgtgctcttctacctcctcggcgacacggcgtcggcctacttctgcgcctcgctggaggggctctccgccgtgctccgcctgccgccggcgatcgccggcgtcacgctgctgtcgctcgggaacggcgcgcccgacgtgctctctagcgtcgtggcgttcgccgcgggggcacgcggcggcgacggcggcggcggcggaggggaggatgccggggatgttggcctcagcggcgtgctcggtggcgcgctgttcgtgtccaccgtcgtcgccggcgtggtcgctatcgtcgccgggcgtcgcggtggtggcgagccggtgatcatcgagcggcgcgggttcgtgcgcgacgtgtgcttcctcctcgtggcgctctgctacctcctcgccgtgctgctcaccggcgccgtcaccgtctggtccgccgcgtcgttcctctccctctacgccggctacgtcctcctcgtctggacctcgcactgctgcgccaacgcctccgacgaactcgaagtggacgacaccaagcagcccacctccgacctcgccgcgccgctcctcgtcgtcgacgacgacgacgcgtcaccgcctccactccccgtctcctcctcctccaagcccacctccgcgccgagaacgttcgcgcgccgcctcgtcgacctcctccactcgccgctctacctcccgcgacgcctcaccatcccggacatcgcggcgcaccggtggtcgaagcccaccgcggtggccaccgcgctcctctccccgctcctcctcgccgccaccaccgcgcccaccaccacagcgaccaccctcctcgccgccacgctcgcgggcgccctcctcgccgccgccgcggcggccaccacggacgccgcgtccccgcccaagagccgctcggcccgcctcccgtggctcgccggcgggttcctgatgtcggtgctctggtcgtacgtgctcgcgcgggagctcgtcgcgctgctggtctccatcggcgtggcggccggcgtggaggccggcgtgctgggcgcgacggtgctggcgtgggggaactcgctgggcgacctggtggcggacgtggcgctggcgacgcggcgcggcgacggcggcgccggggcgcagacggcggtggcggggtgctacgcggcgccggcgttcaacacggtggtggggctggggctgtcgctgacggtggcggccggggcgcggcacccggaggcgtacgcggtggagggcggggcggcggtgtacgtggcggtggggttcctggcggcggcgctggtgtgggcggtggcggtgctgccggcgagggggatgaggctggacgcggtgctcggggtgggcctcctcgtcatctacttcgtcttcctctgcgtcagcctcgccattctcacgccattgccttcaccacattaacttcatttttcttctttgcaaattgaattgcaaagatgatgatggtgatgatgctagattggttgggttggttggtgtcaagtgttaatttgggtgattagttattaattaattgcatggtattttgttcatgcagaattgggaagatgaaatgctttgtagtagtatatgacttgtcatgaaatgtaaatagaagagcacatatagatgcaatgaaataatgcatagtagtactagctttttcaccggaatggttgaatagtgagatgatttgtaataattattcgagcatatagatgaacaatttaaataccataaagttataaaaatgaatatgagatagtttgctatatatatatatatatatagttttttttttggaaaactacgttatttaaaagttcagaaaacgtgcgcattctattagtctgaaatatatacaaatttccgaaatgttttcttttctctgtgagtacgtactactgaactagtacagcatacagaatgtgtactctacagtgactgaagcgtgtagctcgatcaaacaatttgattagcggaatttcgtagtcattaaatttgtttttagtggctgggccacaataataatttgattttagttggacttgcagagtggagtccttgctgggcttcgttttctagttgcattacacgaacgtgtatgatacgatacgattgcctatttgccatgtgcttctcactctgatacgattcccatatctgacatctagtagtcatcaactatatctaatctcgtggttgtgacgattatattactggtaattagtgacttaagagctttgtaaattacttgacaacgaggcaccagtggtctagtggtagaatagtaccctgccacggtacggacccggtttcgattcccggctggtgcattttgttcttcttttatttttcacagtttttcaaattttggcctgattaaaaaagaaaatttttgggtgttacactatatgtcggaaagagtttttgacacgaatgaaaaaactaatttcataactcgctagaaaatcgcgagacgaatcttttgagcctaactaatttgtcattagcacatgcgggttactgtagcatttataactaatcatagactaattaggctcaaatgattcgtctcgcgatttcctctaactgtgtaattagttttttaatctatatttaatgcttcatccatatgtccaaaaattcaatgtgatatttttagtaaaaaaaagttttgggaactaaaccaggcctttaacaccgagttttttttaaaaaaaatctttttcccttagaaaggagagagttttatacccatcaaattttaattcagagtttttttaattccttctcccttaaaatgaagaggatttttgtaccgtttccgagtcggagcagcagtcttgccctgactatttacgtgcacgtgatcgaactcaaacagtggatggatcgatcacccgggatgtcacggcggcggaggaacgacggcggcgaggccgatggccgcgccagcaagacggcgcggcggcggccggcgcagacgaagatgaagcacctctacctggtgctcgacgacggcgacgaggctactactacttacaccatccacaagctcgacgtcgacgacgacgcgggcattatccacgcgcccgacgtcgaccggccggcgactcggttcgcggcggcgccagcggccggtggtggccaaatgcacttcctcgccatggccgggaagaacatcgtcgcggtcgacggccagggtggcggcccgacggccgtgtacgatacggaggcggccgcgctgacgttcgcgtcacccctcccgggccgtctctcctcctccggcgccggcctggccgtcgtcgtcgaggacggtggccacggcggcggcgaggcgctttacgcgctgacgtcgctcggcgagcgcatgccggcgtcgttcgaggcgctgtcgtgggcgcgcgacccttgcgcatcgccgtcgtcgttgctgttctcctcctcctcctcgccggggcgccactactactggtcctggaagaacgtggccgatacgccgccgccgttcgccgaggaggaggccgtcaccgcctacgcggtgcaccccgacggccgcaccatcttcgtgtccaccaccggcggcggcggcggcggcacatactcgttcgacaccgagcggcgcaagtggcggcgccacggggactgggtcttgccgttccgtgggcagggctacttcgacggcgagctggacgcctgggtcgggctccacagggaggtccacggccgcgtctgcgcctgccaggtcgcgtcccgcggcggcgcgcggcccccggagtacagagagacgctcgactacgacagcgtgtcgtcgtcgagaagcaagaaccggcgccaacgcgccacgctcacctacatgggcgacggcatgttctgcgccgtggagacctgtgagacgccgccgacatcgtcgtcgtcgtcggaaggaggtggcggcggcggcggcgtggaggtccatgtcacggtgttcgggctcaagtacaatcgccggggagagctgcaggcgagggttcgccgcgccgccggcgcgttcccactgcccaagcaacatgtcccatcgttttctcctgtagccttctggatgtagcagctgcttgcagaaattttatttttatttttttatacttttttatgtattaattttattgatataccttttgaaaacatatttccgaaaattttatgaagtagtttgcttctcttgcattacattgtggaatatgatcagatcaatagtttcatgcaaattaaagtcttacatgatgatatttcggccactacacaccagatattgcccccaaaaaaaatgattgcacaaagttaacatatggctggacagtagatttcaccttttctttttatagatgtcccccagcttctattaaacttcaacagatgtacacacacaaaaagcaaagtctactgggtatatatacttgtttacagtacacaacagactcaatattgctatagtaaaaaaacactcatatccacaccaaaacaccacccaacatctgaatccctggaatcattcacaagcagcaatcaacatggttagcagcttctgagtattacagattgcattgatgtttaaagaaagaccttaagcctcttccggattgtgatataaaaaaaaggccaacacacaaaaggctagcgcgtctggtatattagaagtagcacatgcaaaatcggttcatgaacatgcaaaaggcttccaggttgtgataagctccactttcaatatacttgtacataagagaacaacaataaagttgaactggtaagaatggctgtggcacatgcgcacaaattcacagacaaatgagtagagagtttggtcatagtaagggggtgttcgggagagagggggccattagcccctctctaaaaaaaacataagtccttctcatagggatttatgtttttgtgagaggtactaaagtttagccccagtttagtccctccaaccaaacaccacctaaggaatcatgaataccatcacgatccttctgtacagactggccttaagtgactgaaaaaggtgtttcagtgtctgccctgaataagctgaattgtgcagggcttcaattcgcgtatatgaacagagtgttgtcagggaaatgatcagttgagttctttcaatgtcacttgtaaatgtctgctgtcttcgtggtcaaccttttggattccagaatctgtgtggcttttagtgaattgacctgaacattagcacaagaaatcagatgtatcaaacaaatgcgtacatgcgaaggtctgatttttgctagagtctacagattcactacacaccaaaagcagccaatggtataatactataatgcaactaagaaagaatatgaagattagaagacaagcagtactcactttagcgtatatccttgcttaaacatcaccttctggaaatcgcccatgagtcttggaaaattctgtgcaactataagtacaaatacatcctcttttgctcttgcactgtgctgcctgatgtttctgagaagtttaagaaggccacaaatgtcatcagaataataagctttccttcctgtggcaggatcaatgaaatcaagtgtttccttcaaatgcgtatttccatctggagcttcaacacccttcttccatttggtgtatttactgagtttggtcttaattttctcgtacgttggattatctgttgtctccattttctcaaacatgttatggagagacatgaagtgggcagctgatctatatccatccttcaaagtgatatagtcctctgctaaactgtcataacctctggcacaacgatcaatcagctcaatccactgtataatgtccaaaggcaaagtggtgaccgaaacaaatacctcctcgcgagtcatcttcacaaatctatctgtatccttttcaatgtcaccatcctcaagcttgttaatcactccctttgacagattaccaaatctcatgttaccacaggtatccattagaaaattttccgatgtaaaatggccaccaaatgtcagtccagcccagtgaaaattcttgagtagtacatatgcgttcctgatcttgcatttcacttcatttgacgttgtgtaagaaatatgtctacacatattcttctcttcttcttcagttgatgtgcttgctccttccttcggttctagtggatttgtccatggaatctgttccggtggcgacttgacttgaggtgttatggtttgaagaattaacctgtccttattgaacttgcagtagttcctcaggctggtatacattgtttcatccattttgcagacgaaaagattatggtttagatggtatgccttttcttcaaatgccctgtcatactcaagtttccttcttacagatcttctttggtaaccataacatggtcttaattttttgcttgttgatacgatagtgtcccttgcaccttgacttgttgctggagtcttgattagagcttgaatagcctgtaaattatttgccatcacaatgattaactaagatcaattgccaaaataacaatcagcagatgtgtttccatgtcaaatttttttttcacaagataaccaatcaacagatgcagctatttgcctatcaagacattcaaattcagcatatgagcagataatacattctaggacaaatctttaaatgtagcaatgcaaaattagtgctcgctaccttcttgagagagagagagagagagagagagagatgctagctacttacaggtgcatcattttctgggatctttattccttttatatagcagtcgtcaatccattggatgttaaccaccttcttgccttcaccgttccatatcagaacagctccctccgaatagtctccctagcaatttgaattaaatgtcaagaacgaaacatgtgttacactaataaaaatcggtagtaatttttttaccgccatagcaacatgagtgcagatgtcatagtctattgattgcagtacgaagcctcctagtacttcaattttccttttgctctgcatcatttagttcagaatgttaataaaacctggaggaagtaaattgttatcaatggactcccatgctgacaagccagccatattagtggtagaaaccaaaatgacatgctgcacaattttacagggtttcaaaattgaacgcagataaatcttacagagccaatcaacaaaattagatacgattcgactaacaaaattcgataaaggaaccttagatacattagtgaagtatagattactcctctaattcgttatcaggaaaatatatggagataaatcctctaattctttatcagcttgtacccttcaggcccaaagaaagggaaggacaagtcacaaaactcaccagattctcaaatagacaagcagtttggaattttggtgcatactaggaatatggcttgcttagaaggagtaaatactaaggggctgtgtagcagaaaactaagatggactggaaatgagtgattgtgtgatatgttccctactgttgataatcatgagcgtaatgtttcaatcttcagagcactgctttcaggtagaaagaacgcaatcttttcgcggaaagtatataaaatggaacttgttttttaccttgacattagatgagatggcataaatatcaaaatatgcacacgctgaaaatgcagtacgaaaaggagaagttcctgagaagatctggttgacagacacaatacttctgtaaaattgctgatatgttcaatttagtttaaatttcatcattccataaaagtcacatgtgtagattccttaacctgctgataatttgacttcatcctgatagcctaggcaccgataattaatctttaaaaaacaagtgtaaggaacgggatgtgtgctgtgtgcatgttgtggcctgaactaaggcagtaaaaatcaattaagctcgatgtccagttccgcatttcccttaaaccctaactctgcaattcgatgaaattggggaacacacgccgacatgtgaattatgagcaactagaactggggacattatctcacctgttcttttagaaggtgtgggaatccgtgaagtatgaaacgcatcccggcgaaagggcgattgattctgcccccgcgatctgctcccgccgctgatccctcgccgctgatatggcctcgcgcctcgagatcgatccccgactcctcatcgccgcttcggcgtccaaatccgccgccgcttcgggctcctcccccggccgtggatgtatcccccggcaccgccttgttcttgagccccgccgcgtatctccccaccacagccgccgccgccgcaaacgatttctccccatccgcagcggaccgcttccctgtctctgccttgaccttcagccccaccaccggcttgcgctcctccacctcccccgcgtatttcctcctcgaccccacctcttctccatccaccaccgccgcgtcgcacccctcctgcttcacggtggctttgctccgcgccaccgccgcgtcgcacccctcctgcttcacggtggttttgctccgcgccaccgccgcgtcgcacccctcctgcttcacggtggttttgctccgcgccaccgccgcgtcgtacccctactgcttca

SEQ ID NO: 75178 - DNA, 6229 bp, Oryza sativa
catgttctaacctatagatcaattttcatgtgggtgcttggttagaacttgaaataatcccaaggttttgtagcctgttctttatataggggtttttttttttcatgctctcgtgatgcaagtatggggtgtggtttgttctctgggagacatgagacgctaataagatgattattgtacttttttaaaaaaatggctgtggaccatatgtcatatatttgttttttgggattatagttgcaatgtacctttacatgttggagatttatgtttatgttccattcttttttttcaatttgccacttctttgataagccaatcgactatttgccacttttcatctcatatgaccatgagaccatcccacactttcttctcacccctatagtatgacaaacaaatatttcttcctcctccgatacttatttacccctaaagtggactcggccctttatttgcccctaattctatatacctatacaatcaatccccactatatgtagtcaataggattttgcaaccttctcatgcttccgcatcatcctaattgttcttcgatctccatcctatgacaggcaagctgtctaggcaatactaggaatggcgagaagctcccacgtcttcatctaataggccaaatcaaagactagcccaactcatccgacctactgcctaatggatttggattggatggccagatccggccttcctcatctctgactacggcctcccctgccagctgttccctagtcatgactcctcgccaactgtcggagccgtgccgcccgctgccaaccccccatggacgcttgctgctccacctcgcgctggtcttcgtcacctccccttcccaaccttcgtcgcccctctccacgtttgatgtggacgggatgaagcgaacatgtgccttgctaccgtcgtccttggtcgccactcagttttcggtggttctctcaagcggtggcggggtggaggtaggaggaagggtgtcggcggtgctagggtgttgggcgccgctcgtgtcacccatgcgggagcgacgcgagggcctctcagtatagcgattgactaggggatgtcaatgtcccacctggtgccacttgcaccggcaaaaaacattaccactaggatcataacatttggagtgaactaaatacggagagatatcactattaccgctacgtgtgaccggactccctgtatttatagcgctttgggagttaggggcgattccaaataggatttgagcttctctgattgttcgcaacgagcgtgcgtggatggcagggtagaccgtacgtgttccccatgcgactaggttagctatcgattactacaagaagaacccaaaaaaaagttggtgaatcaatagggaagtcaactaaaaaaactcccaataaataacgattgtcccctaaagtactaaaattattttctggtaatatgttgttttgtgacctatacataagacgtaatgatataggctcatgacacaccgttcggagagaggcttgatgtttgttgttagaaacgacaaccgcatacgtcgaaagacgtggttactcaacagtggttaagaaaaagtaaagtatattgattagagaatttttcttgggatccccctattacctggccctatgggactatttatagcccctgttacatgttcttactattagggttttggttatacagggaaatttacatggttatccttatgaaagggacatttacatgggtacatagtgtaacagaggttcatggactcctgatgggccgttaggcgatcgtcggcctaatggcccctatgcttgataggccgaaaaaggcttcttcggccctcgcgggggcgagcttgctttggtgaagtcgtctcccttcagcatatactcttcgccctgcatccttcgcccaagaggcctctggcttggcagagtacccgcacgatcctccgcctctcgccgtccttgttccatagtcttcgccagggggggggggcttcgccccgactaactttggcgtctcgggcttggatccccactcctcgcatagccttcggcagattttggtcgaagggcctcataccataccgccaacaagcccctcatgggcaagggtgagattggagcttcggccgagaccgtgcaaaccatgtggtatgtggtatggtatgtggcgccccctttcgaccgatgctcctgccgaaacctacattgttcctgcaaataaagtttgttgtctgtgcggctggtattgctttgccgctcttcgcctcctgcggacggtgatatatattttttttatttttttaccgggccaaaaggaacagtaatgggccttccctttgtgggctttttactgtgcagcttggtcgataggaatctaccatttcgcctaccctcgcgacacgtggtgctttattactggtgggtaggcgaaccgtcgccttgttgggctatatatgctcccccgttatcttttcaccgctagacttgccactttcaccgcccgcgttctcttcctccgttcttgctttcacggccccccttggccctttagatttctcgctcactccccttgttcgccactgcacacacccttcgcgacttcatacgtccatcgtcatggctccccgcaagcctaacccctcttcggcgaaagggcccgaccccggccggattgacgacgacaccactgcctatttggggatttctctcatagacgacggcgagctggcaaagttggtcagctctagggcgttagtcgagggacaggctttcaccccggggaaagccgttgtaccgaaactcgtcgacaaccggacagtggtgttcgccgtgtttttttgagacggggctccggtttccgtgcaacgcgttgttgccggagattcttcgccttttccaggtggagctcccgcagttgagcccgtcggcgctggtctagattgctatctttgactgggcgtgccggactttggggtttgagccaagcgccgaactctttggcgccatattcttcaccaccgtgaattcgaagacgatgattaccccagctggaacgaagaagacagtgttcgggagcgtaaactttaatgttcgccccgagcggtccgatctctggccggtgaacgccgccatgtcgaagtggggccgccattggatggcgaggtggttttaccacactatccccttcgaggctggttctgactccgcaaaagcccttcggtgccggtgtagggcgattgagccgaaccgaaagcccaagatcgccgtggacggcgctatggaggcgcggttcgctctactgcgtaaggtctgctctcgccttagctgccgcgacttggtggaggaattttgcatgcttcacatctttcccctctcccagtcgtggcaagtcacagttgagcaaggcgaagaggttgatggtttgttgaagttggttctccatgaaagaacgaacggtaagattgctctttcacaatgcagtcctgcgctttgttattttgctttgttcgacgcttaatgtggctacaccctttatttttgtagtgttgacccttgaccaggctgacgccgaagcccgtaggatgatcggcgacgtgtcggtcgtcgagtatagccagctgctaacgcgacaagcggctggccgggcgaaccgggtttacaacggtgaattgcctccccgggcgaacccccacaaggccgacgacgatgcaggaccttcacgaaagcgaacgcgcggacaagtaaagcttgcgcccaggaagcgaagggttcctgtttcgttcgattccgacgctaacgacgaggacgacgttgaagagcgtgacggcgaggaggaaggggaggaagaggaggaggttgaggtcgtggtcgaaaaggccgcggacgaggcggtcgaaaaccgcgtcgacacccctggctatactcctactccaagcccgggtcacaatgagaccggggtggagtcgaatagctccccccttcatcgaaaggagttggatggggcgaaggcgctaattgcgttttcgacaggcaaggcggcgaagggaggtccggtcaaaaatatttccaagaagaaaggactcgtcgatgtcgctcgcgtcttcagcgacgacgagtcttctgacgagactccgacttcgcccgctgcccgcagcctagacctttcgaccgtccccgttctttcacttggcgctgatggagtaggcggtagcgccgccgccggggcttcagcctccacggaacggatcgtgacagctgcggcgagggtcttcggtagccctctgcgtcagccggttgtttcgccgctagtcaaggcgaaggggaagggtgcggccgtcgaaatatctgcttcggagtattcccttgcggcgccccatttcgcccctagcgatttcgagacccgggtagaccttattccctttgtcgagggagtaagcaatcttgtcttacctgccagcaccccgagcctattcaccgaactgaatgagttcgatgagaggtgttctgctattaaaagcttagcggttcgggtatgctttttctctattcttggttttcctcttcttttttacatgtcccataattaacatttgctctcttcgccattcctattttgcatccagattcttgcagctcactgttcgacagagcgaaccgtgcaggcttgtcttgacggatttaagaaccgtcttcgggccatggatgacgaaataggccgcaagaacttggagatggaggccctcaccaacaccctgaaagaggcgaaagccgaaaacaagcggctccaattcgagttggagaaaggaagagaggctagggccgaggtcgatcgcctcaaggccgaactggagaaagggagagaagccatagctgaggttgatcgcctccaggccgaattaaggaaagaaaaggcccattccgccgtgctgacggattattataaccttactgagccgaagatggaggctcttcgcctggaggtcagcaaggccgaagcgagcgctgtggagtcgcagcggttttcgcgggagatggtgaaaactaccgaatccgcaagaacggcgtgccaaacgcttcgcctcgcccttactgacatgggtgcaaaagtgcgaggggtccctaccgaagatgcctcggccttcgacttctccgagtggacccagcaggctggtggttcggtttcggactgcgccactacgtacggtgattgctgtgcgcgtgtatcagcggcctttactatgggtcttctgcaacagttcggctgcgagcacgtcgccgagttccctaactatgtgaagggggactgggagattagcgcgcaggacatttcgcctgcacttcgtgcgtggcggaaacaattctggcagaaggacggccggtccaccaccaaggcgcgccttttggagcaactagcgaaggcagagacggcagacctttgcgaagaagaggacgcggcggctgaagggggtggaggcgatgcccaggtgtgaggcccttcgccctttccttagatttttgtagttttccttcttctttttgtgttcgccaggagtggcgaacgatgtgtattcggcgggctgccgctaaccctccttattgtagccaaaaaaaggggcccttggatattttgaatatatatgactcactcttagccactttttgatggtcgaagtctttggcgtatttatgattacgcccatttcacattatgcaatacatttttcttttttcgcctattcttactatgcaattctccttttgccctttttgcactttctaccagggtgttcgccgaaagttgtgcattcggcccccttctgggagttggcgaaaccaaaacgagaaatttgtggcattaaaagatttgccaaaggtgcgatgcccaattcggcctatttatcgtgaaatggtgataaacggacgcagctataaggtttttaaggttgccgggtggcttcgggcgcaccctaggcgaaccttagaagactacgatcttgttcattcaagatgtttggaggacatggctcgcttttggcgaaaccatcagaagactgatcggcaggaggcgatctcccagcgtcgttacagtctagtctgtatttcgcccccttctcctcttagggttgtgtatgatattagtagtgatgacaaacctagttcgcccaatcactccttagagagagagagatcgcgggggcgaagatgtaatttatctgtaagcc

SEQ ID NO: 75179 - DNA, 2813 bp, Oryza sativa
ccatataaaggttttaatccgatttaatctttaaaaattcataactaattcatttgaactcagtttaatgtggttcaagttgcaaaagttatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattataatctacatgtttgtttactttttatgtactgtttatttggtttttattagtctttttcttcgttttacgtgttagcttgtcgtttccgtcgttgcgaaggttcgcaagtgcgccggaagtattcaagaagattaattgaagaccgattattgcaaggcaagtcacacagatcttaaacacaatcctttgagcatgttgatcctatatttaaattctctatatatttcaactgtgcatttattttcgaatgtcactgggtggtgtgaacctattctttgttatggcctgtttgcattgattactttattccttgataccttgggttattataacttgactagctgggctttatatattggttcagctagatattagatatgattgcttagccatgcttagaaacattagcacataattgggataactaatgtttcactatcacttatggttatatttaatggtatctcacgatggtcaatcgtgattggttaattaattacttgccaactaaaacttgataatggtgggttgtgagcacatggttttgagagtcgtgctcatgacaattaaggactggttcgcgagctactgttgtggaacattaaccgtgccaaccacaagccagtgtgggcaacggctttaccttttgtatagcatggttcattgcggagcaccagactgagaagtggcggagataagcccacgggggtcgctggggagtccatgccttgtttataagggggtgattatgatccaggaaggtgcgctgtggtggattgtgttatgcaaggggtaatgtcacagctcctttccgaggtaccgtggtggtactgaggcaaatggtgacatgatgtggagctgtgtcttgtgggtacagtggtacacctctgatcagagtaaaactattcgaatagccgtgcccgcggttatgggcgggttgagcaatgtttttcgtgattagtctcacacctctcacaataattatagatgttatacctggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaaagttttgctaaatgctgcttttgcaaatgagccaatattatgccatcctttggtatccttgtgcacttgcatatttgctgtgtggcttgctgagtatgtcatatgctcaccttgcgataatcaatcaacctcagttgaagaaaaaggatccagaaggagaagacgtttggcttataccccagttgagctgcctgtgggagtggagccggagcttcgctagattttattttccgctgtagttttcttcatgttgaggactaagtgcctcttaagtaagtatttattcgctttagttattgatgaatctgtatattaaattgtcagtttgtgtacctcggctgattcctggacgaggattttatgcacaaataagttcggaaattactagtgaatttccgggcgtgacagtctaccagggggttcgccgaaagtcgtgcattcggcctcctttcgggagctggcgaagtcaaaccgagaaatttgtggcgttgaagggtctgccgaaggtgcgatgtccatttcgtcctacttatcgcgaaatggagataaacggtcgcagctataaggttttcaaggttgccgattggctgcgggcgcaccccgggcgaaccttagaagattacgatcttgttcattcaagacgtttggaggatatggctcgcttttggcgaaaccatcagaagactaaacgtcaggaaacgatctttcagcgtcgttatagtttagtctgtgtttcgccccctactcctcttaaggttgtgtatgatattagtagtgatgacgaacctagttcgcctgacccttccttagggagggatagtgattatgggggcgaagatgtatttttacttgtaaggtgaattgtatcgtgtgaaccttctattctttcgaagttaataaaaatgtgttttatttccttttcgctatttttcgcatcgtcacattttgtgcttttgttaggtcggaacatgccggcccctttgcgtatattagcgaaataggtgtactgacttttcagcttttcatcgttcgttttcgatctgtagcgttctgtgttgaaagaaacgcttttgcttttatgttgatcgagcgtaacatcgttcggctagttattttctgagacaagctgttgcggtttcaacgttcggcgagcgatgcttcggccgattcgtttcgcccccctggcctttttcgctgatcaggcgtttgccttggggtttttccacaaattatcaatcacacgaaaaataaaaagaaggcggaggacacagagattttatactggttcgggcctccatggtggataatagccctacatccagttttttttctcttttttctctctttctttttttttcttgccgaaaggcttacatagtgccaaagggcttacataacggtatgtacagg

SEQ ID NO: 75180 - DNA, 5811 bp, Oryza sativa
cttcccccccccccccccctctccgaccgccacggctccctcctccgtcgccgctttggcccgcgcctccgcctccgccaccgccaccgccgccgccgccgccgtagcggggtcccatcagcggcggcatgacctagccgcggcgcttggcgaattgggggcgaactgcgagaagcgagcgggaggaggcgagaggcgaaaggggaggggagacgagcgggagggagcggaaatttcgagttcgttgggctattggctacttgctgagctgtcctttcgttttgtctacccggtccggatggggccttgtgggtttttcactttttctttttctttccttttctctctctctgtttttttttgtgacgatgggagtaataaaacagtaaattccttctattttcttgcggtgaaaaattccttcagatatcagtatcacggccaaaggtgccacaaacctactgaatttaggcggttccaaaaacaaaaatttctatgctataacatcgaatgtttgatacatgcatagagtatttaatgtaggcaaaaagaaaaaatcattacacatattgcatataaattgcgggacggatattttaagcctaattgtatcatgatttgacaatatggtgctacagtaaatatttgctaatgacggattaattaggcttaataaattgttttgcagtttcctgacggaatctataatttattttgttattaggctacatttaatattttaaatatgtgtccgtatatccgatctaacaaccaaacccaaaaattttccccaactaaacaagcccttaggtggtgtttggatccagcgacttaattttagtctctgtatttagacactaatttagagtattaaatatagactacttacaaaactaattacataaatgaaagctaatttgcgagacaagtttttaagcctaattaatccataattagagaatgtttactgtagtatcacataggctaatcatggattaattaggctcaatagattcgtctcgtgaattagtctaagataatggatgggttttattaatagtctacgtttaatatttataattagtgtccaaacatccgatgtgatagggacttaaacacgttgaacggtactcccttcctcctaaaatagaaggaattttgggtgatgtgacatactatcctataccttataaatctgaacgcaaatcctttatattttgaggcggagaaagtattactaattagtactaatatttcgttgcggcaacatactgacatgtacatacgcagcccgccttgtcaggtttgccaccatcagccactaccttctcaccacaagctccgtataccccaccgacaacatcgacacaccgctgcgtgctcgtcggtcagctgaaggaagatgatgcccctatgtggagatagaggtggtgtgtggcttccgttttccagcgatggtggtgcggcgaggggccaggaatgataatgataaggtgaattaggcttgggtagcagcggctattcacattaattagacgactgtacggctcgggcatccaatcaatttggagaaaaatagaacgctgatgtcagcgcccaatttacgtgcaaaactattttaaactgatttttctcttaattacttatctaaatcattatccgattgtaccattaaattcgttgcaattaaatctttaaaacaagaccacacatggatatattccgacgaaattttttttagcttattattaaattattttaaatattgcacgatgttcaaccaagtatatcggaattgattcacttagtagatcgaaaatgtttcgcttgtttaaatcaggtgttgtttcaccgtatataaaaataatgtttcagcaaatagctaaagaatgttttagttcacagcaacatttgatccatacgtagtgaaacattataagtacactaggtgaaacatttttcggtggaataaaaaataaaacgaattcccttaataggggttcccaaaatatataggtttttttgttataatgaaatatttcagtttactgcaacattagatctatacatagtgaaacattgtgaatacacttggtgaaacattttgggtaaaaaaaataaaccaaatttccttaatatagagttttcaaaatatctagttgatttgttgtaggtggagacaggtactgtagtgggcctagcggcatgcaccgcgcacagggggcggggtagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcggcacggcacggcccgggcggcccgtcaggccgaaagcgccggcggcgcgtgacagggcgggcggcggtccaacgggaaggcgacacgtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccagctcgaagagatcgagaacctccggtgtgtggcaaagcttcgacgagataaaggaaacatgccccgacggaagggagatatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagagctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtacaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtaagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttaacattaccaaatcattacttttttaaaaaacttttatttccattttttaaataccattttttcattttttaacattagtaaatcattacttttttttaaacattttatttccatttttaatttttttttccttatacatttcctttccttttttttaaaaaaaaaaaaacactgtgcacggcccgtggcccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggccacctctagggcgggggctg

SEQ ID NO: 75181 - DNA, 1828 bp, Oryza sativa
agtcaatccaagtaaggtataaaattttaattatcgttgtccaattctggttctgccttgaattttgggagaaaggtactaccgatgtgctgaccatgtcttctctacattgtagatgagatcattatggtagtgtccagactcgtgaaattacaagtgaaaatatccaaactgaatgaagtttgttttgctataagtgttcatgctgatttaggaggtcagcggtatttttttttttgctctcgctgaattggttttcatttaggtggatactgtgctaaatttattccatagcaaaattctaccttttgtatgcttgcaacagattactacaaattggatcattgatatattaatttatatttgcagactgatcttttgtctgctcaccagcttcacaattgattgatcaagatcagcgggatgcctcacccggcccccgtagtccatcaatcctgcccacaggcaaggtaagttgctctcaatattgttcctccattgatcgcatatattaataagctaattctacaacagccatctacatttctagatgtcaaccatctgtagtgtgtattcttatctttagtgctatttgttgtaaccaagccaaaaggcatggtgtctattttattcatgttaccttcaaaatcctaggccatattcagttacatgtatgttttcagattgaacaaatttgaccaaacatcagtacatatagactacttgagaatggcatgctcatgttcctataattttcaactgccatccctaagagaaaatacaacttttcttgtcacaactgttcagtaatttgcagcaatactgtaacagcgaagagaatggacaaaatggatcgatggtatcagcggtactaaagctgtgtagtaataaactattttttttggttaagtccatagtaaatgaatctaatcttcctaactattcattttttctcacctagactgaagaatgcatttctcttttacctatgtgtattcagaaatatatatgaggtgagatatgcagatatgcttcttctgctttagaaatttgtggaatacaaataatgaaatatggcaggttaaactatccgtgcatatacagtatgtcatcaagccttagatttttttcgagattatcagaaaatgttcttggagaacaagattactagaaaatggaagtgtcataaacatgtctacttgttttcttttgtcaaacagaccgcttttttggattttattttaaaactttgtgatggttaataaatcttgtttttttttgacccatcaagctggagaacctgatggttagttcctgattccattcaacagggagtctggcctgctgcatcggtcactgacacagcatgcggtttgccttcctcacacccaagctcctccaatctccttaggatttcctctttctttttgttttcttctgtgttttctcctatcctcctatgggttgttgtggaatcaggggggcctatggctgtaaggccctgtttgattcagcttaggattattataatctagcttataggagtaaactgaaacaaacaaatagattattatagcagattattataatctataagccagattattataatctaataagctgctttaaaggagctttttttagattattgagtggctaaagacccactacccttacatatttgagaaaaattacccatctatgccatcaaccgaatagatagctgagggcattatagactttagcctttcaaacccaataatccatccctccaataatccagacaaacaaacaactcacagcttattttatatcagcttattataat

SEQ ID NO: 75182 - DNA, 2040 bp, Oryza sativa
tccgagtgaactgcctgttttgcaatctaatgtgttttagctccaatgtatttaaggttgccttgaagcgccccattagacgccagttcaaagcaggatgtggatagtgctagcaaggaatgcccatagaaaagaatatctccctcactattgctcagaatcctatctaatttgcttagaatcgggtttccctgctcattactccaagtgaactacctgttttgcaatctaatgtcttttagctccaatgtttttaaggttgccctgaagcgccccataagacgcctgttcaaattctggttattcttatccctagcctcatatatgatgttgaagtctcccatgaccaaccatggcgtgtctgttggtggcttggctgcgactaattcggcgaggaaattttccttgtcacagtcttctgagggtccataaactactgtgatgatgaagctgagattatcagttatggtcgttgccatcgctgaaagatggtgtgttccttgggagaaattcaccatgttaacaattgtgtcatcctagaagatggcaattcctccacaagttccattggcaggaaggaaattgaagttcgacagcttgcttcccccgatctctttgccgatccattggtctatacaacttaattttgtttcttgcaagcacaggatgcctgctctggccagctcggctgcttcgaggactgcctctcttcgtgctgggttatttagtccgcgaacattccaattgagaattctcagatgttgtaacatttgggcgaagtataacacacaattttttccaaaaggatcgaccccataatgttttccaaatgaattagttcataagcagatagagggctacatattttcttccatgacctacaactacaatccaaacatggccatgtagaagcaatttcattatcttctagcctgtctactctgctactaaccggctgaaggctggtgcctaccgggagcgctattcgcatcaatcgactaaggagctccggcttaaggccgttgcagcatgggagcgctagtcgcatcgaccatacagcgagcagcggcttaaggccgcagagaaatgtaaaggatacatgcagatgatgatggaagaccattcctgcagctctaacactgatgcggacaatcatgacagctgatgacttctctcaggccgcgacagcgcgcgcctcagaccaccatcgttgcggtggttccttcctctcctggcaccggcatgtcgtgcactccatccatgcgtgtgagcgcccgcagaccggcgatgacatgcgacggaggcggtgtgtcaaaggactttgcataagcccctaccgccgcatccccgaccggttcacccggggtgagcagccccatctcctccatgaggcgcacttctgcgcgcttggacaccggcaccgatgagaagcgcgccttatggccgctccaccgcgacggcatctgcatcaccttgcgtccgcaccccttcgtcttggccacgccgggcggcgctagctcgagcggcgcctgcaggatgatcggtggttgcagctgcgagaacagaggagataagatgaccttttcacattcaccttctcctccgtggatgggctgagtctggaccatggcctggtgttgctcctcgcagtcggcctgctgcaccagggtgggctggtctcctatggaagcttgggcctcgtcatcttgagtggactgagtgaggaggtccatcttgggggcctgctgcgcatctgggccgagatggcccatcttcttctggccaactcagctgccgatgccaccttatcctctcccagtatcgctttttccccacccgtcctcttcgtctcgttctctgcctcccgtgggaacttgggagcgatctctgccaggagcggcagcatcgggtcgtggcccccctggtcgtctgagaaggggagcaggggtgaggagcataggatctggatcagagggcaatgatgtaatgttgaaggaaaatttaaatttaagcaccattgtaccctctctttcaaacact

SEQ ID NO: 75183 - DNA, 635 bp, Oryza sativa
atctaccacgtgcttgcgctcacacaccttgcgtacctcattgaagactatattgttctttgaggacatgtactgccagtctagccacttcatctctaccactagatgagatcttcccatgatcatagagttataccaatcaacctgcaccaaggtcctgaatctgtcatcctgagagtcagctggcagagtatcaggactaaccattctgtcctttccacactggagtagattcttcagatagttcactcttgtgcgtttaggatctggatcaacagcccttgtcttgtacagcctcaaaggattgcttttagaacccggctcatcctcaatgccaccatcatctgactcagatgcaccttgaaaggaagagcggggtgcatcacgaatgacaatgctaccagccctcctggaatggatcggaatctgactcccactgtaaaaaactccaactttttttttgtcccaatctccccctaggaccacgaaccggggggctcgagtcagcaggaacatcttgagaaagcttctgtctcttctcacgaggcataatgaccactgcaacaagaatcaacaaggttggagtgcaatggttaaatgaaacagtagcagaatcaaggttattggctggctgg

SEQ ID NO: 75184 - DNA, 654 bp, Oryza sativa
agttatatggacgttgtatcgacttataaggattacatacgaattggatttagccgattgcaacaaaggtttaattgattaactaatcatttggattttacgacattggacctccagccgatgtattctttaaccttcggattagcgcttattctatcatatcattgatagccgattggtttccactgaattatattagttatgttacattatcatcagtcaactgtctttatatcattatctacattggacatataatcgattattcaaaaccctgtccacattggttggaattactccatcggcttgtcagccgatcggctctttgatcttcaatttatatatcttgtcagttgtaggatcaaactgactggcacgcccgcatctcataaatattctggaccagcgctggagctaagtagatctcccaggccattgtgttcatcgacttagttcgggccaacacagatctagcaccatcgaccaagcacggattttttttgtcaacaagagggaaagtgatatcaccaaagttcttgcaaaataagttgtttcccaaagttcgaatccttgaggggattctacgctccgttgaggagctcacaaagagccgggggttagctaactctttcctcaagaggttgcacaaagcac

SEQ ID NO: 75185 - DNA, 609 bp, Oryza sativa
agggcggatatggcggcagagagggcggtggagatggcggcggagagggcggcggagaggttgaggcggtgacggtggagatggtggtggagaggacggcagcggtcgagagagtgagtgaggaggcggtggtgaagagggaggcggcgatggcggtgaagagggcgaagatggcggcagatagggcggcagagatggcggaggagagggtggcggagaggttgaggcggcgatggtggagatggcggcagagaggacggcggcggtcaagagagtggcggcgagaaggcggtggagaggtcgaggcggcggtggagagggcggcggcgaggagggcggtggagaggtcgaggcggcggtggagagggcggcggtggggagggcggcggagatggtggagagggcggcggtgaagaggtcgacgcggcggtggagagagtgagtgagtgagagtgggtgccggatctggatcgatctagaagatgtccaaccctaggtcaaccctagtcaaactcacttgtgacgggcgccaactatgtggccgtcacaggtggcctcacctgtgacgggcgccaaccgtggagccgtcacaggtaagacaacctgtga

SEQ ID NO: 75186 - DNA, 4670 bp, Oryza sativa
ataaaaaaaagttattatctgcgcgtgtgagaaagagatagcaggcctgatctttgtcaagtagaaaaatgctaactgtctcaccattagtgcagagtgtttgatctgcaactaattcttgaagtacggtgattctcagaccttcgagctaaactactgaagaaccgaactctaattgtgagtacctgtttaatttttgtctgaagatacaaatttgttcgaaagtgactgaaagagacataaaattcaaaataaaaatgaatctaatctttttgatatattttcctctgttgcactatagcatccatcagtgccattgagttcagtttcatgttaaaattaattagtatatagtgttgttggttcagctgaattgccaaaatataggatgccatcagtattttattttttaagctctcccgctgatttggtttcatttcatttaggtcgatactgtgctaaatttattccaaatcaaaattagatcttccccatcaccaccactctccatcagtctcatcctgctctctgctctctccaaggtgagtattggaaaccttgtcccgtggttatttcagaaatggagaatttcgttcagctgatgaattatcccttgatcatggccattataaatgaaataaatgcttaattgcactatctacatgatataacttctataattggattttgcttttctgaatttccattatgacacaaaaggtatgccagtataaaggctgtctgtttcagtggaagaaacagagaatgattaggatgggtgcaatggttatgtttgctttttgctaaacgtctgaggtttgcaacaatagcaattcttggctcatacttttttccctcacaatattccaaactgttaatattgcatgacggattcatttgttttgagttctaattagtgaactgtacttgaatagtttatactactgagaaattaaggtacgggcatgaatgataagtagttgtgagttgtgaattgaagaggtgaagtggagaccatcagatttattttggtcctttatatttttaatattgtcatgcatctgtgatcagtttccggggtttagattcattatgttctatatcatggttaattattctatgggtcttccgaaacatggcacattgccacacatcctatgttgtgttctatatgttatcaatgagcactgtggatatactattttggaaactgctttgtgattttcacttctatatatgtgtgatatctatactgattcgtttagttgtctcctacatacaagggacaaggtggacggggagctgaagctgtgtcaccttctctccagttgcatcggcggataaaattgtgagggcaagaaaaatatttgtactcttttcaaattagtaaattaatgcttgcaggaataattttgaaaatttaggagtactacttgtaaataaatggaatagcaaaaaaatggtagataacccttttaaatgatagaagagtattaccacgcaggtcgtcactacgacacaattagcaatataagatcattttcggcctcttctaatttgcagaagagatgacatttagcccattcacacctttgcatttgtgaccaaataattaagaggcctgaagcataggaagatttcaatagttgcattgcgtaaaactctcctgaaactaaaagtgatgtgttgctgatctcgctttatatgccgtgcagatcctactgaatccattgatttccaagagttctgcaataagaggtaaaaagaaaagttattatcagaggcatgagtataataaataaagctcctcaacaaaactggaatgaacaatctgtgctatttatctcgtaaatttctgaacttgctatgagtagtagctgtggatgccattcatttttacatctctctttgaatatgctgtgtattttcgtggaaacataatattatagacttttgtactcctcaacttcacttcgttagtgattcatggtaaaatcttggtatcattagagctgcttatggttacagcatcaagttatgattttctccgttgtcaaattgattgcacagtgattttgactacaaccatagctgatgcaattaatgggtataacaacgtagtataatctctgaggaaaagtaatgcagtttgttgtcagtatatgcactactgaatttgggattatgcagcacgtcaacagcaggtattcttattggtcgatttaatttgttatagcaaggcaaggagtcgcggacctgaccatgaccattttttaagtacatttgcacaaaattgagaagcacatgtacccattgatgtataaataagaggttcgtagctcaatccatatgaatatactttcttgaagaagtttcataagtataacgatttttcttccaccaaggagatttataatgtaaatctaatttgcatcttctgctagagagcttcctccagtagatgagatttacagaatgtccagcacagcgagcctgtcatgggtcgacgagctgcttcagtgcttctatccttcagcatgcagcaagttagatgtcgatccttggtgagcattgaccatgcttcttttttcttgttttggttagattaattcaaattgttggtactcatatatatagcattttgttctggtggacgtgtgcaggcaagctatttgttgtagtccttgcaagataaatttattactgtgtgttttctattcctgttattgaacatggtggaatcaatggtaatttcagactcagtactatgctggtgctcagcaatcaaaatcattgccacgattaagtgcgtatgttattttctgctggagattaatatgttttaaactaggaatgtttaatatgtctaccatgattaatatgtctgccttccaaataatttactctacgagctccaaacaaataactttgcatgataaaattgctatagtcatcatttcttatattttgtttactcaagtatggaagtgcttccatatcatacttatgaaatgtttatctcatgaataacttgaaagaatcttatggcatgacagtttctaagctatttattgtattttgttatttgtccagctgagtcgaaaagcatgatcaaggaacatctacagaatcaattgtattatgcagtttaaacataatattttgtcctgtgatatagaggaacatttttctcctctaagggctctatgtatttggtcttctattttgactaattggagatccttttgcatttcctttagggcacaataaaatcacatgacataagcaccagagagatgatgacctttttggcacgggggtaccaaccaaaaagtgttgggttgattgtcgaagctgtccagtgtctctataccataggtgagaaagaaatatggatttgcccttttgcatggtttcgaaagatggaaaatttgggatgttatttttagccatgtggctatgtaattaataatgtaataactcgtgatatcattcttttctttaatattaatcatatctcattttatttttgattgttgaaacatatatattctttttattgtttactttacattattaaatgatttcgttgtgttagcacgggcaaatgattcagtttcatgcatagacggtagacctattaatttctaattttctattttgcttaatacaagttatttttaaatcagctccaaattcatagtatagtgtacaataatatgtaatattttaacttgtacttcataccatgatgtactcacgtaaataaagacactcttcctgtcgatatgaatgcagtccggtcatcaagaagttccaaatgtaagggcagtacgcagtcgtcattgcgtttcaatttatttagatctgtcaaccgcttaaccataataatttctttggataattattattttgtcatatgtaaaattatgaaaataaatgatgtgagttggcgtggaactggatgtcaatttaatttagttaattctggtcaagatttattatgcccatgcaatatcatatttttgaactttgtgtggaatatatttgatgtacgacataaattgaactaaagcttaatgacatagatcatataatttttttttgctaaaatgaaatttcaagttactaaagacaatagaattgcaccgtagcgtttagcacgggcatattactagtaaaaaaaagacaccgtttatcggttcgacaaatatccgtgaagaaaacgagcgatgaaaaagaacaccgaagccaccgatcgaaatagccattttcattagccgctccgcgtacacatacataatagagaaaagtacagtacagggcaaccaggagataatcgatacagttcgttcgtactggcagccaatttgaccacaacctgctcaagaatgcttcctctcccatttcccttctcgacgctccctgcgttctactacaacctgccttgaggttgaggttgaggttgaggacgacgacttgctgccccgagaaggagtatgcctcgtgccagcttccaaagccgccgctgattctggatctccgacgctgctggcgtcaccacttccctcagcattctcctcataataatttcctcctgtgctagtacgctcgtcactcgtagtacgctctcgaggttgctgcagtattgtgggaaggttgcctgaaaa

SEQ ID NO: 75187 - DNA, 2295 bp, Oryza sativa
catatgcgcgggcttcctttctagttataaaaattagagatgattatgtactcacaccctcttcttccatcctcttcgtccatcattcaagtcaccattggatcgggcgatacaaaataaactgagtgatttattggtacatcatctgactcccctgcttgccctcgtcgttagctttcgcttttgcaccgttaggcgttgcacacatccaattcaagagtgtgttcgtcttcgcgtccgcctgtggttctcacatgttcacgtccgtggtccgcctacgaatcgttcgtatgtgtcgccttggaaaaggaggggaacttcaatttctcagcaaactttatagatggaagaggtgcccggctgccaacacaagtgggctggttgaggcggcagcatcctcactgatggttgttcccataggcggagacagagaggcaaacggtggcgtgtaagcgtagtctgcggtggctgtgcgcgagagatcgggagctacagggtgaaccaaataagaccaaatccaagcagtagaaaggaggaagagctagatccaacaaaaccaacctcatctagctgcaccaagctcattgaccaagacctcattgaatggatggtggtggattttgccggacaacaactcatgatgtcgttaacccggagcaccgcgcccatcttccccctcttttgtttctggccttcaactagggaaaacgatgaacagttgtcgatggggaatacccacagaccgtattctgaaggtattagggcatgttgattcgaggatccacacaataccacatcaaacacatattcccaacttctctccctcattttccgcgcgcacacttttcaaactgctaaacggtgtgttgtttgcaaaaaaaaaaaaattctatacgaaagtttcttaaaaaaatcatattaatccttttttaaaaaaaagcaaatacttaattaatcacctgctaatcgctgctccgttttccgtgcctcccgaacgcaaccataggttatactaattcaagcccctcgtaaggtaatagccctaacccagtttatagaggattacgaagaaaaccacatagtacaattgtcacgtacagaaattcatgaaccataattctaatgtgcattaaaacccttgtctagaaccggccaaggtacacacaacaaagttgatatacaaattcacatcttacaaacatattgaagtcttacatatgcaatgaaactaaaagcgagctaaactttgtgatcacaaatcacaataactctgattttaggaaatcacttgaaaatgataaacataacactctcaaaaccatatcaccactgacttagttaagcttttcaataacacgcaaaatgagataaatcattagcacatgaataattaagtattaattattaaaaagttctaaaataattaagtgcacactactttcatcaccatccttttagttgaacaaatgaccatgtgtttgtggtctccctatagttcaacaaatccttttactcattcatcattcatcatatcacatatccaatggtctaaaatcatccaatccaacgcctcagattaccccacctctccccctcctctccttcccgcacctgaaatggcgaaatcacgccgcatccaccgtcctgtgtctcgctcttccctcctctttctcccgcatctcccacgcatttcctcctcgcgctctctcgcccccgcaccgtcgtgcactcgtgcgccggatttttcacagaatcgacgcgctcctcctccgcagtccgcaccaccatcgtgccgcgcgcctctccctaccgcgaaaaaacgccgcgctggtgcccaccatcgtcaccgccgcccatcgctctccaccgcgcccccattgcgcctgacgcgaaggaggagcccgaggaggaagaagaagaacaatgaggctgacgccgacgcctgcaggcaaagaagacgaccgagaccttcttgtataagggaacaccgaagaagtcgtccacgcgcgggcgaccgggggcgaaccctagtggtctccctatagttgaacaaatggttttattcgttcatcattcatcatatcacacatccaacgatggaaaacgatcagatgagcggcatccgacggctccccactgcctcatcctgatcgcgtctctcccccacgccactcccggatcagcctccacagatcgcgcctctacgccccctcctctcccatccgaggaaccgccgcgagcccgcgatcccgtttccccgccctctgtcggcagcacccccctcccccccggggc

SEQ ID NO: 75188 - DNA, 6302 bp, Oryza sativa
tcttgtagtttagaatgaacataatgctacagtatgccttgctgctcatgaactgattgacaaaatgtctctcaaggttatatctgaaattctgagcatgttaatttgtgtctcccagtaaggttctgtcatcttctgtcatccattagtgcccaatcaaagaacttgcatataataacatatattctattcttttaaaaaagcagaagctattatctgaagttcagctctcagtttcacagtaaatttacataattaacagtgcatgtaatttgtgggtactcttatataggaaaggaagatcagcacaatactgacgggtttctcttcaagatgatcccgtggttctcagttttctgctttctacactgtctacatcttatatgtgttcattgaagctacagattgatggacatagctgtcaaacctgaacctaccaggcctcctggtcatgtttctcctcagctctcatcacatttatatgttttcttacccaattccatacaaaaaattttaccaaggcagacccgttaattttggtatggatcatgtgaattttgaagagaatacgtacaccgttaatttattcatgcattctgctttatactatagtctacccaatttattcaattattctgctttgtactgtggtctagccattttattcatttttttcgcgttgccctccgctgtcgtccaggaccgtcgcccacggcgctggcgacgattcaccgccgacgtcatcgtccaacaccgtgacttggcccttcgtcctccatgtccaccgcgccctcgccgccattcataagaacaacattgcagcacccaatctgtggcaccccatcgacacatacgaccgcgtcgccctggctcatcgtggctaaccccaccgacgaggtaactagatttaccttttgcttttgttcgattgtttgacggccgagcaacagggatcgcgaccagtcggcaagctgactgttttggttaactgataagtgataactgaggaatttaaagctgtgtgtgcttgtcatgtgctttcgggtagctgttcttaaccactgccaaaagtttcggaaggtgatagaaccaaacaggtagttccttagctgcctgtgcagtgtgcagtgtgtctctggaccaaaggttgtaaatgttgcataaatgtttttttttaaaaaaaaatccagttgaggtactcttgggtccaaagccataaatgcataaataaggtccaaaggcactaatttccattgctagctttcttgtcacttagtttcattacatttgacatatacccagatgatttttgttcttgtttgtgtacaggttcagagttttttatgtaataattactctctttccatatatgcagtacatttttattacacgataacatcagtgttaatgttctatatggcattactatcattatttttcaacttatgtcatgcatatcattccatatcttttacttctcttttattatgaaaatgacatctttctgattcgttgagggcatgcggggtagtatatctgttattttaatatattcagtgttttcatcaatatattgaccaaatattcggtttatatcagtaaagggccatgttcttttcacaagatctgtttctgaatatacagactgtgttgcaacatttatagaattcaagttgtccgtagtcctgctttgcatgagtaaatgccaatcttatgtgtctgaactcttttcttctgtgtctgaactctcaagtgatgatctatgtttcccaaaaaatcttatgtctagcaaacttagtttctgtttccaaatgaaaaatcaagtagtgaataatgtacctgtattaaatgcactggtctcttatttagtaatgtatctagatacatatgctgaatttttatatatagaagcatatgttgcttttacacatgaaggtgtatatgctatcaggtttctataatatggttcataagtgaacagcatcaaatgtctacgttactttagtttgaatgtacacgctgatataaaatttagagagcattcttggaatgtacatactgttaagaaaatttagatgaattaaatccttatgccttatatgttttttctcacacagttgtaagtttgtttggagaaggggacattcacaaactgcttgaaagaggtgttttggtatctcaatatatggtggaatatttactactgcttttagtaactcctagataatctttttttacatacatgcataactaaatttgcatatatcttcatgtgcaattgcgctctctgatattacaatggtaggatttgtctttgaattggtatagtgacgtatttctgattcattaagggcaaactggggagtagaactgttatgtgcgagatattcagtttatatttctaaacttgggtgcactttgaatcaggacgaataggctcagttgaatctgtttttaggatgatgcttactggattgccaattttgaagttccattcagatcaaatattaatgatttatagattcaggtttgtctgaaaacgatataaaacaatatgctttgctgaacttaatactgggagatcactagggtggggtagacggccttcatggcgtctaggttctattgtggtccaacacatactctttttaccgatcctaatagatttggcataggtttatctacatctgactatgactactgtatattcctcaaaaatcctattagtatatgttttctgttctgactcgtctggttgtctcttatattaaaggtaaggaaattgaaggagttgtagctatccaaatacatcagcttctcaaaatagaagagctaaatatactagtaatatgcccgtgctaacgctacgtgtatgtttagtaatagaaatcatgacacatagtaaagaaaagataaagattaggaaaggagatgaaaattagattgaatacaaaaatttagggacggaatattcagtttttgttagcaataaataaataaattatgggccgtacgtgtggcttcagattgggccgctccaaaacccagactctggacggctccgtcacaagtcacgccgccgccgccgccgccgccgccgccgccctgcagctccgctcccccggtctctgcgcgtctgccccgacgctccgctggcccttccctcgcttgctcgacgccattgccttccggccactgcctcgtgccttggcctgttgcggctcgtcggcgccctccgccgtccgccacctccgtgcctgcggctccaacgccttcttcttgcgtgcggacgcctggagggcaggtaataacaaagctcttccttctcccagctcctctccaactccagtggtgctggtgctggtgctgtggcggtggctctcccacatgtgctccatttgatcttcttctcctctttttttttttttttgtcattgaaacatatagcttactgtatttaaagaaaatctctatacattgtagtgggacgggttcagcatcggcaattaatcgtgtctgatagaaattgaaggatgatgaagtttcatggttactttcctttattcatgttttcttctttggcaattatacattgccgactcccactgcttccagtgttgatagttacgccatataccgcttaagcccaacaaaaaaatgaaatcattatttatgttgtcaattaattttgaaaaactgttactatgaattattatgccagatttagattttattgctcaaaataaatgcttatggttaatcaatagtacagaccacagatagagagtagtacaagcaaatccaattatcaaaggtttccttaaaaagtggatttcagttgttctaaattgaaacaaggggacttgtaccaggacttcaagatttagatcgtaagaagtggaaccattcatgtttttatcttctttttttttccattgtgttctggttgttgtaaggttttcaaagaattgaatcaaaatggatgggacatggtatagtgagaaaagttgacacccttcaatggcttcgatttgtcttattagttgtagtattgaacttcgaattttttccacatactcctcatagatttaggaggcgttgatatgatataaagaacaatttagtttgcattcctggttgatttgaaatcattccactgttgcttctcatggttgatttgaactgcagtgtttgtgaatacaaaaggtacaaacagttgctcctttgttattattcttcctttctcattctctcgtgcgttctgacaatttggtaaacctatagtcatgtctatgtgtgcatctgttgcagctcaaactattttcatgttatacccccttatcacacataaatagtcaaaattttcctactagggctagtatttccgctgttgtcctgagattgacatttgaagtgaaatgatgaaatggacattcacagtcacatgctcaggtggataatttgtaagcatcgcaatgctttagtgctacatagaacaagctttgggcatgaatattgtcactgggagttgacaattgatcttgcatgatgttaggttgttaaaaccccaataatccagataagaaggattttacaggatggtaggatactacaaactacctttgattctgcaaccctgatggatagcatgcctattcccctttgtgatctttgacttattcttcctttacattacattggtttgcatgagattgatgtaatatgtatgatggcttttgctaattcagttatttttggtcatacagtgatgcaatggctgtttctttgaggattcattatgcataatggtattctactgcagctatgcttttgaacttgcctaaggcggtaaaaccaattggagaatggttcctttcaggtgcaagggcagcatgcattggtgtagatgtttatcctagtcactttgcatccctattgaaggaatgcaagtctgcaaatacagttcatcaaattcaccaacagataattgcttctggtcttctttctttgcccacaccattattgtcagtctcactaccagcattgccatccgaaccatttatatctccaagatctctgggtactggtgtcgtagcttcttatcttgcttgtggtgctaccgactatgctctcttggtgttggaacgtgttacaccgtcaccagctgtgtggtggaatctacttatccgagaacacatcaaacaaggccgccttgacagtgcaattaatgtctcttgccgcatgctgcgtgctggaactaggccggaccattttactctaccacatgtattaaaagcatgtggagagctaccttcataccgttgtggtagtgcattccatggattgatatgctgcaatggctttgagtccaatgtcttcatatgcaatgcgttggtggcaatgtattcccgttgtggttctttggaggaagccagcatgatctttgatgaaataactcagaggggtattgatgatgttatctcatggaactctattgtttcagcccatgttaaaagtagtaatgcttggactgcattggatctgttttcaaagatgacattgattgtccatgagaagcctacaaatgaaaggtcagacatcattagcattgtcaacatactccctgcatgtggttctctaaaggcagtacctcaaactaaagaagtccatggtaatgctattcgtaatggcacatttccagatgtttttgttggtaatgccctgattgatgcttacgctaagtgtggtttgatggaaaacgcggtaaaggttttcaacatgatggaattcaaagatgtggtttcttggaacgcaatggtggctgggtactcccaaagtggcaactttgaggcagcctttgagcttttcaagaacatgcgcaaggaaaatatcccattagatgtggtaacatggactgctgtaattgcaggctattctcagaggggatgcagccatgaagcactcaatttattccgtcaaatgatattttctgggtccttgccaaattgtgtcacaatcatctctgtgttgtctgcctgcgcttctttgggagcattttctcagggtacggaaattcatgcctactctctaaagaactgtcttctaaccttggataatgattttggtggtgaggatgaggatcttatggtgtacaacgcgctaatagatatgtactcaaagtgcagaagcttcaaagctgcacgctccatatttgatgatatacctctagaggaacgcaatgttgtcacctggactgtcatgatcggggggcatgcacaatatggggactcaaatgatgccct

SEQ ID NO: 75189 - DNA, 21076 bp, Oryza sativa
attcctgcagccctgctgttcttgcatttggcgaagcatgtcttagagtcgtgtcatgtactgtcgcatggcttccatggcggcttcggtttgtgtctcggggtcagagttgacttgggcttgcacagcggcgagcgcagttggggctgctgccggctgcgacggagcggcttggggcaccagtagttggtttgtcgaaaggatctccgccctggtctggagtgccctcgccgccgcagccgccttcgccatgtcagccgcgttcggcacctgcacagaggtagcaggggccgaaggcggtagtgatggcgcaggtgcggaagcagatggcgctcctccatcttcggcgacaggcgccgaaggctctgctccctcttcggtggccatatccgccccggcgtcgctttcctttcgccttgtaaccttctcctttacaaccttcttcggtggcattcgctctcagtggtttcgctcggaggtccccacggtcggcgccagctgttgtcgaaacgacaactgcatacgtcgaaagacatggttactcaacagtggttgagaaaaagtaaagtgtattgattagagaatttttcttgggatccccctattacctggccctatgggactatttatagcccctattacaggttcttactattagggttttggttatacaagggaatttacatggttacccttatgaaagggacttttacatgggtacatagtgtaatagaggttcatggactcctgatgggccgttaggcgatcgtcggcccaatggcccctaggcttgatgggccagaaaaggcttcttcggccctcatgggggcaagcttgctttggcgaagtcgtctcccttcggtatatactcttccccctgcatccttcgcccaagaggcctccggcttggcagagtacccgcacgatccttcgcctctcgccgtccttgttccatagtcttcgccccgactaactttggtgtctcgggcttggatccccactcctcgcatagccttcggcaaattttggtcgaagggcctcataccataccgccaacaatgttgcattataaactatatgtatttactcttgctacctgcatttttttctccttgttaaacatcgttaaacattgcgttgcaattgcatgttatatgattatatctaaatcataaattaatgtaatttataaaatacaataggaggatagatatatatggacttcttttgcgggagcctttgggcacatatatgccccatgtgtcacccaacaagttgtactacttgctcccccaaacagatatggattctctgcagtactgcatttgcagtagcggtggctgacaggtggacccggttccacatgtcagcggctgctactgcaggtgtagttctgcaaaaaatcaccactgcccccaaacagctctagcctgccaacaacaattattttttaaaccgccccttaattggtagatcttcaggaggaaatcatctaataagctgaatccaacggatccaaaccactatccatctaataatatagtgttttagattaagatgtcaagttgaagcttaaactttcaaaagggaagcggctgctttcagggagacatgaagcattactaaccacaaaattacaaacactcccccggggggagttgctagcatgagaagcttcgttttggctcaacaaaataatatgatgcctccgcaacatgtcagtatattgagtattgacccatctgattatgacatacctgctatttttcagaacccaagaaactgttctcttctttctggatagtcaaattgcacgagtcacgcgactaattgagtgccggccttcactgatgtgttgaatattgttcagtttgtcaccagtgaaccgtcatcttcttaacatggacaccgaggtctgcaccagtaacatcaggtggggaattgagacgattttaagaatgattcatatgcaagcattaccttagttgttaaggataatacaattttgatatgcatggagttgtttgatttaatttcatgtcactgtcgatcaatctgagcaccaatataatattgtttcagtagcaaattgtgccaatttcatgtcactgtcaatttgagtatcaattttgatactcaccggactaccagagggtgataagttagccagtgaatttgaattctagcacagtattgctttgctgatgcaagcaatgacaaactggtcagggattttcttcagcacacgaaacataatacttcctccgtttcatattataagactttctagcattgcccacattcatatatatgttaatgaatctagacatatatatgctagaaagtcttataacctgaaacggagggagggagtatggtataaaacccagatagaagtcaggtcatccagtccaagacttggactgctagagctcaaatttcagggttgacaggaaatttgttgtatggccagttgaccacgagatctcaagaacagaccaaacccaaaccatagctaaagggcgtagatcatcattctcttctttaggacaggtttgcgtgaaaaacaaaccaacatagaaacagtaagatttggaacaacactttagagtaaatttcacaaaactacacttccaatgtgaaagctaagaaagaactacactatcagctaaccctttacaaaattacacttcagttgctttgttccaaaaaatgtaaatggtttccaacgaaaagcgtagttatgtttaactgcttagaagtgtattatttgatagttgccttagaagggtaatttggtgaaaattattcttctatagttgagagtaactcatggtagatcaggtgactgattttacatcgtcttgttgaatcttaaaagacaacagtataacatggcagaaagctaacttatttgcttagccaattggctttcaacatcaggttcactagcaatgcatgtatcagatacttagtttgtagattgcagaaaattcagcgtataatgaactttagctttcagaaaacttgctctatttgtgcttttgcagtcacatgatttccccatttacattcaatgatgcaatctaggaacaagtatatccatcttaccttgttcaaagatctataacaaccaactaggagcttattttggacccaagtacatatgtagctccaatgttaagaggcttttctttttgtctgaaaagggaattagatgctagtcagttagtaataaaaaacattgttgggcaatagatatgcatactcaccttcattgcacagtagcaccggcagcacaccactgcgaagataaattgataactgatagcttaattatacaattggtaatctggtagaatagtggagttgcagtgaaatatataattagcatccatctgttctaggaaaaatttctgacacccataatcatgcacatttacaacaaaatcttaacccaaaatttgacaatacagatgtgttagtttatcttgaggctattaccctgtgttaaaaaataaacctagagcctgcaggttacaactagttcttctaaataccaactccagttaagagcagcagttcccataaatggtgcttcaagaaaaatcaccagatgtctgtaggtttttccctctattgaaaattacatgcctctgcattttctttgttcactccacatataaaagctcactctctgatgaatcctctgtatgtatggaatcaggaagtgtacggtattccttctctgtgacgaatctcactccaaactgttcactggttggatctgctctttctctgggaaggaaccctcgttctcgtgcaagtaaccactggtcaatgacaccacatgtaatagcatgtttcattgcagtatgcaagtaatccttgtcagtgaccaggtgagggttaattgccagcatcttcatcagagctgaagaacacattaaaatgtcatcagagctagttcaagatacacaaacaaaataaacatgaacacaaaatgaagtgtcactaaattattatcatgctggcatctgatgatataagctataaaaggctgaagctgtaatttttttaaaaaaaaaaacttgtatacagtgtttgaaagaacggatttgctatactagtgtcgacagttaacaggggtgaaaactttcaaattttaagccatctaatatgctttgagatttgtgctggtgaaggaaaacgggaaaaaaaaatcagacgcgtgcagcagggatctaacccaacacctccaacttggatgtttgttcaactaaccagctgctccatcatgcttttttgagttacactcgatttacatatcagttacatattagttacatagtagttataatgcaattatatagtagttacatttgaaagtttttcatcccaaaaactgtcgacagttctatagctactcccaagaaagaatttgtatgttcctgctttatgaaagtagaacacatatgtaatgatgcatttgctatcctttggtgtcattaatgaaaatggcatatcctgcagaagtagaaaaaaaaaagaacatcagatgcagtacctgcaacaatggcgtcacctgattgtgacatgtcaccggtgaaaggagtaattggtgcatcttctgtgccacgaacccagccatcatgctcttttgtgtaataatgaatcttagaagtgccgtttgtcacaaaaaggaccttgagattttcatgccacaatttcgtaacaacttctgggctgtagtgagtgaatttggatttatcattatccttcgtaccaaatttctcagatggtttaatgccacacaagaactcaagttcctgcttagtgatttcaataatatcagcagcttcccatgcttccttgacaagtgacttggtctccttactggacgaccataatggcagtggaagattgagatcaaagaatgttacaccaccaaatttcttggaaacctcaattgctttcgacaatgatgatcgtgtcgtgggctcaagcaaagctgaagaattgtagtaaaacatcttagcctgcattaacaaacagaaacaactgatttttacataagatataacacataagtggacagtattttcttcagggattgtagatatctttgatttacctaatttcagatatggcctgcccatagggacctaatattttaagtagttgctttttaatgttcatattattttgagtttgggaattttcagacattcagcattagcaaagatattatccaacaagttccagtacagagcagcttgtagtgccctaactgctaaaaggttttttacaaaaaattaagatcattatggtacaggtttatgtgtcttctgactaaaaaataaccatgctaagtgcaaacatgtagaaaaagcacagttgtgaactgaaagtgttttatttacttctttttctgaacctaccaaagcacggcaatgaaaacaggtaaacctcccatttgtttatagtacatagtatcattttgacacattcatggtcaactaatagatagcaagtttgaattgatagaaatcgagttgagtaatttcctcttattatctttttggacaagtacattaatttagcagtatagccctagttgttccttaagtcttttgatataaatataatgacttctgtattgcaaacaatgttgcaactgaattatgaattgcacatctaaacagtataatatgccatcagctgaaagcaacttcttcactttagcaagctcttcttgtgataaagaaaaatagaatctttctaactgtataaggaacagaattattcaacaaaatttgcttttatgtggtaaaatttccataccagattaattataactaacaaaacaatgtgtgacatacaaatcttctgatccgtgtagtactctttcattaactaatcatctctgacaaaagaaaatgcaccacaacataatgataggtcagcatagtaaaataactttaccatgtgaacatttaaacaatttattgttgccacaatgtgcatggcacaaacaaacttttctcaagaccaatcaagtgtgcatacagtttatcattaaaccatgtagtaatagataatattgtagaggataaggtgtaatcaaaatattgtttgatgtactcgtctttacctcttttaaaacagctgggttgatatcagtttggacaaaacaatcctctgcacaaggtttagcacagctcattttcaagctacccctacctgtgaccttcatcaaggacatggcagtaaacgctgaagggtccattttaattgcccgagtttgaactccattgacgttcaagtgatataatgtactttgaccataatcatcatcgcctagttttcccatgaattcaacccggccaccagaagctgctaaagcaagagcaacattggatgatgatcctcctggtgcccttacaaattgatctggagaccagaacatgtctttcattccctcatgaatttcatgatctatcagcctattagcaggtcttccagaaggaataaatgagtacttagcaggcccaaagcagcacacaagagggattaaattgttaatatcattatcatcagtatcttctaatagcaatgctgctattttactttctaggtcatttgctgaaattttctcctgcctgtcattggagggcactagatcttcacccagatcttccccttcattgtcactcaattcctctacagtcttaacttttcttctgcccctcttctttggttcttttgctttgtccttctcttccgatgagcttgcagtagttgcagctgcaacataggagagaagtcatgacttgctaagggtttacgataatttttttcttaagttattgaaggaagtactctactgaaaatatgcaagcaagatgtacctttcttgcggcccctcctttttattttcttagtcccttcaggggattcatcttcttcagtgctcacttgaccttcttgtgtttccccttctgatgcttgtatggtggctttctttcttccacgtctcggagctcttttcttggtttttgatgtctcgccgtcactctcatcatcacttgaaccttctgctacatcttgagagctcttctttgccatggaacttacgtttcggttgagcagcctcattttagctttaggcttagtcataatgtttcccaagaagtggggcttataatgtaaatggctcctgcacattacacatcggaagcaagtcactaataactgttggaatttaaaccataatgtaagtagtgatgtgttaaaaaataaagaataagtgaatgtaagatagaactaatgttatcacacgattcaaatatgaagctgctaccataccacgtgggagcatattcagacaaggctaggtacaagcggtatatatatatatttcatcgagtacacatcacaatttgatgacatattgttcatcttgtaagaatcaaatagttgttatcaaaaaatgaaacaaaacatagacccaagatctattggaaatttgggaccaaagaaagatgccacaatctccactccatgtgctgctcctttcccttccctaacctaggatccatatggtggcgactcaaacaatccgaaagagatcgccacacgcactcatatcagctactaccagaagaagaagaagaagaagctgcattacacagaaaaatgaagcattacatacctgattgagttggtactacaaggcagggagcaaagaaactgcggggggagaagaagagaagccattcggtgcatcaatggagaggagaggattcctacaagaatcctcgcctacgcctcttccgcctcccgggagaagaaaatccctcaaacgaagaagctcagagctgagcagaggagcaaaaaccccaggggagaggggagaagaagattgattgctgctgcaaactaaaattacatacatgcccttccatctatctcaagataaggggcagaagcgtaataaataatcgcatggtagaacacgtacttggggaatacgcttcatccatgggtttacgaacagataataatacgctagcactctcctctcctctcctcttcttcccccgggagactccgccgccgtttatcgcctcggcggcgcggaatcctctctcttggttcgcaaatggcagccgcacggggtagcttatagggatcttcttgggagttaccctggttgactggtccgctcattcatcgaatcaacgcatcctgcgccgtcgcctcgcctgttcttcaatttgccgccggcgccggcttcggcttggccatggtgctccggcctcacgggagttcttgctgaatgtttatcatggtatattaattgtttcttttgtgtgacaatgtgggaatctagtattctagtcgagtcctactgccgttctttgcaaccttctccagtttgtggcaatgcgttgcggcgctgtcagcgctatgcatgtttgtggtgatttgtggttcttctccgtttcacattataagttgttttatttaggtttgatcaaatttatagaaaaatttagcaacatctacaatactaaattagtttcattaaatatattttgataatacgtttgttttctattcaaaatgttgctgtattttttagaaattaggtcaaaattaaaaaaaaagattgattaggaaaaaaagtcaaaatgacttataatataaaacaaggtcgtaatggactgttaaaattgctggtttccatagcactttgcacgtcatatgtaccagtaattgttattcattcagccattgttccttctcatttgctccgcaacacatagtctgtcaagatagaaaaataatactataaatctacttattcagataagcttgattttttttttttgaggattggaacaaaataattggttgattccgtattgtactgtcttttttacttctattgtgttcttttatttctgccacgtcacacatttagtttctaaacacccattgctcttccattccggctatcagcttaaggactgttttatgttgtaaaacagtaaaagtactgttcctttggtagattagccctaaaggaagctgtttgttcagataccaattgagaaccttttcttctgtaatatctgcctaaaaggttgacttgtcatgaaatcttcttatattccgtaatatttctgtatttttttctcatgtctgaggttgcctgatactttgcaggcaatgtagagctgttcagcaacatttttttttttctggacaaaaatcaaaaccccaaaagggcattccaaccatttagctaagcatgatatatcctatggtatcgtgtactaaatcccatgttctctatcaaggatagagttaaacggctaattcctgctgcccaatgctactacttgaaaggaaaaatgctcagcatttttgcaacagtgttccctcatgtttctttaataaggtgctgctgtacccatgtcagcctgtttgttgactcacagaaatgcacaaacaaatttctcaaggtactgttctttttcaggaatcaggataatcatccaagacaagatcccaagagcaagcggttgtcatagctttagggagcaatgtaggtcacagaatcagtaactttatacatccctacagctcatgagagattcatgcattatcattacaccacatgcctgcttgtataaaactgcacttgcatgtgtcactgatgaaccattgtttcaaaactccgttgttaagagggacaataaagcttggaccacatgaattactcaggaagctgctaagatatgggccacattaaacaaagcttgagacagcaaagaaattgagaaggagttgggccactgatggaataagatatagtcctgggccaattgatttggatattattttctatggtaagcaccagataaagaaatggtgaaagaatagttcactttgtgctcaacatcacagttgcatatggttagcgctagacaaactctgaagttttgatagacatgagaggctattgttatggctctggtgatgagtcttccaagtttgaatactgaaactgatattggtgcaagttggcatccactctcaaaatgcagagatgtcttcgaactcttggagaatcttggacgacagcccttgattaaaaggcaaatactaagacggggttgcccatcggtagtgcgttgtttgattggcaaagagaagtttcatagcctcatgggtatacttaatatgaacctgatagttcaagtgatcgagcgaagtttcaagaagtagacgatgctattctcaggtcaagttgctattatgtgatgatgccccttgcatagtaatacatctgagagaggatccctccacaatacatgttatcaaattttgaattaaggagatgtttgcaagcaggtggccatggaacgatactcaagggtgtaatggcacagaaatgacacacctccctttgtggagaatgattgttgacaccggaattggtttctcaaaaggttctgaatgtttctcaaaagatgagtaaaagaagcatcggtgcttcacaagtgccaatgttagttgaatgaccatccatgaaaatatttctaggtgaaatatgtgaccacaccgatcccatcgaaagaatttcagctcatgctgcctcatctgcaacattggttggtcaacataatcaaagtgcacaatgccagatttggtgttggttctgcaaaaatatgtgacacgttgctaaagcagagtaaaactttggactttctaataacaagattaagcataagatcttttgaatttttcatgaaatccagaatataatccaaatcaattcaagtgtaggagttcatgtcactaagagactaaataaaaatgaggtgatcttgagctatcctctgcaatcgagctttaccctgctattttgattggcattcttctaaattgaattcaatgtgctgtctacctgctcaacatataaacatattcaacaacaaaattaaatacatgtgtttgtatttcttttagctttttctacagatccattattgtactctcttatgttagcattccttgtgttccttagatttgctctgtttgagtgaacttttgccttaaatctcaccaaaatactaatcacccattcctgcttggatgaaaattattccatattgctagatatgaactctgcactcttttacttctgcccatgtgtaatggtgtatgtcttgctccgtgcacaatgtcagtccagtcagtgattcccaaatccaatagtctggggaatatgcaatgcatctgcgaagtcttgtacttgtttcatcacatgggatgccatcatggcagtgtgccagtgtgtgtacatcatctgagaactgagatagtagagaggaaagtgagagaggcacatgtacttggcatatgctttcttctgttcaaccatgtaccagttcttgagtacagtgtcacgcttgttcatgcaacgtgtgtctgtctctacctgtagctacttctgatcatttatgttgtgttgcaaagatatgtactgccagaaactctattctgtcagtgcactacagagtggagtgtagcaatatgcatgtggctttgttgctgcatctccgtcaatctgtgcatacatgactgctgtaatcagtattttttttttctctttagttgttttcttgtgaatgtgaaagcatctatctaatccaggcattgcagttggcaatttattgaggtttgcaaaacaatgtttttgagttatatttcagttggagttacacctgttggtttcagaaccgtgcattgattctggacactgcacttcaggtggaagagtatgttatatacattatgctcacttggtcttacaagctttattacattaacttattgtagtagtaattaaagtgcaaaactgtttcaaatagatatagttgatagctcatgtcccatggaagtttatttccattttcaggtttattttttcattgtgacaattgagcataatgaacttcaagggcttattaatcttgccacaaaataacttgacaggctacttttattccaatatacaactcacctgagctgtgtagtcttattttagacatttcatggtgataaagaacgccattgatctgaattgggggtatcttccagaataaagggtgtttttttttaaaacgaagaagaaaagctataacagcaccacaaaaaagatgttttggtagtaatgtttatgaaaaatgtgacttagcagaactactagtttggaattggtactacaagttaacagaactgcattgtgttttttgtatcatttcattctttacttgaataccttgcatgccttacctagggttttggtagtccttcatttagaggggaatttcagtccttgagaaaatttgcctgtagcaatctggaaatgttgtccacttgtccctttgtataatctttggtatgatgaattatataatttataaatggtgtgggctggcacctctgtgtttacacaatgtagtttcgtgtcctatgaatagcagcaacagccaacagtgacacttctggatttcaacaactgttaacatctcctgtactagcaatcaatactgcttttcagtatgttgaggtgaggcaagttcttttcccgacatcaatatattgtccaaccaattgaagcatcccctgttcattaacatgagttccttggtatctatagggaaaactgagagccaccattgaagcagtttacttgctttagcctgttcattgaggtacacctttactgttcctctatcagtatttcctcttttacatatttcatatttctttcagttagtggacatgagaagagaaatttgaagtcttcatccctgtttctatgagaactcgtgtatcttgtcaagtcttcatccatgtgttctgttcttatggacagctggtgtctattaactctctatcatgttcagaagcatagaagccaaatgacacttctgttttagttcaacaattgatggaccaaaagaatacaggagcatctgatggcaatctacattagcttcctaatggtcctataatgcctatattatctctataatattcctattttcatggacatatgttacaagagccaaacggctgttctaatcctgtcatcagggcagcagcatcagaattgcactcttattttctatctgatttgaattcctatctaacttcgcaaaatgttccaggatcagtaatcttgaacgcggatatgtaacccgttgggagcttcaactcgggggaacttcaatattgtgttgttaccttcttcctcccatctgcaaagaaaagattaacaccatgtcttctttgtcagtaaagaaccagacatattctaagcaacagaggatttgacaagatgaacaaacctgtattgagtcacgaaatagtgaaggaatgttgcaatttctacggtgcctacttccttccccgggcacattcgactacctcctccaaacagcatgaagtgtggatgtgattccatgttcttctcctgttatcagtaagtattacgtggttagaaacttacaattcaatcaatagtggtgttattggtgtgctagtggaaattacttgattgctgttttacttaccagccacctccatggattgaatgtcatgggatcagggtacaggaatggatcataatttatttcccttgtgtaaacatatattctccaaccttttgggataacataccctggaagaaacaaataagcactgcattagggctatccaaagatttatcaaaaagatgctaattgcagcagcgtatatatcatgcatatctcaccattcatttcaacatcttgggtagttttcctcagcagcccattcacaactgtagctaatcttaatgtctcgaagataacctgcatagtaaaagtgcccatgagttcatcatgatcagactacactgttactgtggctgctttctgagtttatcatcatcaaacttacagctcgagtgaaggtcatggacttgaaatcattccagtcgatggcatcttcgggcgctttacctttcctgatatcaaaatgttctttctgcagaagtgaacagatcatcagtaaactcgaagtgtgaaatggttttcatcatgggattcaagtggtttgttttcagattatctataccctgagttgctcaagagctttgggatggtctgacaggtacttgacagccatcatcgaggtcgtcgacatggtttcatatccagagtatataagggtgatgatcaggtcaatgatctgctcatctgtgagcttctccctggtgccctcgacaccggtcaagagcgcatccagcatgtcgtcgtgtacctgaccggaggatcgccgttccgcgatcatctgctctagcattgcaacaagcttcttccttgcctgaaaaaaaaaagagtgccttgttagagtagttcttcagtgcatgagttttaactgaattaccatatcagtacaattctgcagtcagctaaccttgaagccttggtagtagttggttccaggaaggttgatgggcagggagatggtgccaagcacaagggtgtagagctctgccttgagagcgtcagagagtgggccagcggagacgccggcaatctgcctgagtgcagatagcaaggccatctgaaagtgaaacattggtgtgagctgccatgcaagtatgaaattcagcatgccaaccaaaagcaaaccaggtactcatacaatgctactgctactttaaaaaaaaaaaaaacaagttccttaggcatttgagacatgtgatggccataattatggatagatttcactttggaatgaatatgtactacttagtactaagagagtgagagagatgctgtgtctggtagagtgtcttttatttctggctgaggaaagagctcatgatagatcaatctctttcttttgttatccagcagtacaagtgttctagaaaagctagagattccccttttttgggggtccagagaggaaagggggatcttccttctcccctcctttcctcttcctttgctccattccccattttgcaagaggcaccatcattctgtctgctgccattgtactatcagcagtagagtgcggtaaagaaaggtcaaaaaggtaattactgtgtgcttcctactgctgctggctgctagtggtgccacccattctttgttgccaacttgcagcatcagtggaaccacagtacagtactagtgctaactaatgtcaacagttgagattttcttaatgcagggtagtactcgtagtagagaccaagattttcttacggtgggccccacacaaattaccaccctccccaataatttactactcattactgctactaataaccagacagatcgtaatgcctgatactgctactgttgttgttgtttcagaaagcaagaaaagaaaagaagacgatgatatccatgcaaggagaaggagaagtagaagtagaagcagagagagtacctccttggtcttggcctggatgtcgacgacggcggaggaggaggaggaggaccaggcggcgaggtgggagcgcatgaaggcgtcgatcttggggaggagggaggagcggatcatggcggggcggacgagggagagcatggcgccgcgcatggcgcggtggagggggccctgcacggcggcgatgttgttccgccccaggatgtccagcatcgactgcgggtagcccgggacgaacccgcgcccttcgctggccagcgcccgccggttcagctccgcctccatacacaccaccgtcgggcaccccaggatgtgcgtcctgaacacgctcccgtacctgcaaaatctttcgcttttagtactactgctactattgctgctactgctagtggtattagtgtttgattagttttctcgttgataataaaaggaaatggaggaatgaatgattgtgatggatgaatgctgctgctagtagtacagattctgcaacaaggagaagaaaaacaaatgcttggtttgtgctgtggatgttctcttttagttgatcattgaagggagaaaagtttaggagggggccaagtggggatggatgtaattaaaaaaaatcgctccttttttttccttgggatgaaaaaaaatcatatcttttgtgtaagagtgttagtgtgtgtgtgtgttatgagggtgggcactttttggtggactggaagggagagaggatctcccagctggaacagtgatgagtgtgagcttttgggggacacagctccgaggtccctcccttcctccagatcacctcctctctctctctctctctctctctctctctctctctctctccccacatcttcatcatcatcaccatcatcaaagcagcagcactgcagcagctccttcttcctctgcctctccccccatggccaaagcttcaagcttgctattgcagagcagagagcagagcatatgatggatagatagatatacacacgcatgatgcagagattgcaggggaaggaatgtatggcgcgtcaggtagcatgtcaaaagaagcagttagttgttgtgttgctttggtttggtgcttgtttcatagtggagtaatatagcatatacctgagcctccgggccttcatgaaactgggtccctgcttgaggaactcggtggtctcgccgaagagcggccaccccattgtccccggcggcaggccgcgcttccggctgtaccgcacctcgttccaccgcagcagcaggctgctcaccaccaccgccgccgccacaaccaccccaatcgccaccaacaccatcttcttcttcctcctctcttggctactctctgagtattctctatatgtataaatatattttatctatagatgtatgtgtgaatcttcttctcttcttcttcttcttccttctgtatgaggttgtgaatgagtgacctctccctcctctgctcccctgctctgctgaagcagaggaagaaggaagctgtggtgggttgcttcaagctgcttgcttgtgctggaagaggagaagcccctccctccccctttatataggcgagccagccagccaccaccacccccagcacaagaattattgcctgtgcctttttcttcttcttttttttaatttacttctcccctctcctaactttggcagtgtttaagttaccttcaaacttccaaaaattccatcacatcaaatatttagacatattcatggagtattaaatatgaaaaaaaaaatcaattgtacagtttgcatgtaaattacgagacgaatcttttaagcttaattacatcatgatttgacaatgagacgctacattaaatatttgctaatgacagattaattagacttaataaattcgtattgcagtttacaggcggaatctgtaatttattttgttattagtctacgtttaatacttcaaatgtgtatccgtatacttaaaaagattttggcacacgaacggcctttttttgaaaaattactgcttctactctctttttttatatgttgtactttaacctatctaaaggagaatatactatgtattgctattaataaacctatttactactctcttcgttacaaaacataaacacttttagattctttaatagagcaaaaaaaaagaccttgatacctcatattaaatgtgagatggttaatgtgagagagtcgtttggattaagatgaaaagaattaaatgaaagatgattgataagacaaataatattgtgtagtatctttcctgaaataatttatctttagctattgaagcccaaattaagatgattgaaaaactatggtttctgatgagatcaaggaacgaggtttctcatcaaggaacggggttgagaaacgttgtatgcttttttgcgtgaagtttttaaaaagtctggatgaaaatgttctttcgttctccggacgtggtggacgttcccgggccaggaacgctgccttgaacctgtgctcctgtgattatgatcaaaatgcatcttatacttggtaagaagtattaaaaaataaaatttgtttatgacgaattataaagattaaaaataaatttattttgagacagggctacttcctttgttaaaagcaagtttatttttaacttctttcatttattataaaataagtttcttttaaagaatcattacatcaatatttatgaaagtaataaatgtattagaagtaattaaagtaggcaagagatttgatagagtaataacgaatgagatgggtgaaaaataaatttactatacgagagtagcatttatatagaaaaaatatgtattttcatgttctgattaagggtccacattccaaggcaaggccttgactatgggtatgtgtcgagacaatggtcagatgccttgcagctgcaccgaggaaaattagttttttcaaacaataaagaaaaggggaattgaattctagggtgttagataggcataggtatggatggcaacggggcggggcggaccgggttgggctggaacgctccagaccccgacccccaacttcactcctgccctgatcatggatgcgggtcaaaaacaacgctcgtccctgacccctccggggccccacaacctgaccagagccccgtattagattctattgttatgttatgtgctatgtactaccaaatctattaaatatacacgagaaaattgcgggcacagtttcattcacaaggcacagttggaatcttggagatgtagcaatacctctcactatctgtgaatcgccacctgtgcataggtgaagctcgtcgtgaatcgccggccgccgccgcgcccgtgcctgtgcgctgcaacctcacgcggccgcgcctgttccctcgccatacccttgtttgtctcgccggctgccgcaacctcgctgtccgcgcctgttccctcgccgtgcccttgcctgtctcgcctccccgccgtgccctgtgcgccgccgccaccccttgctgactccggagggagaggtagagctgtggaggggacgggattcgtgaggccggatgccgaaggggagactggagaggaggggaggggagatggtggccagcgacagcgagatccagtgcgccctgttgcgtcgtcgcctgtgtgtctcacaggaggggaggcgcctgtgtgtctcacgggaggggaggggatatgggaagaaactgagagagagataaggcagaggctagggtttagtagctttttatggtgggttgggctttttgggccttctatgcgctatattttgagggtttatatacatccccatgcccccgagggtcaccgtcggtaaaatgtctcccccgtcccctgctcgcccaaatgcggggccctatccctgacacccctgcgggtcgaaaatcacacccgcccccacccccgcccaggccctgtttggggagcttctagctgcagcagcttctcccagaatcaaaaactccccccaaacagtttagcttttggtctagattctgagaagttgtagttgtagaatccagaaaatgaactagaagccagaagctgggaaacccagcttttctagattcttataagatggctaccaaccagctgcttttcagaatcttaagctccccaaaacaggcccataggtttgcttggagaagttttggatactcaaagcatgtacaataacagactataagttaactataagcatatgtgtaggagataagagaggagagaagagaagtgggctatagatttgtagccagttgcagcacggactctaaaatattgtgtgtatatgacatgtaagaccaattattaataatgtagcatatatttgaagttaaccattgtataaattagctattagattgactatagatgatttggagctagtagttagctatactattaaacttgctctaaacaagcatctaataagaattaaaaaaggctagaagattcggtttttgacttctaatttatctttgagctctacactacggtttaacaaaatttgattgaaaagctcaaatgtttatatgaaacttctgatttgggataaactgtagctatcataagcttcataaatactccctacatctacttttgatagtcatatttcatcttgacacatagaccaagaataagtaattctacttatcatccatttaaacatgctactagtcattcctcgtaaacaagcgattcattaatatttatatttttaatgcccatgtagccagtcatgtgtggaagaatggagagtcacgcattaaatccgagaaagttattaagatgataggttgttggattgaaatatacttatcaaaaataaatttttcagatttgaaaatatgactatcaaaagtagatggagtgagtacaaatgtagagagaagcattactacggacagggttcatcaaatcttttcgcatagggttatcatgatggttatccacatggtttatgtggcttttaaaaactgagaagattaacaggttggtaaacctagccacgagattcacatcctctgtcataatagcgctatcattatgaacactgacttatagggcaataaaagaataaaacccacatacagatgatcataagagcaggtacaatagcagactattagccagctataaacatattttaatgagataaaagatgagatagaagagcagcaggctacagatttatagccagctgcagcacggactccaagacgtaatgtgtgtatgacaggtgggaccatatattaatagtatagtaagcaactattgtatgaattggctattaaatcggctatagatgaattggagctactagtgggctactccctctatcccataatataagggatttttatattttgcttgcactgtttgaccacttctcttattcaaaaaatttgtgcatataaaaaacaaaaaattgtgcttaaagtactttgaataataaagtaagtcaaaaaaaataattccaaaattttgttaaataagaccaatggtcaaacaatgcaaacaaaatgtcaaaatcccttatattactc

SEQ ID NO: 75190 - DNA, 2732 bp, Oryza sativa
atccctccaaaatctcttatattgtgggacgaaggaagtattaaacttgctctaagagcaggtacaatagcaggctataaaccaactataaacacatttcgagaagataaaagagaagagagaaggacagcgggctatagatttatagccagctgcagcatggactctagggtgcatgaatgtatgataggtgggaccagatattaattatgtagtatatgtttataggtaactattgtatgagttgactattaagttgactatagatgatttagagccaataatggttatgacattagagaagttacaatagcaggtacaatagcaggctattagccagctgtaaacatattttaatgagataaaagatgagagagaagaacaacgggctatagatctgcaactagctacagtgttgactccaagaagcgatgtctgtttgacatgtaggaccatatattaatagtatagtaagcaactattaaatgaattggctataaataaattggagctaatagtaggctatactattaaacttgctcttatggtagagaatcgttggtatttcgtacaccacctacataggcagcaggggtagcactggcctatccactggagtagtagtcggcgcggcgcggcgcggcgcggcgcatgcttggcctcgggagccgcgccgctgcgactgcgaccgcgactgcgtggtggtgggatggcaccgcgcgcaccggtcaaaaggaataaaacgcgcgcaagagagacagagatgccaccaccaccaccaccgtgcgtgcgtagaatagctgcctacaggtggcgcgtctggcatggccatgtgtgccgccctgcgccgcgcgcacgctcgcttggacgcatccccgtccacgcacaccacacacacccacccacccagccgccgcgtgcgtgcgtatgggcgtgcaggcgtgcagcctccttctgctgaaatttcttctgtactctactgtactgtactactcctgcgctgcgacgcacggcacggtggtgtggtggtgcatggggatgggacgacggatcgaggagcacacacacgagcacaacactgcacacggcttcagaccagtgggagcaaatcatggacgccggctgggaggactggggtcgtctggggatggccaaccttgcagacttgcacgtgcaccctgcaatttataatggccttcgtttataacaaaaggcacgacattaatttgcacatattaatgtgtgttcgtggtttattaaaatatatactaatataaggcatatcttcagtttcaaccagcactatagaacttgaattttagagaatgatctgtcgtattaatttctgctaatatttatagttattataatatattctacggtggactcaactaataatattttatagtgatcgacctatccaggagctgtctctctgatcgatcactaactatattttgaacttctagcagaggcaatcactagaagatttagcaagtattggatggctactatatgtgacaagattctcttaatttgccattggctagggcctattaggttcatcttcttgccaattttttcctccaatcattgatggatgttgcgtttctaaactttgacgtaccacatttgcacaaagtttggtaggaaaaatctagcaacaagtacaaatcaagccgcttagtagtctaaaaaaaagttaaggcttttggttctagttaatttgcgtactccaccattggaacatcacaaattttattggaagagatcacatttaatttgctcttggctttctctagctcgtttttcttttcctcaacgaaagatgttgttgtgtccttgatcttgaatgttgatttgtttgtgagtgggtcgatccaatcaatcatgaggtccgggatgtaaaataaagaaactgaaaagaggaattgcatgagtgcattggtgtcgatgaccggcgccatgtgcgcgatacatggtagtgtctagctactgattgatcatgcacagtgctcaatgagattttataggtggatgggttgatttcattataagtggagtaaacctatcaatgtctacatggtaccactagttattactttcccccatttaactataaggctcaagacattttttacagatttataaaatgtatgtaagattatattgtagaaaaggcaccacagacattttgaaagatcaaaatattatatttacatatgcatctttttaaatcaaacaaaactatgccaaatcaaacagcacattatattagaaaaaaataatggatgaggtaaatttatcaaaggataagtaaacaaaacatggaaagagaaggttgcattgccattgaggtggcacatggggtggttcccattggaggaccaggatggggcgtgcttgcatctgcacatacaggagtgtatacatcatccggggcgccatctacgattaaactgttatgtatacttaagagtgaaatttgaataaaccgttaaacattaaacctagcttggttagttattgattagcaatggtatgggttgggcattttatgccataaaatgaatacaattgatttttgcatggtttcgaacagaccttattcagcatacctccgcaacatggtgaaactcgtgccaagcaacactatcactactgataaaaatatattgccatacaatattgacaaaataattttaaaataatatattgttgacggtcaatat

SEQ ID NO: 75191 - DNA, 13557 bp, Oryza sativa
ccccccccacccggttgatcggatagaatcattatcgggaatgataatgataaggtgaattaggcttgggtggcagcggctattcacattgatggagtagaagagcaatgtctagtggatttgcagcagaaaccataggagcccaccagataggcggataggaggaagaaatcaaatttgtactagtacatttttatgagtttttaatgtttcagaaaatgcatctttcttgggttggattgaaacgttgtccttgatacttcgatggtgtttcatatttttgtttaagaatcttgtaattggttaatgttccatatgtgaaaataatagtacgtttcaatacatgaaacatttttcaggtagcggtaaaacatcgcccaaattttaaagaaaaaaaaaggttaaaatcaaacactcgatttgctgtcgcctcccagcattcctgaacttggagaaagtttgtccgaaacaacggcgtcacacagcgcgtccgactccgtttctcctgtaggtcgagtcggagtcggtttctcaccccatgtaacccatgttcgaatcggattcggacactacaaccgccataactacctcggctatatatatgcaatgcacgtgtaatcaaagtggatcaaaccatccatctagctcgcgcccaaacaccgatcgctcgggatgcctaggcggcggcgggacgacgacgacgacgacggcggcgaggcctaccggcgacatcaccacgacaagaggccgcggccgccggcgccgccgcagcagaagcatctctacctggtgctcgacgactgggacagaggctacagcatccacaagctcgacgtcgacctcgacgacgccggggttatccacggcggcggcggcggtccagccgtccggttcgcggcgccgaggtcgtcgtgcgacgcgcggttcttccccatgtgcggcgacagtgtcgtcatggtgtccgacgcggcgccgacgctggtgtacgacacgggcgcggccgcgctgacggtcgagtcgccgctccccggcctcctcgccggcgggatggccatcgccatgcccggcggcgagaggctgtacgcgctcacgtctctcggcgagcgcttccctcgcgccttcgaggtgctgtcgacgggcggcggctggtcgtggaagaacgcgcccgtggcgccgccgccgccgccggtcgaggaggccgtcgccgcctacgcggtgcaccccgacggccacaccgtcttcgtctccacctccggcgacggcggcggcggcacgtacacggtggacaccaagcgcggcgagtggaggcggcacggtggctggctcctgccgttccatggccagggcttcttcgacgccgagctcgacgcctgggtcggcctcccgcgccacggggacaccatctgcgcctgccaggtcccgtcccgcggcggcgcgcggccgccggagtgggacaccatggacgatgacgacgtggtgccgtcgtggaagaagagccgccgccgccccggcggccgtcgacgcgccacgctcacctacatgggcgacagcaagttctgcgtcgtcgactgcgtggaatgcgacggcgacgacggcggcggcgtggtcacgccgccgcaatgtgaggtccatgtcgccgtgtttgggctcaagtacaaccggcggggagaactgaaggcgacggctcgccgcgccgccgggtcgttccgagtgcccaagcatttctcatggttctctcctgtggccttctggatgtagacgaagccatatataagcaaaaaactgcaatgcaatctacaatatatattgcgattcagatcaaggaaaaaagaaaactaacattcagaatgctaatcaaacagtgctttcctttcagtgaagtgtagcattctacagtgctttagggggtgtttatatacaggggtgtaaagttttggcgtgtcacatcgaatattatatagggtgctgtatggggtgttcggacactaataaaaaataattacagaatccgtcagtaagcctcgagacgaatttattaagcctaattaatccgtcattagccgtcagtaagcctcgagacgaatttattaaacctaattaatccgtcattagcaaatgtttactgtaacaccacattgtcgaatcatgtagcaattaggcttaaaaaattcgtcgcaaattagtcacaatctgtgaaattacttatttttttagcctatatttaatacttatcaggtgtttaaacttttgatatgacagggtgtaaaatttttgggtgagatctaaacagtcccttatttatagtttctcaaagttcagtcatatgcttgtaagaatgtaagttgtataatatcctttttgagttttgacaaccattaatacaatggatacaatggagagttttatctgcattttgaaataaacaagaaagaaattcaatgtaacagagtatctagtcccagcaactagttacacatgcatgctgtcctgtaatgccacaatcttaactcacacaagatgctaaccatgttgattgtttgaatcaccgattacagagaacaagggtttcaaacggccggtttaaattgagaaaaccaacgtttgcagcggaagataaaaaacctggtacccatgataccaagaacgtgctgccttgtagtactgaaacttcttatcatagcagagaacttcaacttccatgctgatacataacactaaggatttttatgaccacataagagaaaagtacatccagaaatggtacaactttttaaccattccatcaccttatcacagaatttacaccattcaaagtcatccatgtaaactgctgcctataatttctgtatactaaagattgccaccatacaattcctgaaaaaacggatggcttgatgcacatcgcaaaacaaacagatatgtttatgtaggaacaacataaggctctttgtagtccttccaccaaggaaagaagagagcaatgattgccacaacaaaaacgaaaagaaaaactggatagtgagaacggtttgcatttcttttcttgcctccagtcttcttctcattcacagcttgacattcttgacatggagatttggctgcaccatcaaaatcctcatcatcatcgtcagccgggaacttcaaatcttctattagggcatcagtgttttgcatatggcattgattttcctgccgaattgagtcccaaaattcttttctttccttaagctcactgttttttctgaactgaagaatattagtacctggccctgagcagtgttgtatagctggactttcaagtggtgggtgaccatcttgttctgggtctctacagaaggtgcaagaatggagttgctttcttggagtagaattcatcctcatgtcacctgataaaacctgtgccctggatatctgaaataaaacatgagacaaagtgagagagatgtaaattcatttaattctaaggaagttatgtcttcaacccaaaatcatgtcaaatataaaccactgaaagacaaatcttcagcacgctaatgaaaatgcatatccaaacaattaacatatatgtggatggtatatgaaagtgacatcaaaatatgttcatgctatttggggctaaggaatggaaataatatgttaaagaaaagcaagtatttaatcatacaacacatttgacattttaagtagatcaaagctgctatgagtttctgccgcatacctgagagcagtgattcgtttcatgcgctgctgaacagacataacatgggccagcaactcttgttggcacatctgacaacctcctgtctggcttaattggatcaacagagctgaaatgtgccatcaaacctgaagcctcatgactatctggaataacagtgcgaaataagtcatgattggacattccatgtgatttgtcagatttgttacaccatagctgccgccttgcacgtgtgcttccagaaccacattgtcccactgaatgttgagaatcaaaatcagtagacaaatgaacagagttcaggtcacaagaatgtgaatcacatgaaccatcgtctctgatatccgcatcatccatgagagaatgtgaatatgaaccctttctgccatttcttacagaatagtttgctaactgactcaaattattgtcatgcccactctctttttgcctgccaacaagtagcttagcagtctcagatgcctcgaaagctgcaatgctgatggctggcatagtgtcgtcctggaattgttccatagcatggataatactactgatctcagaagatataatgcctagatccaaacccttcatgatggaatgtatcatttgaatcgatgaaataatcatctgagaactgcttgccttagcactctcatccagtatctgtaagcccgatcgaatcaaagatcggccataaggctcaagcatcagtggattttgtgtcagcaaaacaaccaccaagtttaagtgcgcgatactctgagcatgcgcctcctctagggcccctgagactttcaagcagacatcattaaccagctcgttagacgcaaaccgccagttgttggattgcacaagcgcggcgacacaaagagcagagccaaaagagttgctctccaccttagtgctcatcagacaatctgcaaagggacgacaaagcgagccaatgatcgcgcttttcaacgcttccgtcgccagaggatcaacaacgtaccgcgatagcgcgcaaacaaccttggagcaaccaacggcattccgcgaggacatcatcctaacgattgccgagacgatcagggcgatgtgcggcacaatcttgcggccgtgcgcttgcgcggcggtctcgaagatgcacagcatctcctcctcggagaaggagcatggcttcacggggtcacaaacgcgggcaagaaatggcgggagcgtgttcgaatcaagctccttcacatactgtctcaggccactgaaggcagccttgttggtaaggggatccatcaccatcagagagagcgcgccccctgtcgatacgaaatccagcatcagagattgccgcaactcgcaatcgattcaaccgcccacaaatattttctatggagcaaagaactaaaactactactcctagtcctaacaagggtttaaggcaaagaggaaagagcttcgaaacctagaagaggggagaaagagcggagagggatgagagggatacggggtgctcaccggcggcgagcggaaggaagaggaagtgagcaggagggggacgacgccggcaacgctgcttcaccctcgcgggatggagatcggcggcggaggaaggcggcggggcggggcggggcgaagtcgatctccgcctccgggagtcgggtcgagtagggccgtcggtaggagtcccaggcccattaacgcaaaggcggtatgggcatttttagttacccatggcccaacttgtcgctattaatctggacatagttaatatctagattcataatcagaagttgtttatgtctagatttgttgataaaagttagtttattttgagacggcgagaataaatctagatgtttttttagatacaagaaaagcggtgcatactagggtctgctagcctctcaaatcaaatgctaagtctttatggttgaagttgaagtgagctcgatgaatcgttgatgcatttcttttaagttgccctaatggctcagtgggccagatagcttgggtgcaaccaaataggtcagagctattgtttttccaacctggtctagacttgtctgaatagtttgtttttcaaatggctggtcaatttgttatatacaaatttgacgcgtaggacaatgaatttgtccagctcaacttcaataggctgaaatgactaggcaagctggactatccggatgaagttgatcaccaatggaccgaacaagtctaggcaatgtactttctatgggttggattagccaaacaatcaccagctagacagtccggtgaagatcgaactatctgcccttttatagcgcaactgctagttgtttcagtgaccatcgcaaaagtttaaagggttagactatgtcctatgcacttcaaaggcaatgtttaaaaatggctagtttgtgtagttgaggtataaatatacagtgctagtcgagactaaatactctatgctatgtacctgttcctatctcttggataacattgcaacttgagataactcgtggaggacttaagctttcagagtgattacttgagcgaggtagtggctttgtacgcactcacaaaagagtagtgctgagtagcttcaagtgaagttttcatcttgttattcatggcatctcttaaggattttgtggaagacccgatgatcttgggaaaggcttggagagttggagtttggcttccatagtgaagaatagctatacaaaagagcggctatggactttgtgaccataaaaagaagtgagactataatgtagagtgctccaatgaggactaatagattactgagtctatgataccttgctaaaaagtctccgtgtctccgtgcttgatcttcatatctcaatctctctactgcttgcaattacattactagaattgagtaggacttcaaataagttaaaaaagcttgtgccatgctagttttgaaccctacgcatgtagtagcttttgtttatcacaattgagtgtaatctcagcctttagtttttaaatctctatttagcccctctatggcatgtttgatgctatagctatcatggtaacagggcctaccccttggtagggtaattaaattgctctgtatatcagccatgttttaaaaaaattaaacaaaactttaatcttgttaaaacttctcccttttttttaatcatgtggttactaggcttactaccgaaaggagtatccttaccgtgataaaggaaaggaaatcctgattgtgcttcgtatccaatgctaggggctgttcatgagttggtgcatttttccttagagccacgactttattagtcaacccatactccccctctttttttttctttctgtaaaacccatgttgtcttgattttctaaacaaaacatagtttttgtgaaaccaaccaagttggcgtgtctattatgtcgagaaaaacaataatacaatgccataacttgtaaactataagcctagaaattaaagccatgaactacaacgagcacacactaacattgtacagtggttgctgaagggtattatatgaatagaatacatacaatttaaaaagaattgatgatggaaatgctgccttttataatcactgaactaaataagaaccctctttgtttccttgtggaagagaacatctgctattaaccaatgcatatgcaaggaaggaaggatacctcatttctatgtgcccctgctcatggagtgtgaccaaactgtcctcatggcatccaaagctatatatttctattaatgctattcaggtcagtaacagccaagaggctctgcacacacagttcgtcaccttcacacacagttcgtcatcttccaaactgtcctcatggccctgtttggatcattaaacctagattactgacaaaacccattccataaccgctaggctattttgcgagatgaatctaatgaggtatattaatctatgattcgctacagtgatgctacagtaatcagccgctaatcatggattaatatacatcattatattcgtctcgcaaaatagtctaggggttatagaatcggttttatcggtaatctacgtttaatactcctaaatagcaaaattctggagggctatttaatagctcggaggatccaaacaaggccatggttgcacttgtttctttccatcatcacttaactcaatcatttgcttttcagcctataaactgctatagaaaattaagttttaaaacttaattttggagttgatttcaagggggttttcatatttttattttttagcttttacttttaaatcgctatacaagtatatataaaaaatttacaaataaattattttttctcggtgataagccgttacggcctataatcaactataggttaaacaagaggttattcttcgaaaacaactaaaggcaccattcttgtgaaaaagctttggaagatgaagtgtagtagcagtacaagttcaattgcctgaagagcaggtaaagccagagagatcaaagcagcaaaaaggccatgacaacatcatggagtatatattcagattcacctcctctttttcttcagcaaggaaagggaggtgcaatattaaaaaaaaatctgcagcagtttgtgctgtcctttttggaaggaagtaaggaaaagggggtccaagaggaggttggctcacacaatgagtgacacaatgccctgctgccttgctttgctcagctttgctttactttgcttgcgtaggtaggaagaggaagagcagaaaatggagggagagcagtatgaaaatttggcagcaaaattggcaggcgccaaacataataaatgaaatgaataactgcaactaatttgtttatagatttagatggatgtttcggatatctgtaacgataatcgataatgtataattttatttgtctaacaagtttagaaccacacatgatacacctatgtaataccggtgttgtaaattgggcccatatgtcgtgtacatgcaagggaaaatatatagttttgaattaaaaaaatgctagttatagtttcacgaaatacctacttttgaacaaataattacagtaatgtgaaatttactcaatggaaaaagtgcaagaactgaattgaatgggagaaggaatatgaaaacaaaaccagatttgctgcagatttacgtattcattgtgatagatatatatccccaatatatatattgacattgtttttcctaatactaatttcttattagaaggaaaaaacacccaccaaaacacatagtcgagcccagttcgttccaggctcaagcctagccaaagccacagctcaccacagctcgtcagttagggcatgtttagttcgcaaaaatttttgccctgcataccacatcagatatacggatacacatttaaagtattaaatatagtctaataacaaaacaaataagattccaccagaaaactacgagacgaatttattaagcctaattaatccgttattagcaaatgtttactgtagcaccatattgtcaaatcagggcgcaattaggcttcaaagattcgtcacgcaatttcctggcgaattgtgtaattaattctttttgtctacgtttaatactatatgcatgtattcaaacattcgatgtgatagcatgaaaaatttatttcggaactaaacaggccagtattatcgccagtattgagtacttgctcggctcggctcacgagccgacggctgggctcactgagcgagccagagcaatccggctcagataaaagcgaaaccctccctcccctctccaagcggaaacctaccccctcttcttcctccgcttctctctctctctctctctctctctctttctctctcctcaaccgtgcggctgcctcctcctcgtcgctgggcatggatgtgcacccgccgaatgcggccgcctcctcgctggaggagttgttcccgcaccagcccgccacggtcagtgctccgggcctcctagctttgttgcttccccctttctttccccccttcttgctgttgctgtgtgtgtgtatgtgtgctttggtataagtttttttttcttgccaagaaccgggcgtggttgggttgctcttccgtggggaggaggaattggggaggaagatggtttctttttcttggggagtattggatgttttctttggggattttctttttttcttctttctaaattggggatttcttgggagtttttgtgttgggggttttgggggtttttggtacaagaatttggtgcggttgtggtggcctattctctagtttcttgatattattgttctaggacctagggtttgggtttttttttcctttcacttgtgttctttaccgtttagatgaattttctccactattatgtttgcatagaagaaaatgggggattttcctttgtttcttgaactatcttaccttcctattcatgcgtgctgcatttcctcgcccttttcttcaccttttcctacctataaattggaaagaatttttttggttcatagagaaacaaatatatttacagttgttgagcaattcattcagccgcacacttttttccagcagagcttcatagggaaaataaacaagactatgttcatgccaatcttgcatcttgtttttggcttagttgtgaggtcacagggaagaaatgcatgtattgctttgtgactttcaatatcgatgtgtgtatatgttattcccttaccatcactgtcattgcatagacgtgtccattgtaaaaatcttctttcgtcgatgggatgatgtgcatgcaagattgcgacagccaattttttttactttgtcaattcgggtgaaaaacctttattgttgccggaaacaattgataagaggcactgagctttatcctaatttcttttaggcattgttcaattttattgtgtaattctaaagctttactgttagaattcaataaagggcctactgcctgcatccccatgtgaaatgtggttgcctagctctcttttggtttggagtttcttttggtctgttgcaggtatagcatttactgcaattgatcctattgtgtgcccactgcccgctatagtgtttaattgcaagttgtaactgagtgattgctgtggcagttttgtattccttgccacaattacaaattgtagatgctgcacattctatctttgaggggccataaatttcttgatgcttgagatatatgaacttcaagtttgttaccgctgtataccagaaacagctgatactgacccctggaattttgtctttgctaatttttgtcagaaaaaaaaaacttttgaggaatttaattgcgccatgcttcagctaactttattttttgattttggacctccatgcatgtcttgctgtaatctagtagaacgagagctttgtaaagctataattccttcactgttatgtaatttagtttttaaaagatggatagataattgttttcgccattgcaatcttgtctaacatttctttactttgcaggaaagtgatagaagtggcatagagtggctctctgtctatgtagaggactgcttgtcaacctctgcatcctgcacaaaccctgtctctgcagaactaccgcctattacaatggcaagtcaaggtgctgcaaaaccaaagttaccaccacgctcatctaccaatgcaagaaaaaagaaaaggagcctggcatctgtcataagcgacactgatgaccaacattgtatcacgctgtttgtcgagccaccgctactcctgctcgatcataaggactggctagcagagagtgagcttatcctccccaagaaggacaaagatgaagaacttgtccaagagcaagaacaagaggaggaagagaattacaaaatgagtgcaggaatgcaattccagcaggagcaactggtgatcacttgtagctattgtttgtccagccaatcaccacagtggtgggatggtccatcagggcctacctgcgatgcttgtcgtctgaggattgaggcgaggaatgggcacaccaccagttccaagaagcgctatggccaagagattgacaaagaacaggacataggaaagcggcgagataagaagaagatcaagaaggctgtttatgtgaatgatgagctgctatcggaggagccaatgaagaggtgcacccattgcttgtcctacaagacgccacagtggaggaccggtcccttggggcctaagacgctatgcaatgcttgcggtgtgaggttcaagtctggcaggctgctgccggaatacaggcctgctaatagtccaacttttgtgagtgacatacactccaattctcataagaaggtcatgcagctgaggaattctgttccacacccaaggaagtgaactggtggtcgggaacgtctcgatctgttgcgtttagttttaggaactcttcagttgtagaagtaagctgatagtgaagaacatcttaatctgtctcattgaattttaggcgggctccttggtcgtagaagtgagctgataatcacatctcaatctgctgcattgagcttttaggggctctcagccttagatgctgagaaaacgaaagcagaatctagttaggcgtcatgaactctttgttagctctagccgttttttaacttgagaaattaatctgctagttgttggagatcatcagtttaataccaatgggtggttgctacctttgttatcccaccattgtcttgcagcatgcttgttctgtgatactcgctgaatatgtttgcaagatggaaatcagaattcagagcagcctcttagactatgttctgtgatacttgctgaatgtgtctgcaagatggaatgagagcaagcctcttagattatatcctgcaccatctatgatctttgcacatacttcagccatgccccttttggcctcttctccatatgttcataattctcattatagtagtatttgtcattcttttctgaagtggaatgagagcttctcattgtgtggttttgttggtggggtgcaaaaccgcaaatcgtatctccttggacatgccatgagccccagatagatttagggttcatgtttcctgttagtgtgctaaaattcaggccaatcacctgaaaattgcaagctacatggtaaatatcttgattaataactgttatagtccacctaatatctgatcttatgacaacaaaatcttagcaaatgcaacaaaatcataactgattgttttcctggtagcaaattctgctcaacagtagatcagatagactgcatgaatcaatgccctgcagatttcagattttttcagaccacaaagttgtcttcaattcagaaatctctctgcaggctctactcttgcacactgagacaatttccatggctggagatgacgaacaatgatgcagctgtgcttgtagtcttcctgtccactcaaaagttaaagcaaaggaaaggaaggtctagtccaggctacctttctgctgttcttttatcatgttggagccttttttggttgcacatggttggccctcttctgccatattcatgcttgcaattttactgacaattaaagctctgtaaatcataaatcatggtggccgagaagctcaatcctgtacttgtctgaagaaactcacccatgccgccatgcgtgttcttgcaagttaaaagctcactctttttcagttcatagttttgcttgcctttccctaaatgtcagcagagaaaaggcaaagctgtatactccctccgtcccccccccccccctcaaaaaggcaaaccctgagttctcgtgccaacgtttgactctccgtcttatataaaatttttttataatttagttttttcattgttgtttgatgatcaatacatgattaatactttatgcatgacttatctttt

SEQ ID NO: 75192 - DNA, 9906 bp, Oryza sativa
  unsure (1)..(9906): unsure at all n locations
atctacaatgacaatttataaataatatagttgttacccactaactataaagttcaacatgcaagtgtgccacatgatcacccactagtaattattatctatagtatcataaatctcattcaaacatatattatttataattttgctgtattttgagaactcaacatgtaagatatgtcaaaccatcctctccacattattttcatattatttaaacatatacatatatttttttctataatgtataacatgtattcactcagatatcctgtagcatggtgcagggtatcaactagttaccttaacaagagcgccaatgacacccaagctggtcaaccgcaagtactcaaattgtttggccttgtcatcagtttccaaaaatgcacataggtacaacggaatgcgggctgaaaaaaaaacaatatcgaaagataggaaacaacaaaatcactaatagcaaacaaacaaaagactaaagtttgtaccatgaattattttactacaaaacgtagtatatgacacccccaactatcaatattggacattttaaccctttagcagtttttgaatggtttttcatacacatgaacgccacataggatgccacatgtactagaggtccatgtaagcccttatgcattatatgggccctgctcatattggctgcctactcgttgctcgttggcatcatgtgacggtacattgatggagtggcggtggcacgttgaaggagtagcggcttagcgacgagcagccgcggcatggggaaggagaagcagggagtagggagcggggagcaggggcaaacggttgcttcgtgtgcccatggaggcggtggtgaggggaaggagtagcggcgagctgctgcttcactcgctcgctcaggcgacatggcggggaaggagcagcagtgagcgattcttgttgtagtagcctaataggtgggacccccacccctcttcttcctcttctgacatggcatctttgtacaggttggatccttcatcatgtccacgcatatcaaaaccaacctaaatctactttagagggtagtgtttggtattgatagttgtggggcaaggggtgttatagctggttttgtaattaggggtgtgttttagataaagacaagaagggtaaaatagacttatttatcccaaaatatatatggaatcataggtatgatatgtataggtattacttttattttgcgaggtatagtaatattacataataatgagtgacatcattgaggttgggaggaagataattaacaaattaccccatcaacatatttcagtttagacatatccatgatctttaccttgtaagaaatgggtcctagtctccgaatgtgaagcaatacactgcgcaatgcaaataaattaaataaaatatgattatcatagtatttggtagatgagaaaaggtagcaatataagtgtacctgaagaagtgctagtgcattgcaaactcggtttgaagcacctaatgacaaagttgggggtgaaagtgcagggtagactactataatctcctgtttgtttgtcagtaataagaaaaagtgatgagtgtttgttataccacacataaataaaagtaagctcagacatcaacaagttgaattagcacagttattgatatgatcatcaactcaacttgtgctaatgttgaattactaagagtggctgacatcaaaaccacctttttggagaagacctcaacaaaaaaaaagatcacgtaaatagtacaacacaacaaaaattactaattacttgtgggatcaagcatgatcatacctggagcagtgaagcaactatgccaaaagaattccacaacagcagagccaggttttgaaacatctctcttttctgaaaaatagtttcaagaagctgcattattcttaggtttttctttccatgatgctgtaatgtgtcaattgcataatatgcaatttaccattacttattcaattaagaacaattacaaaaataatcaacctggcaaatagaaattaattaatatctcaaggtaagaagatctatcaaccctttgagacctcaaggtgtgctttctcacatagattagtattagaaaggttgaggacaagtttctctgctaatgcgatgtgtactgatccttcgctcactaccaggtgacacccaatgtcagagcaagaaagatttttgagccaggcaaacatcactactactatcatttgctacggaggaaaataaagtgtttttttttctgtttcatatagatgtatgcttttataaatatctaggtcttagcttcattggtaacatgtaacattacttccttatagtcttgctctttaagggaaggcatgaagcttagcacgcttggtgggagatgtgcgtgcacaccctcaacattcaatctctatgtcatgttggaatcaacctatttgcttatttcttctctactagtttgatactgagatcctccttagtatggttcattctcttttggcacttccatgggaaagttcccctttccttatgcttttcttttgtttagtttgtaccttttagaagtatgtatgtaatgcacatgcctttttatcatagatagctttgtctttatgtaagaacaagggactttgcaatgtgaataaagtctgttccaataagattttggatgtattttggtttactttacataattgtctatactgcagttaagtctattctacgtagatcttctgagttgtgtacactttttctcaacctagcatcttttacacgtgcaaatgccaaaacccaagaaaaacaacttttggtcggttttccaaaagccattccacctctgcatgtatgtagaagctactagagtaattcccaactcctacccctctccctgttttatttatagcggccagtggaaacatgaatcatgtgaacttcgaacactcaccctcctcctccctccaccctccccccctctcccacacactcctcctgttcccttaggcaatttattgtctcaaccacaattcttgtagttagaatgcctgacactatgtagtagtctaataatctttatgaaaaatatccaaacctagcaaaggggccttactattgtattggttaggttaattggcatttgcagtaatattgtcacatcaatgcatgccatgtcacatattgtccaaaaatttacttaaatattgcatattatcgacaaattttattttattttatacatatttatttaaaaattgagggagaaactaatagttatatatgttggagaatatatctcatatagcatcattagataattcctttcatgcacaaatctgcaataataaataatgaaatgcaaaaaggtgcatcatctcttttcaactgtcatttattcatatcacttgtatttggtggaaaacaactcattagtattttagtaaatcaagttttacgcaacttggagcccataccacttcttcaaataaaaggaatgatgtaatagacaattcccagaaaagatataaattaccttgcgtagctcggaaggagcatgtcgtttgagttctggatctagcaaatcaagaataagacgctcaacaagttcagggtctctagggctaggaacctcactagtcaacatagcaaatatgtgtagactagctatatccaatgaaagaagtgatataaaactctaagtcaaacaatccccaatgcttctacaggaataaaatagaaatatgtgatacataggggcactacagcctttaagtagtgtagatacagatgatgtgcatttacttgtgtcataagaaatcagtagaaactgttccagataaatgcacattatcttgttggtttctttataatctttgatgcatgttactttttctctaaaaagaatccaaagttaaaaactgcagctccacatctgcgatgagtcatgcaaaagataagtattagcggttcataccttttttatgtcattcctatcgtgtgaagcacatgacaaagtgtaagttcggttcctttatttttgttaatatatgaccagatcactaatctttcttcagagtgagacaaaactcacaggaaaataatgattcacattagaaattttcccatgagttatccatcagaatgaaactctcaaggtggtggttgggtgtgggctggctggggattcaagagaggaaagatgttttttttggaaaggaaagaggttagggcatgttcggattataggataggaaaagtgtacaaatttaggaaatgaatctaagtgtaaaacagagtaatgaaaaataaaggaatacaaaagttaataacaagtttcaatcaatctggtgcatcggcccatattcaaagatcatataattgtttaattgatatcttataataatcaatcttgtacttataatatctctatttggtccgatctattaacattggttttaataaagttagaagattctttgctgatgtattctttgctttatttttcaaaattatatcacatccaaatcttcgctgatgtattctttgctttatttttcataacttatatccatctgttatagccgatcgatccgaaattccaacatcagctaggcacatgattatatatcggccttttggccaatctgccaaacgatctaatctttatctatatcttgttagatcaaactaactgacatacctaaaccctaattgataggacatgtactagatgtaagcaaatctctcaggcctctacaatgaattttgcgtcaacaaatttgtgtatgaatacaaaccgtttgaggaactgaaaattctgatgaaaaatacattgtctagaagcttccccaaacataaccttatactccctctatcccctaatataagggaatttgatattttgcttgcaatgtttgaccactcgtcttattaaaaaaattgtgaaaatataaaaaacgaaaagttgtgcttaaagtactagtatactaaagtaagtcacaaataaaataaataataatttcaaaactttttgaataagaccatggtcaaacagtttaagcaaaatatggaaatcccttatattaggggacggagggagtattacagttaatgcgcaacgctaatgccaatgctgacaccgaagcgctcatgtcgatcaccaacgcatatggctgcacaccgaagcccgtcgcctcgccgccggtgcagccgccgcccagtcatcggcgtgcatgaacaagctagctttggtcgaaaaccagcggtgtcaaattgaaaattttcccccaaaattttttaaaaaaaaaggggcccccaaaactgggaaaaaaaaccgggccttttcccaaaattgnatcgattcgattggctcgattttggacggactgccctaatttaatcctgctaatgaaattatttgatcccgttcatataatctgtagttaatctccagatcgatcagtcattttacttcttccgtgcagtcaaatcctatgggggtattggtaataattgtaactctcgaaccctatgggagtagagatggaattgaatttggtgatcattaaagttgatggagcaattgttgcatgtatgcttgtcggttaaacttttcattcctcattcctcttccgacgggagcttttgacgcgtgcatacgacaggaaggatgggggcgtcgggccgccgctcctgagagcaaggctaataatatagccgacttgttggctataaggtttttttagccttctttcaacctacccatataatagttagctctttacaattaatatagggttcacttgtctctctcatatagttttttggttcttgtgtccaagccggctgtaagtttatagcccgcttctcctctctctcctctcttctctcctccaccttagcatttagccggcttatagcctactgctatacttgctctgaggcgtgccgcgtgcgggacagaaggcggcgccccggcggctcttccagatatacgagtagttacttcaaacgagtcattgagggatctgtttttccggattacccctccgtctcaaaatataatagattttgggtaaataggatgcatcatattatgaatctaaacatacacgcagctcgctgtccagatttatattactagaatacgtcacatccatccaaaattacttatattttaggatgagggaaatatcttttcaattactagcaaaagtgcccgtgcgttgccacaggaattgtaaaaaccagaaaattgagaaaaactcgagaaagatttatattatgtaattaattgaaatataaatttccggaaatgtttggtattttttaagtaggtagatatataattaaattagttatataaaattatatagttggatttaattttattgaattatccatgattaattacactatttggaattttattgaaatttctagagtttaatagctaattttgataatacaagcattattttagtatttatttaaataaaaaatcatcctttctctttaggccattttcagctcgctttcatcccttctcctcccctccgtctcaacctgtaggaaagcattcggcctaacaggaagtctaattcggctccccctactcctctcattgccgtgtggcccccaaccaaaagtccaacctaagtgctttgttggaccggccggccagcacgctgcgtagcagtgatgcggcccaaagatggaggctagcccaacacgggatcgatctgagccgttcgtttcgatggatggctcagatcgattttgaatccatcaaaatcgtcggggttaaaaaatccctaaccctaattcatttttccctccctcccctcaccgcaggccgcccctgtcccccaccagcggcgccgctcctctctccgcaccaacgacgctcctcctcccaccgcgagttgccccttccccaccggtggcgcctctccacgcccctcccccaccggcagtgcctctccatgccctcccttctcccgcggtatcgctcccccttcctcccccctatccttcggctcctttaattcctcctcatcggggtgccgctgccatcccgctcctcgccacatccagcaagttggcggcaccccgacggcatggtggctcaggattggctcctccctctccctcccggcatcttcctagcgcaaaggcgagtcagcgacttcccaacgcaaccgcggctactccccagctccctggcggcacagtggcggcttggctgatccccgatgcaatgatgggacggtggaggaggaggtccgtcgaggaggaacggtggcctcccgctcgcccctccatctcctctcatcatctcttgatgttttggatgattttgtgatgattctgatttggatttggatttggatttggattgagattttgtttttggttggacttggattttgattatgtggattttgattctaatagtataaccaattactagctcaaaatcatctatagtcaatctaatagccaattcatacaatagttaagtacaaatacatactacatcattaataattggtcacacatgtcatacacgcagcatcttgtagtctgtgctacagcctatagatggctacaagtttatagctagcccgttacttttttctctcattttttatctccttcatactccctccattccattctaaaatataaggtataaccactcctaacccaaagaccaagaaaataattattaccatcttgtactttggatcataataaaaatataatatatgcatccaatagaattagaaaacatgagagtgggggatttaaaaaagtaataatttaatggagaaggggtcatagttaatagcttacatacacgcatatcttatattatggaacatctaaaaaaagtggctgtgtcttatattatggaatgggaagtatatgtttatagctgatatatagtctgttattgtacatggtctgtaggaaaaaaagtacccatacaaattcctaaaagtgcctcatattaaatacagtaccaagtactgtaaatgaacaactaatggcgagggtgtgaccgtgaacagatatctcgctatagactatatagatatctcgctatagactttatatagaaaggcaatatctagctaaccaattaaagaggaacatttatgaactagaactgcaagattaacacctagggaattgcttgtgagccggattcattagcaagctaagatatggtcaccggattacccattcgggtagtaagccgtcacctggtgaaggcgtcggatgctaccatccagccgcacgtgctcactctctcccacatcgacctccacgccgacgacgtccagaccaccgtcacctgcgtctaccccaaccctgccccctccggcgccggcgatttcgccgccgtcgtcgccaccttcacggccaacctgccgtccttcctcagccacctcttcttcctcaccagccgcatccccaccaacccggcgtccggcccgttagcctttccggctccaaaaggaaaaagtccaatttcactcccttaaatgtcggtcgaatctaatccatgaccctgaaccgtaaaaccggataggacgactccccggactattaaaaccggtgcaatttgactccctcaacggttttggagggcggtttcgttgatgtagcgcatacgtggtggtattgacttggtattccttccacatggcgctgacatggcggttaggtggcactcgaattttaaaaatgtgtaggacccatctgtcattcaaaaaaaattataggacccactggcatgtggggcccacgtgtcatcctctctcttccctccatcctcatccctctctcccttctctctctctctctcctcacgtcggcgtcatggagcctcgactccctgtcgtgggtgtctccacctcgccaccgtcggtgccccggcgtcgtccaccaccgaagacgccgtcttcatccgcccaagccgtcgtcgtcaccacccgagcccagctcgagctcgtcgccgaaccgccgccacgatgcatagccaagtcgtctgcgagggcgccgcctacgaggccgacaccgtcggcgccttcggcaagctctagggcaagcccgccgtcttccgccacgaccgcatgcccatgtggccatgttcgggagaggccgcatcatggccgaaggcgacgagtgggctcgccaccgctgcatcatcgcccctgccttctccgccaccaacctcaacgtaatcaaccaattaattcattctctccatgcacaagaacacgtgcactattctacatgattctaattgatggctacatatgtgcctgttgttgatgatgcaggacacgatcggcgtgatggaggagacgacgtcgaagatgctcggcgagtggagcgacatggtggcgttgggacacagctgcatcgacatcgagaagggcgttgtccggaacgccgccgagatcatcgccaaggccaacttcagcatcgccgccgccgacgccacggtcttccacaaagctgcaggcgatgctgttccactccacgcgcgcgtctcgtcggcgtcccgctcgccagcctcctccatatccgcgccacctacgaggcgtggaaggtgggccgcaagatcgacgcgctcctgctcgacattatcgactcgcggcggcggcgtgaaggcggcggcatgaaggaggtggaggaggtgaccggttggtcgggccccatggacgcggcggtgatggaaaagctcaccaagatggggtgcatgctaaacgaggtgctccggctgtatccgccttcgccgaacgtgcagaggccagcggcgtgcgatgcggaggttgtgcgcggggagaggcgaaatgcggcatggggattagggatttcggcgagccaaggaagggaaggg

SEQ ID NO: 75193 - DNA, 21231 bp, Oryza sativa
ggttaggttgtgttctgatgcaagatgggaaggtggttgcctatacatctcgtcagttacgtccgcatgagaagaactaccctactcatgatcttgagttagctgcagtggttcatgcgttgaagatttggcgtcattatcttttcggtactcgtacagaggtgtacaccgatcacaagagtttaaagtatatctttactcagccagatctgaacatgagacaacggagatggttggaattaattaaggattatgacatgggaattcattatcacccgggaaaggctaatgttgtagcagacgctcttagcaggaaaggctattgcaatgctacggaaggacgacagttgccattggagttatgcaaggaatttgaaatattaaatttgggaattgtcagtagaggtttcgttgcagccttagaagcaaagcccactctaatcgatcaggttagagaagcccaaattaatgatcctgatattcaagaaatcaagaagaatatgagaagaggaaaagctatcgggtatttggaagatgagcaaggaactgtatggttgggcgagagaatctgcgtcccagacaacaaagatttaaaagatgcaattctgaaagaagctcatgatactttatactccattcaccctggtagtaccaagatgtaccaagatctcaaggaaagattttggtgggcaagtatgaagcgtgagatagcggaatatgtagctgtgtgtgatgtttgtcagcgggtcaaggcagaacatcagaaacccgccggtttgttgcagcctttaaagataccagagtggaagtgggaggaaatcggtatggatttcatcactggtctacccagtacgtcatcaggccacgactctatttgggtgatagtcgacagacttaccaaagtggctcatttcatcccagtaaagacaacatattccggaagtcggttggcggaattgtatatggcaaggattgtgtatttgcatggcgttcctaagaaaatagtgtctgatcgaggtagtcagtttactttaaagttttggaagaaacttcaagaagagatgggttctaagctgaacttcagtactgcttatcatccgtagacagatgaacaaaccgaaagggtaaatcagattttggaagacatgttgagagcttgtgctttagacttcggtggaagttgggataagaatctatcttatgcggaattctcgtacaacaacagttatcaagctagtcttcagatggctccttacgaagcactgtatggtcggaagtgccgcactctgcttttgtgggatcaaacgggagaacgtcaggttttcgggactgatatcttaagggaagcagaagaaaaggtaaaaatcattcaagaaagattgcgtgtggctcagtctcgtcataagagttatgccgacaatcgccgcagagatttgagttttgaagaaggagatcatgtgtaccttcgtgtcacgcctcttcgaggggttcatcgttttcacaccaaaggaaaattggcaccgtgttttgtgggaccttataagattatcaatagaagaggagaggttgcttatcagttggagttacctcaatctctggcaggagtccataatgtgtttcacgtgtcacaattgaaaaagtgtttaagggtacctaccgaagaagctaatcttgaacagatagaagttcaagaggatctgacatatgttgagaagccaatccgtatcttggaaacaaacgagagaagaaccaggaatagagttatccgttttgcaaagtccaatggagtaatcactcggaagaagaatcaacttgggaacgagaagatgaattaaagtcagctcatccgcatctgttcgccagttcttccgaatctcgaggacgagattctgtttaaggggggtaggtttgtcacaccctaaaaatcctaaatatataaattgttgtttaattggaattattagaaatgattttaaaagtctagaagaaaagatctaattttaaataataaattccaatataaaagtgagccagataaaattttaatactttacttgattctatagttcctagatttttctgggatttatttgagccaaggaagtatttttaataaatggaattgtatttcatgaataatttaaattggaaaaggtttttaaagttcccttttggctttgtccctctctctcctctccggcccaatcggcccagtcagcctgcagccgcccgcgcgcgcgcgctcggccgctgacaggtgggtcccacctgtcggactcgtcgtcctccttgcgctgaaaccctagccgcgcctcgccgccgccgcctttccaattcggccgcatctttcccgatccggtgaaatagtttgaggggaaatgctccccgggatcttctctacctttttccttttggaatcgatcgccaattcggtttggaaatccgtggactcatgttcgattcggatcgatctctctcctccgaaccctaaaccttccatcgcgtcgccggtcgccgtgggccttcgccgccgcctccttgcccctataaaaggacccccggtgtctccgctatccgtcgccaccctcgcctttgcccgccgccgtctgtagcgccatagcaccgtgcagccgtgcgccgccgtcgccgccgcagctccagccgtgcgccgccgtcgctccggtcgtcgtcgctgctcggggaggtcaccgttgtggtcaccaagccgtcgccgatctcgtccacccctccgtcgtcgccgtaggtcaccggagcatcgccgtcgtcgtaaagccgaaggtcgccgccgcttattccacgacgtcgtcgccgtccgttgatcttctgccactgttttggtcaccggtgagttcgccacgtcgccctctacgtgttggtgtcctccattcgcgtcgtcgcgccgtcgttcgccggcgagcttgcgtgcccgagccgccgctggtgatgacgtcatcgccgacgtcatcgttgccgtccgtcgtaggccggtcgtagaccgttagatcttggccgtcctttgtggatagaatcgatctcggccgttcgtttccgtgagtcgccgccgtgcacccggtccaccgcgagccctagccgctgacgcaataattcccttttccttttcaaaaataattcattattgcgtcataattcaattaaaactcatataagtgttttaatccgatttaatctttaaaaattcataactaattcatcttagctcggatttagtttgttcaagtctctaaatttttctaaaaatgagatctacatattaaaaatatccacatgtaatgttcatgcttgtttatgtgctgttttagtgattttgctcttttctgtttagattccgacgtttccggagagtccgttttcgcaggagaagaatttgaagagttccaaggccagcaaggcaagtcacacagatccaaacaaccctttgagcatgttgatcccgtttaaagctattgtttctattcaactattacatttattttctaatgtcatggggtggaattaacctattgtttgttatagcccttttgttcttgattactttattccttgataccttgggttattataacttgactagttgagctttatatattggttcagctagatatcagatatgattgcttagccatgcttagaaacattagcacactattgggataacttatgattcactattatttaatgatggcttaatgatagttcacgatggtcaatcgtgattggttaattaattaaattgccaactaaaacttgataatggtgggttgtgaacacatggttttgttggtcgtgctcatgacaataaaggaccggttcacgattttcggttgtgaaacattaaccgtgccaaccacaagccagcgtgggcaacggctttaccttttgtataacatggttcattccggagcaccagactgagaagtggcggagataagcccacgggggtcgctggggagtccatgccttgtttataagggggtgattatgatccaggaacggtgagctgtggtggattgtgttgtgcgaggggtactgtcacagctcctttccgaggtactgtggtggtattgaggcgcatggtgacatgtcatgaggctgtgtcttgtgggtacagtggtacacctctggccagagcacaactattcgaatagccgtgcccacggttatgggcgggtctaacaatgtctttcgtgattagtctcacacttctcatcataataaaagatgctataactggtaataatttgattagctcctggtttggaatggttaattcctggtttggagatagaactgtgcagccgagatgattgttcagaatgtgcagccgggatgattgttcagaatggttgggcctaagcaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgttgcgtggcttgctgagtatgtcatatactcacctagcaatcattcatcagaggaggagttctacagtgatgctgatggtgtggaagattaggtgtagccctggtcaagctgcctgtggagtggagtcgtcggcgccgtttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaccctgcttccccttctcctcagcagcttgcagaatttcctcatgctttgccttcccatcctctactcctcgattcagatctggaggtggcggatgtggaccttgcggctcttgtcgcccaatctgcaaagggcggatatgtccccttccccctgcgtctcccctccagaatcgattaggcggcttgaaaggtggacgcggcctccatcctccgccttgatttgccattggagagccgcttcttaccaccttcgcgaaactccggccgtcccctcgaacactcgccgtccactctcgccgtcgcccaccaccgcctacccttggccactcctccacttctctcacctccccttgcgtctcccccttctccaatctcctccacccgccttggaaccctagctcctcgagactagctccccacaggtggtgtagaaacggagtcaggagagtcgactcaatggtgttccaccgatctccaaaatcgccatcgttgaatctcgacacgtgttgcccctccacctctctctcccccactattggatcgggccgaaaaccatgggcttcctccctcccctgatcaaaaactctctcgcgcgccgaggagcactctcccaactcccgaaggccatcccctccgccacgaatcaccaccggcgatcgtcggagcgccgcaggtgactccctcgtcgtctctcctaggattgaagagtttctgacgccgcgggtgactccctcgtcgtcattgattagtttctgacgccgaattgaagagaggattggattactgctggcatatgaagtgaatcaatgcaatacgattcgtaatgagttagcatcccaactgcagagacaggtcacgtatatacgtacgtatgcaggccggcctacttccaaatccaaattccaatacgattatacaattcaccgattgattgatttaatttcttcctgcttcaattcgatcgatcgatcggcgtcgaccagaaattaatcgatcgagtctatctagggaccaatcgaattcatcgagttcgctcaatggcaactgctgctggtagatatgaagacagcggagtcagtgtctctttccggcggaaggcggcgtacacggcggcgtcgctgcttgtcttcctcgtcgccggccagctgccgctctatggcgtcaagaagtacaacggcgacaaggatgtcccggatcccttgtactggatgaattgcatgtttgcgtcaagcaataacaccctgatgactcttggaatcatccctcttcttctctccgagatggccgtccgcatcttctccgcactcatcatcaccaggtggccacccttccatcatgtgcgcctgtaagctactccctcatcttttttacagtacttacaaaaataatggaaggtgccatattctgtagcgtaaaatctggtatctcttgatacctccggtagtatgagtatcgctccacagagttcgaattcgttttttataagttgtataataaaaataacaaatataaccctaaatatctgcatagtagtttagtataattttgtttaacttatagaaatcgaatttgatttgtatatttgtaaagtgatcgatgtatctcaaaattgatctatcttatcaatttttaaattattttttatcatttaagtggcatgtaaaaacgagaggatcctctcaaggatgaaattccatctccaatattagtaattgtttttttttggaactaacatgcatattaattttgtttgattaactaacatgtctgcatggatgcgtcatgcttgctctatatattgtggagattatggataccccatatctacatgacggttgtaatttagccggatatacggtaccaaatatagatggaatatctctataaagactcgggttaggttctaaacttatatgtcaaggaaatacccgggatcttagtcggttactattgtattttatctataatcccatattgcgttaggatatggactgtattttgtaaagtggactccttcccctatataaggagggtccgtgtgcctcttggggggcgattctttttccagtttatacaatcaataacacactcggcggaatcatccccggacaggagtagggtattacttcttgaataaaaaggcctgaacctgtataaaattccttgtctccaaacccattcactttcctagcttgatagctacccccttttattattgtcgaaatcttgtttcgacagttggcgcgccaggtaggggcagcgtcaagttatcgccaactaagtgcgatgggtttcgtttctggcatcgacgacttcgcctttcctcccgggtaggcgttccggttcggcagcctcaacttcatcaccaacgacttcggcaagatctctctccttgactcggattcaaaccagtcggggagagaccaggtccccgtgccgttcggtattccgaactcggccgaggcctactccaagatcatctctcccgagtcggcttcaaaccactcggataagatccaatctactcttccgcgaccagatcaagacgacgggtcctatccctcaatcctgatgaaacttcctgatgatttggccgctgtcttcacagtcaggacatctcccactcgaagatctaggcgagcttcggccccgatccgatctagatccagggaggttggcgttatactccaacctctcgggacagtctcgacggaagagttggatggctacctcagctcccccggcgtcagttctcgaccaaccgagatcctcgactacgacgatttcagctaccactacgaccacggcgacctcgacaacttcgacgacagctatgaggataactacacgcccctcttcttcggcgtattcatggctgacaacgaaacggaggaacagcgccaagcccaagaagcggaccaagatcgcgcacggaaagaagctgaacgtcgccgactggaggaagagcgacagcgacaagagcgagaacgactacagcgtgagcaacaggatcgcgaacggattgcaaaagaggctgaagatcggcgacaacgcgccttggaatctgggcggcgagcgagagagctcattgggcaacaagacgtggctccaatcggaactggagaaagggaaagaagccagggccgaagttgatcgcttgaaggccgaactggagaaggagaaggcccacaccgccgtgctcatagattattacaatctcaccgagccgaagatggaggctcttcggcaggaggttcgcaaggccgaagcaagcgctgcagaggagtcgcggcggttttcatgggagatggtgaaaaccaccgagtccgcacggacagcgtgacaaacgcttcgcctcgcccttactgacatgggcgcaaaagtgcggggtgtcccctccgaagatgcatcagccttcgacttctccgaatggacccaacaggctggtggttcagtttctgactgcgccaccgcatacagcgattgctgtgcacgcgtgtcagcggcctttaccatgggcctcctgcagcagttcggctgcgagaacatcgccgagtttcccaagtacgcaaagggggattgggaaatcagtgcgcaagacatttcgcccgcgcttcgtgcgtggcgaaaacaattttggcagaaggacgaccgctccgccgctaaggcgcaccttttggcgcagctggcgaaagcagaggcggtggacctttgtgaagatgaaggcgcggcggctggagggggtggaggcgatgcccgggaccacccagaggtgtgaggccctccgcccttctcttagattttcatagttttcttttggtgttcgctagatgtggcaaaccattgtatattcggcaaacttccgctaaaccttaaaaaaggctttttggtatatttggaatgtatgacacaatcttaattactttttgatgatcgaagtctttggcatatttttatttcactcgtttcacattatgccataccttccccttctttcgcctattcttaccatgcaaaatgtgttttgccttttctgcactgtctaccagggggtctgctgaaaatcgtgcattcggcccccttttgggagctggcgaggtcaaaacgagaaattcgtggcattgaaggggctgtcgaagacgcgatgtccatttcggccattttatcacgaaatggagataaacggtcgcagctataaggttatcaaggttgccaactggctacgtgcgcaccccgggtgaaccttagaagattacgatcttgttcactcaagacatttggaagatatggctcgcttttggcgaaaccatcagaagactaaacgccaggaatcgatctctcagcgtcgttacagtttagtctgtgtttcgccccctactattcttaaggttgtgtatgatattagtagtgatgacgaacctagttcgtccgaccattccttagggagggataatgattactggggcgaaaatgtaatttacttgtaaaatgaattgtatcgggttgtaaaccttgtattcttcgattatttttttgaagctaataaagaacgtgctttatttccttttcgctatttttcgcatcgtcacattttgtgcttttgttaggccggaacatgccggcccctttgcatatattagcgaaataggtgtactgacttttcagcttttcgtcgttcattttcgatctgtagcattctgtgtcgagagaaacgcttttgcttttatgttgatcggtcgtaacgtcattcggctatttattttccgagacaagctgttgcggtttcaacgttcggcgagcaatgcttcggccgattcgtttcgcccccctggcatttttcgctgatcaggcgcttgccttggggtttttccacaaattatcaatcacacgaaaagaaataaaaagaaggcggaggacacagagattttatactggttcgggcctccatggtggataatagtcctacatccagttttttttttctttttctcttctctttttttctttttttttcttgccgaaaggcttacatagtgccgaaaggcttacatgacagtatgtacatttttacaagttggcgatttgggtgccacccattctagacatagaagcgcttgagggaggcgacgttccaggaatggtcgaactcctcgcctttgagtgtcgctaggcgaaaagatcccgtcgtggacttgtgtttgatgatgtatggtccttcccactttgattcaagcttgccaaccgctactgggttcgcctttttccttaggacgagatgaccaggcattagctccgtgggtcggacttttttgttgtaagctgccgaagtgcttgtggcgtacttgtgcatatgctcgagcgcttcgacccttacaccttccaagagttcgagcgatacctcgcacccctcttcgcccctagagaacataacccttggtgagttagcccctagctccgctggggtcattgcctcatcgccataaagaagcataaatgagctaaacttggttggtcttgtgggggtcgtccgaagggcccaaaggaccgataacaattcttctggccatttgcctttcaccgccccctcaagtcttttctttagtgcttctaggatcttgccatttgtacgttcggccgccccatttgactgtgggtgcgcgaccgacgcgaacctgatttccaggttaagcccttcgcacatttctctgaacttatcagagtcaaactgcttgccgttgtcagtaatgaactcttttggcactccgaaacggcaaacaatgtttttccatacaaacttctgtactgcggccgaagtgattgccccaaggggttcgacttcgatccatcgagagaaatattccacagctacaattgcgaatttatacccatttcgcgccactgggaatggcccaataatgtccagcccccatctggcgaagggccatattggtgcaatgggctgcagatcatactggggcacggcttggcttcggccatgacgctggcaactttcgcacttcttgatttgctcaacacagactttcaacacagtgggccaataaactccttgtctaaatactttggaggccaccgttcttgcagcctggtgcgcgccacatagcccctggtgtatttcctttgccatttcttcgccttcggcaaaagagatgcaacgaagtaagggttgaagtaccccggagcggtaaagctgacctgagaccatcttatacttcgtggctctgtgttgcaaacgcttcgcttctgcttcgtctaccggaagccagccagtttcaaggtgtttcaccaatggggttcgccagtcatatgggtcttcgcccagtttctcttggtcgattgtcatgacttccgagctgtccatgggcacacttggagcatgtaggacttcgaaaaagatgccaggcgaatgcgggccaccacaagcagcggatttcgccaaggcgtctgcttcctcgttctggtctctaggcaagtgttcgaccgttatgccggtgaagcatttttccatggaccaaacagcctccagatacctcttcattccctcttcttttgcctcgaaggatttgtcaacatggcctgctaccaacttggagtcagttcgaattagcaggcgccggactcccagtgctttcgcctttcttaggcccaggagaacggcttcgtattctgctgcattgttggttgtgtcgaactgcaatctcgccgcgtaccaaatcgacacaccattcggcgaaaagaggactgccgcaacgcctgcagaaccgtcagagcacatcacccagaactggtcatcgggctcggggtcgggggcaagtactggtgtccattcagctacgaagtcagctagcacttgagacttgatagcagagcgtgcaataaaatgcaagtcgaacggggatagctctgccgcccacttgctgagctggccagtgacttccttgcctcggagtatttcgcccaaggagtactgtgatgggactatgactttgtgggcctggaagtagtgcttaagcttgcgcgaagccattactagagcgtaagaaagcttttccatttcaatgtaccttgtcttcgctccttgcagtgcttcggagacgaagtagaccggtttctgtccggactctgtttcttggacgagtgcagcactgactgccaccgacgaagctgccaagtataatagcagttcacttcctgggggtgggcttatcagagctggcgggctttgcaagtattgttttagctcgtcaaatgctgcttggcactctggtgtccaattaaactttcccgcgccccggagggtcttgaagaagggcaaacctctttcggccgccgttgagaggaatcgactgagtgctgcaattcggcctgtaagcttttgtacttcatgtacgcttgacggaggcttcatttgctggatggcatcgattttctcgggattcgcctcgatgcccctatcggaaacaaggaaacccaacaacttgcctgcgcggacgccgaaaacacacttctccggattcagctttatgcctgccgcgcgcaagctgtcgaacgtctcttgcaggtcgaacgcatggtcgaaagccttgcggctttttacgacgatgtcgtcgacgtaagcttccacgtttcgccccagctgcttgccaaggaccttgtacaccagcctggcgaaggttgctcctgcgttccttaagccgaaaggcatcctgaggtgacaaaatgtgccaaatggagtgatgaaggatgttttggggatgttgagcgggttcatgtggatctggtggtaaccggaatatgcatccaggaaagtcatgagctcgcatccagctgttgaatccacgagctagtcgattcgcggcaaggggaaatcgtctttcggacatgccttgttcaggtctgtgaaattgacacacatgcgccatttgccatttgacttccgcaccagcactggattcgccaaccactccgaatggtcaatctcttgaataaaccccgcccggagtaatttttgtacttcggtcttcgccgcttcttggcgatcggcagacatcttgcacaacttttgctttcttggcttaatattcggcttgactgctaagtgatgcatgatgagatctgccgggatcatcaatctgcacttttgttatcttgccgtgaggggtgggcttcagcatgtgcttgggccgctcatgcggttcggtctcaacattgtgcactgctctgttgattatggctagatcgcgttttgaagcggccgaaggctgaagccccttgactactatcacccctgttgggccaggcatcttgagcttgagataattgtggtgggaaatggcttcgaacttgttcagggttgcacggccgaagatggcgttgtagttgtatgggatgtcgacgacgtcgaacagtatttgctcttcgcgcctattttctcccgagccaaaagctatcagcaaaagtgcttggccaagaacttgcactgcctctccgccgaacccccggagcgacgttggtgccggtgcaagagtttgggttggcaagcccatcttagcatatgcttcggcgaagatcacgtcggccgaactccctccatcgaccaggattcgtcggacttcaaaaccggctatctcagctgagattaccagtggatcttgatgcgggaacaggactccttcggcgtcttctggcccgaaagagatcaactggttcacgtactgtggcgccccctcacccgccgaagtgatgctgtggaccatacggatctgcatcttcctctgccgtttcgacaacaggcttggcgggtcagctcttgtaatcacttggattacccttcgttgtgtatcttggcgttgttcggctaggggtatttgctcctgaactgcttcacggggtgcttcgactgttgttccttgctgcggccttgggtcttgcgcgttgccacgttgcctaatgtttaagcattgctccgtggtgtgcaaagagcgtccgtgaaaagcgcagtagaggtcttttcggaccttcttgcgggctggctgctgatggttgcttgcttgctgggcgtcgaactccttgcggagggcttgcacttcttcgacagccatcacagccttgcccgcccgatctgttctgaactttctccaagtcatgggggcttggccttgccttggcggctgtccctggatcgccggctgagactggcgaactgataggggaggtggttcgacaatttgaacttgtgcttgagcttgagcagcggcgacgaaggctttatcgtactcagcttgtatagcttgccgtcgcttagaatcctcctcgccccttgcgaacccgtcagtgatgcgaagtaggtgctcgagcgtctgcggctccttgttggcgatttttcttgttagttcgccctcaagcagaccggccgaagcggcgtttataaccgacgcctcggttatgtcttgaacttggcaccgggcttgcgagaagcgacgcatgtactcccttatcgactcccccggcctttggcgaatgccaagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattaccatcgccttggtattttcatcaccatgagccgcttcgatcgctgactcgtagatggagaggaactccttcgggtcagtttcgcccgaataacgcgggacaggtgggaacttgaactggggcgggattggacgagtcttgattcccccactcagcggcagccccttttcgcctcccgccctgtttaccgcaccttgctgcgggtacggtgtggcgaagggcgaaatcgtggcttgtgcgtggagttgggccgcggcattcgactgcccggctccaactggtggtacttgctgggccgccatggatgggtcaaagattggctgcgaccacatcatggcagcttggattggtgcttggtttgttccgaagcctggggttggaacttgctgccaaacggttggcacctgagcagtgttgccgaagtcgaactactgtccttgactccacggcgaaggtcccgagcctggctgaatcggtggcaaccaattaggcgcaccttgacttgtattccccaccgggtgagccgatggggttgtacttgaaatgtagtggggttggttgagttgctgaaggaaagcttggagttgcgcctgcagagccgaagccccttccgccactgtttgtgtcgcttggccaggtggttgatgctgcccgacgaagtacaccggcggctgtgcggctagtggcggagagggctgggtcaccacttgcggccggacttgagaaggggcatagcctgccgaatactgaaggattggagccgacgtggccttggtccgccttgtcgcctcgtatgcttgttgttgttctagcatttggcaaagcatgtcttggagccgtgtcatgttctgccgcatggcttccatgtcggcttcggcttgcgcttcggggtccaggctgatttgggcctgtacaacggcgagcgcagttggcgccgccggctgtgatggggcggcttgaggcaccaccagttggtttgtcgaaaggatctccgccctggtctggagtgctcttgccgccgcagccgccttcgccacgtcggccgtgttcggcacttgcactgaggttgcgggggccgaagacggttgtgatggcgcgggggccgagggcgactgtgatggcgcttgtccttctacatcttcggtcacggacgccgaaggctctgctccttcctcggcggccatgtccggtccggcgtcgctctccttccacctgacgaccttctccttcacgaccctcttcagtggcattcgctctcagtggtttcgttcggactccccatggtcggcgccagctgttgtcgaaacgacaactgcgtacgtcgaaggacgtggttactcaacagtggttgggaaaatgaagtgtactaaattttgaatttcacttgggatcccccgttacatggcctagggggctatttatagccctattgcaggctcttactactaggatctaggttgtacaggggaatttacatgattacccttatgaaagggacatttacaggggtacataatgttatagggtctcatgggcccctgatgggccgtctagtgatcaccggcccttaggcttgatgggccggaaaggcttcctcggcccttgcgggggcgaacttgccatggcgaagtcgtcttccttcggcagatagtcttcgccttgcacccttcgcccgagacgcccctggcttggcaaggccctcgcgcgactcttcgcctcacgccgttcttgctccatagccttcgccacgggtttcggcagatctggtcgaagagcctcatgccatccgccaacaaacgtgattttagaaacatttagaaaaaaataatctaatttggagtttatataagtgcggtaaacttgttttaaattttattttaatatacagctccttaagacgcccgtatgtaaaaatgagtttatttttgcatgcggaccttttaagaggcccgtatgaaaaaatcaatttcttaatcaaaattagctaactattgcaagaagaggaataagtctattttccctcgctaatgtcttactcttgattgaatcctctccctcaaccacaaaattggatataagaaaattactaacactaaaatttagaaatgttgatatgttctattagaaaaaataacgagctatatctcttccttgatttgagaatctcggtttgaggggttttttactttgatatttatttgttaccgtattcgttccgtttcgtattcgctccgtatatgtattcgacaatattcgattccgttttcgtatccggagtttccgatttcgattccgattccaaaaagaaaatatgaaaatgaatatggtagagctagtttccatccgtatccgttttcatctccaatgacatcgatcgatcggtagccagatttggctcctttttcttgtgcgcgcgcgggggatcttgttgtcgagtcggatccgctcacttttgatgggccatatgaccatttgggccagagtaggaaggcccattttggaagaaagttacacctctatttggaccaaatattctactactatatactacggtgtatacgcatgcacagtgtacgtataccttatgcgtagttttagccttagaattactttatgcgtctactttgccattttagtttttttaaaaaaaaaatcttatgtgttccgtgaactagcaaatgtatgtgagtttgaatggcaagtggaggttcgctgctggtttgtgaaaacgctaggggattaattaatattgccaagttttaataggatttcttatatatttatcaaagtttggtaagaaactaaatggatgcacatctttaataacttttatgaaaaaatgatatggtttaaaataacataaatatggacaacccttagttgttaattttattcacctcatatataaaaaaaatctagataacggctgtaggaataggataacttgaaaggtatatgttatttccatcaaaacggttggacaggcatgcggcacgatttcctactaagcggtaggcggcggcgggcggtcggctgcgccctcccctctgccagagggaaggcgggaggcggcagcggcagcggtggattttgtttgttctttttttttagaatttgtgattcatggtatggatctgagatatataatctgtgatgtatttgatttgtgatgtatttttttggagaattttttatatgaacttatgatttgtgatgttactttgattttaggatatgtagggcactcgatttgggaaaatcatgtagggatcaactcgaaggaaaaatcaaaatgcaagcagcaaagaaacaatgaaaaaaaaagaaaaaaatgatgaccaaccgggactgccactaccatctttagtcatgattggtaaacatctaactttagtcccggttatttcacccgggactaaagatggacgaccatctttagtcccgggttgcatttagtctcggtttgtaatataggactaaaggggttgtaaaccaggactaaagaagagttttccgggagtgaaagtaaacgatcaaatatattatttgaatgtatagcaatgcattggattttcagatggaccaagcggctagtaaattaatcagacaaaagtataaacgtgatttttttatcattatttgaacctttttaatttttaattttaaaataaaccatctcaaaacttattaccaaaatctaaaacttttggtgtaacaaaacaatactgccaccagcgggtgtggcagtttgccatgacaacgccatgctgttacattagctataccgatgtggccaaataacattgctacgtcatccacatcgatatgggagtattattttaccacgccagcctatcttatactgtggtagtgttgttttgtcatgttagtctgactggcgtagctaatgtttctgattttgaaaattagttttagaaaaatttattttaaattaaaaatttaaaaggttcaaaaagtaaaagaagttctagaaacatgttgtagacacaaaattaacacgcgttattgattgcttcaatttcatatctagcgccaacatggcagcatgattaatgacgcattttccttaatcccctttggcaacttaattatatccaactaaaggataaaattcaagtgaggaacgaggatccccaaaacttagcgaagaaaattatcaccagttatttctttttaataatgaaaatgtattacatctctgccatctgtcataaggcatgcaaccaattagttcttattaaaataaataaaatgagttgtgggacaaatctccagttaccttgaaaaataaaagcagatgacacactaaaatgatcaccagttaattaattactagagaatggaacaatatatacctccaaaattatagtacgtcgtgttaaattatacaaagacatacatgtgctccatgtgccacactagttgggagctgcttctttttttatttatttcttgtgaagactgagctgatagattaattagtcctcttattttgtttatttcagtttaatcaaggattaatgactcttcagccttgcaaaggccatcatatcgaattaatgacccatactatttttaatcgcaaaaaaatgtgaaaggaatgatcgatcgatatcaataaaacttaaggtttttgtataccatttcagatgagctgccacgtgctaccttgctactgtagaaactacagtccttgcatgctatccacaccgttcgattgtggctgcaagcatctctgcccttgagcgtgtcttcccagggagcctcggctgctctccaggggacccccatttttttccccatcggttgattcatcccccagcttctctatttgcacgcagttcacacgcttcctccgtcgatccatccagcgccgccggtggcatcgccgcctcccttgcccagtgtgttcttgcgtcttctttggcttagctgtggacggccgtggtcttctgctcggtggcttcgtctccaccatctccattccatccgtcagaggctgtcgccgtccgcgagtagcagcagcctctcctctcccagtgacagtccagttgcgccaccaccgacgaccttttgccttaccggttggttctccggtgcccattgccatcgtgtgcgggagcaatgccctctttttcccacggcagtccaggcaagaaaatccttctatccccattgttgtacagaagaaacccttaggcctttagaaatgtcgttctttgatttattatgtaccattgtgacagattcccttaacctgtatttttaatggtgcaagttacttattatcaagcatgtgattcaataatccctactgattaagcatttaattgaatttagcctgctacagtggttatgggatggttgcctgctgcccccaagtccacgacatacacatattaaagttgtccatatttaggttcatgcttagctttccataatactccattgtgtactcatctgcttgctttatgattttgttttgccattttgtataaatatctaggagtggtttggtgatggggatggatgcggtgcctgacactctaacaccaacaccattttctcagctaacttagggacaaatgagacagagaacaggccaggtgctactcctacacattattcggcatattcaactttctttgctttttctcaattctcaactacagttttcttatgttgagcggaaaacttattgatgatttatttctttgtgttctaagtgctcctagcagtgaaagctctaaccataccatatcttttatctcaactcctgaaataggaatctccatgtcagtgttttgtcgtccatttcaacgacccgttaacaggaggcttgcatttaaccctatcaatcctgctactccaatagatcaacattttgtctcctcatcagatggcccaacagtgccaggtgttcagtcccttcctgcagtgcgcggtaaaggtaagcccctctattaagaattaatctctatttgattgtgctcaagcttgctatactaccattgtatcattttagattcataaatgccagttcaggtacctgtgccatagttgtacatatttgttcctttgtgtctgctcatataaatttggatgcttctcacattggcataggtcctttggataatattggtttgagactgcctcgaccagatccatctattgctacggaagcacgcaagaagcgtaaagtcacaatggttttaaggagaggacataagttacccatatccaatattttctccttcaactaactggcttatttgttgcttccattggttcctacatttctatttgatttcgttcagcaagtgctgattcgaccaatctatagctcctcaatttgtgattgttacattaggagctggacctgatgatttctcatcttcatatcgatgtgttcaacgatgtatttccccacaagttaatgccaggcattgtgatgtgcggatagccaggaataatgggatgagtactactattggcgcttctccttcatctcacattgcccaaaatgacacctccttgcatagggtgaatacatgtcaacgaagccgtgtagggcggtccagagctgatggtaccttatttagtttgctatgatttttccttatttttacctgt

SEQ ID NO: 75194 - DNA, 2838 bp, Oryza sativa
tttccaaaagcaaacggaattaaaaaccgactcatacacggatgacgtaccaaaataccggcaaaaacatttttaatttttataatagtagatatatgagtattaaagttattgagttttatgtgttagaggtaacttaaggttacccttaatttatagggggtgacaagaataaagttagagatggtagccgtctcaaatactctctccgtttctaaatatttgacgtcgttgatttttttaaacatatttagctatttgtcttattcaaaaacttttgtgaatattatttaaaaattttagtagtagtatatttaacaatgaatcaaatggtagaaaaataattaataattaattaaattttttaaataagacgaacggtcaaacaagtttaaaaaagtccagcgtagggacggagggagtataagggtctgtttggggagctttagattataagaagcagttgtttgatagccagcttctgagaatctgaaaaagctctgaaacccagcttctctagcttctggcttcttagttaaagctgtggattgtttgggacagcttctagcagaagcagcttttgagaaaaactgcagctggaataacatcccccaaactttctcaccactgcggctctaaacctctcctatctatatatccgtgctcgatctgagaactccagtagtcgatccactgctaacccctaccgagttaacacttaacacctagtcatatcgcagatcgagcttagctagaatggcgcgaatgcttgagaccgtgtcggagatggagaacaccgaggcggccgatggagatggagctacagctacctggagaagatccggtgcatgtccacgggtggcgggtcgtcgtctcgctcagtgagatccagtaactacagcagcgcgtcaagcaccgcgtccagtgcgcgtcctaggtacgtcccctgctacgatgatgctgatttcgtgacctactccttccagagggcagtaggacttggagcccccggacctgctcgagatattcgtgggcagcttggtgagtgagttcagccgggcatccggatccggccctgcgctggacaggtggttctcagaactggacgtcagctgtgtactccgcaatgatcaggaggaggaggaggcgaccgggagcctggtggggaggtgggcgcgagctctcactgtgatggcgcgcgcgctgatcgccacgctccaggaccaggaggacaacctcaccggccgactctgccaactcgggcggcttatggaggcgagtttctccaagatccaacttgcacagttcgcgcaggcgactttctccaagatgcttgcctttgccaacgccctcgctgataagccttggacgcggccaacggacaagttctcggggctcatgcaactccgcatctgcatcaacgacgtctcagatatcctcgtcccgctgtacaatgaggttttcttactagctgattattcaaaagaaataattgaaagcatagtaaaggagatcgatgatgttttctgggtagagccatattgatgatgacgacggacgccttgagccccccgagtggaccatttccggacaatgcagaaatccacaaggctactctgttagctgtcaactatgcaatattgttttggggataccatagcgtgctggaggccatcctacttgataatggcgatttgtttggtaattgcagttggtattctgagaagctagtagtagaaagattgattgtgcaaattataaccaacttgcaggatgagctcgagaagaaatccaagttgttctctgaccatagcctgagatatctgttcttgcttaacaattcctacgtcgtacaatatcagtttcttgtacccagcgactacagccctccatcggaaataaagttccactatgagcagtaccaaaaagagtatatgcgtgcctcctgggaacctgttctgtcttgcctacacgataagatgccaccgtgcttccctaagctctcatcgcattcggagctgtcaagattcgagttggaatttgagaaaacatgcagtcatcagaagctgtggaaggtcccgcttccgaatcttaggcagagcctgcgagaaaccatcattaataagatcattactagatacaaaaagtacatggaggaccatccagagcaggagaaatgcggcagagatccactggacatggaaggcatggtgaatgatctatttgaaggatgaaggggttgctacagtttcagaatgacaggcccgcacaaatagagtataagttttaaagcagctacgaagaggaggccaaggttaaataggtgttcttgatgtcctttttacttttaccgtattttgatgtcgggtgcaattgtgttcttatcccttgtttcttaactccagcggtgattttacccctaccattttaactttgtgattttatcatcatttttagttgaagcttgtgcctgcgcccattccattaagaggacttaaagttgtaaaagttcatgtcaaaaggggcaaacttcatgttaagcttgtactcgccctccttttttttaactgaatatgtgaaaattcattcaaaacacaaagtcatgttaaaatagcggcaaaatcacaaagtccttagcaaagtaggggcaaatatgcaagtgcacagatgtctttgacaccattaaatccttttaatggatgagagaaaacacaagcttccgttgaaaagaaatgagggcaaaaaaaccattggagttcaaaaaaaaaaaaggagggtaagaattgtgatggctactctgatgttcccccgttcgacccttaggtaatcctcatttta

SEQ ID NO: 75195 - DNA, 32092 bp, Oryza sativa
gaagaatcacagaaaaattcaaatgcagaatttttgaattcagagccattatcactgcgaattgctcgaagagcaccaggaaactccaaagccaaactacgagcaagagactgaaagaagccaaacgtttcctcttttgatcaagaaatagacccaagagtagcgagagaaatcatccacaacaaccaagacataccacttccccccaattgactggacccgagcaggaccaaccgtatccatgtgaagcagttatcccggtccatctgtcataaccattgtaacaggcttgtgggaggaagatgtcatttttccatgacgacatggtgcacacataagacctttcggagctttcaacttaggcgaaccccgaatcaaatccataccactaatgcgagacaagtagtcaaagccaatatgaccaagacgacgatgccagaaaaacaaatccctattctctgaggcaatgagacaacgagaaggaccaggagcagaagagtcgaagttagcaaagaaaactcgaccaactcgagaaatgtcaaaaataggagattcagaagcatcaagaactcgagacctgtccttttcgaaacgaacttccagattttcatcacagagttgtgaaacagagagcgaattgtacttaagcttacttacaagcgcgacatccttcagcatgaatttgtcattgaccttgattgttcctttagccatcacgcgtccactgctcgcatccccaaaagtgatggtctcatcaccggatgcacgagtgagagaagtaaaccacttggcttcactggtcatgtggcgtgagcaaccggagtccacaagccaagaattacttctccccactccaaaatcctacaagaaagacaaagcagatcttgatgattcagtactggggttagtgagaaatgacataggaatccagtactgaaccatgcgaggagtacaagcatctttagtgttatgagcataattatatgcaagatgaccatgtctgttttgccccaaccctgctaggccacgtcgagggtgcgcatctcggcgaggaaagcgagatacaccacttgaacgacaatgacacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcttggtttgtttctggttttgcttgtgctcaacttgttttggatttttgggtctaggtaactctataggcttagacttgctagtcataggtaccatctttggttctgaggttttgggtgaactagaactagtgtttccaatgaaacctgcagacttgaaggttataggtttttgagctagttatatcatcccatctgtgacacctaaaatttcatgggtacttatcctcaaagactcagcaaaattatagcctataccttgattgtttatggacactttggattggtctaggatcatgttcaactttttctttccttgagcaaacctctctaaagattgttgtaggtatgagttctctctcttagcagactcaagatcaactttcagagaaatgcatgatgaacaagaatcaatagatttgatagaataaatgacagttttagcatcttttagttcagtatccaggatagcacaattagcacatgaagaatgaacaggttccttagtagcaaaagattctaacaaatcattattggtcctaagcatggcaacttgttgtcttaattcatcattgtcactagtgaaaatgggacaattttcacacctaccaatcctatcatgaacaaatttttcttttaattctttcaattccatctcaagcaaacccatatcaactttcattttatagcaagtagagcaagcagcactagcactagaaggattcccagctcctaaagcacatgatttcaacttattcttgaggagattaatttcagaaagatatgaagcacaagtagaacatgtatcctcctcaggaatcatggatcgaagcctagcaatttctagcgccattccatcattttcagattttagtttctcaattttatacttagaagacctatacttgtcactaatttcaatcatcaagtgtgccattctttctttgcttagttcatcatcaacagagtcattatctgagcaagaatcatcacaaggagaaccatccaaggaagggatatcatcaagacatacctcaagatgctccgatgagtcatccttatcctcaagtgccatgagacacaggttgatgaagtcctcgttgttggcgagatagcacatcctggagaagtccttgtcccccttttcttgatcatcgtcatcggagtcgatgtcgctaagctgcacctcctcaagagtcgccaagaccttgtggatcgccttcttcatcaaatcctttctcccctttcgcccttgtccctcgggcttcttggtcgtcttgtcactcttcttcttcaacttgggacaattcactcttatgtggttaggctctccacactcaaaacacacaaatggttcattggtttttctcctttctctctctctcacattcttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactatctgtgatggaagtaactttcatttcccaaacaccataatcaagacaattcaaaagatggcgagcattatcattatcagaaaattcttttccaacagatcacaacttcgaaacaatttctccaaaacgcttgaaataagaatcaatggactctcctgggtgcatctcaaatctttgatattctttatgaaattgattctgacgaaccaattgaatatcattgtttccctcatggaaatttcacagagcagtccacatgtcatgagcggacttgtggtgttaaacacgattaaattcaccaaaagaaattccaccaatgattgcatttcttgcacgataattaaaatcaacctgagccacatttgcaggcgtgatgtcatcatcatcgggcacagtgtaaggagatttaaccttattccacacattattcccttgcgactggaggtaggcctccattcgtgccttccaaatgacaaaattgtgtccatcgaaaacaaatggtttcgcagagtatttttcctccatagcggcattcgttgccacggttaggttacaacgaacttaaccgggctctgataccaattgaaagaccaagaacggctatagagtggggggtgaatatagcaattcaaaacttgtccccaaaaatactcatcaagccggatttctcaaaattcttactagaaccgcggctattagagaagccggatctagaaaagaagagagatggaattctcgaatctagaagtgaggtgaggagaagatagcaaaactcgtcatcgcgaaattcaaatcgcaagcggaatttaaattgcggaatttaaaaggcgaagacaaaacgaaatgcttcaaatcattttattcatcggtgttgcaaaataaccgctcaactaggagcaaacatacacctttagaggaacattaacacaaactttaaaatctctcggacaaacacactccaaactaatcctaatacaaaagcctctcgggcaaacacactccaaactcacaccgaaactctctcaccgagcatctcaaaaggattacaaaagaagcaaccttcacccttgcatccacctctccatttatagcctaagacctcgtaagacattgtcacaaatgtctttagggcgaaaccctaactcagatgcaatctgggccttaggttgttccttacatcctaaggaagtagcctggattgaagccacgtcgcttgccacatcgggatcctcttttcacaaagagtctgcaccaaattcctcccatgtgcgtgcccgcgtgctcctcaacgtgggccccgtgatctgtgagaaggctcctctgagccaatcagcatgcaccgatcgggagatcgatccgcgtcgtctccgtcttgccgaatcgaaacttgccacgttgcccagccgtgccatgcgcgtcctgtctccttttcctcagcgcgcgcgcatgcccgcgccctgtccggagccgccacgcgtctcgccgagccgctccgcgcgcgctcgcgaaaaccgcgtgggtcccacccccgtgcgcaccgaattccttgccgccgcgtgtccactgcgcgcgcatgcctcgcgcgatttcccgcgcttgcccatgcatggtgtcgatgccatgggccgtcgtcttgtcttgggcctgctcggcctggcctccctgccagctgatccatccatcatcttgagccacgaagaagggctggattggcttggcctccctgccaaccaatcacaacacacatgcacccatgggctagcaagctcctcatgcacacatgcatgtcttgagcccgtgcatggcattcggccatgtgcacgcatgcataaccgaagcaccactgcccatgcttgcatatgcacataccagtgcatgtatacaagctcctcttccattctccattttcttcgcgaacccggcacttgcacttgaccttgcgaactccgttgcgaagacctcctcacatggtgtccgtccaccgtgtgcaaccttgtgtccaatcttgtcacccagcatccttgatcgctctggacctcaactcctccctgagtctagtaccgatccgtcgttgactaagatcgaccccgatcacctgcacacacatgaatcaaacaaccgttgtcttggcacagatgtcgcaacctgaccaatgttagtctacgcacacacttcttgcacttccggtacttgtcaatttcccatcacaaaagaactataaccacacatggtttcacatcactagagtcttgaatagggattccttggaaaattttcagcatagtggataaatccacaaagctactcggctaattgtggactatgcaagattgttttggggatacgagggcttgttgcgtcacatcctgctttccaaatgggatcctcactcggacgaccgatgctctcaacttccgatcaccatgattcagcaaatgctcatcaactttgaagatcagctggagaagaactcagagtcattctctgaccctagcctgaggtaccagttcctgcttaacaattcctacttcgtaagagaagagtttcttgagcccagcaattacgtgtacatccttccgtcaggcacaacgctcaaatttatgcagtaccaagagaagtacatgcttgcctcctgggaacctgttctgtattgcctacaggataagatgccgctgtggtttcctaaacactcctcacagctgtcaagattcaagtcagaatttcagaaaacatgtactccacatcagaagctatggaaggtccccaacccaaggctcaggcagaaactgcgagaagccatcactgataaggtcattactggatacaaaaggtacctggaggaccatccggagctggagaaatgcagcagtgatctacaggacatggaagacatggtcaacgagctatttgaaggatgaataaggattattccagttttagactgacatggccatgcgtatatggagtgtaaactttaaatcagctacgacgagaagagacaaacaagttcacacttgatgccttttttattgtattttgatgttctatcctcattctacttttttctaggaaatcctcattctaccttactaggaataaaatgtatcaatataaaaaaagaataaaatgtatcgacagtttaatacaagcttcttcctgtattattatctcctcagctctttaaaatttacagtggctttataatataagtgtacgtactttacactgtaaaaatgatttgactattttttagtaaaaaaagtggcttcgtaaatattgtattcccttcggttttgctctaaatttgttctacaaatggactctttcacggctagttccctttagcaccgtgtgataccctaaaaaattgatgaaaaagaaaaggaaatagaggagagaaaagctagtgggctgtgttgaggcctagatgaccataggcccagcccactcttgagaaggaagagctaggaataagtctatttgtagtccctgaattattgtccttggttgaatcgtatccctcaaccataaaacagggcatacaggccgaaacttctaatggtcgatcgatcgccatggagatcaggattcgcccccgtctcccctccctctttccacctagtttccttttttggcaccgtattactttcctattttagtaaatttatgcacctaaagtttatagacctcaagtttacatatctaaagtttagagaccaaaagtttataagtcaaaagtttatatatccgattcaaatttgaatttaaattcaaatattttttatatatagtatctatctatctattatattattaaaacagctttgaaaggagtcaccacgttcgccgtgagggctagaaattcccaaattaatcggagaaaaagaaaaggagagtccaagtagaaatacaatttaaaaatagctgaaattcagaattaaaaataagcaatattgaaagaagagtccatataagaacccaatacgagattaatcaaaatttggaataaaaataaaataaaatccaaaattagaaaagaataggagagtccatgtaagaatacaattaaaaaataactgaaattcgaaattaaagataaggaatattgagagaagagtccatataagaacccaagacgagattaataatattcagaataaaaataaaaataaaatccaaaattagcaaaaaaaaaagaagagttcaagtagaaataatatttaaaataaaccgaaattcggaattaaaaataagcaatattgaaaaaagaatacatataagaacccaatacgagattaattaaaattcaaaattaaaaataaaataatatctaaaattagaaaaattaaaagagagttcaagtagcaatatattttgaaacaactgaaattcaaaaataaaaatattataagaacactatacggtattaattaaaatttgaaaaaaaatctaaaattagaaaaagaaaaaaatatttcaattaggaatagaatttataaataactaaaattggtgataaaaaaaataaagactactgaaaaaaaagaccatctgaaacacatgacaagataaattaagtaacatgcttagaaaggagtagagtggtgacgattgatacgacatataaaaattgttaataaaacaccaaatagaatcctaatgacgattaaaaggagcgacgacaggcaagccgtgaagcaaatgggcaagacagttgccgggacttctagaaagtaaaaaaataaacctcattgataatcatattcaatttttaaaatctcagtggcaataaaaaggagaagcagtgggcggggtgtataggagtatagttgtagagccgtggacggttagcgggacttatagaaaataaaaaatgaatttcaacgatagttatatttgatttttagaatcccaatgacaataaagagtaggcggcggatggaccgtagagaagtattgtggcatcgtttgacgggacttgtaaaaattataaaaaatggaacctaacaagacaataaactctaaaaactacaaaactacaagatccaattgttaaaggttgggaactactaaaaagtaaaaaaaaaatacaataataatcatgttcgattttaaaatctcaatgacaataaagaagagagacagcgggcgagccataaaggagtacaatggcaaagtcgctgacagtttggcgggacttctagaaagtaaaaaattaaacccgaacgataattatgttcgatttataaaatcacaatggcaataaagagaaaagacagtgtacggtccgtataggggtataatggcagcgtttgacgggacttctagaaattataaaaacgaaacccaacaagacaataaactctaaaaactacaagtccaatttttaaaggtttcaaggagaatgaatagaactagtggtagatcgagcaagcaaataaagaagaatatgacagaagtaaggggtagcagctggtgtgacttttaaaaactatataattagaaatacgcaaatgataaggtttggtctttcaaagtcttaagacaacgagatagctatttaataaattttaaggaaaattatactgaaaaatgtatgattttgtttgggtgctaggtgcgcaattgcgcgggccacccggctagtttctatacatctaatgtttatacacctaaagtttatagacctaaagtttataagtcaaaagtttatatacccgtttcaaatttgaatttgaattcaaatattttctatatatagtatttctatacatataaagtttatacacctatagtttatagatccaaagtttataagtcaaaagtttacatacccgattcaaatttgaatttaaatttaaattttttatatatagtatttctatacataaattttctaacttttgtttttcttttaaaaaaatgtgatgtactgtagtagaaagagaagaaggggaggaggaagggggagaagaggaaggagcgtattgcgtatagggggaggggagtgcgggtgatcgctcacattagcaacaccctatagaggctccctcaactataaaaacaggatcaatttgtctcctcgagctgtttgaacggtggttttatcctacgtgagacgttgaccaagtctttatttgacgtagcacctacatggcaacgtagtaaaaaaaaaaaggtgggaccaaagatgctgccctccctgatctagctggccagcgccgtagccgtccccgtcatcccaagcattccgcaatgcgggatgggagcggctgccccagcgtgccgacctggccatgcaattccatcgggagatgttgcaccgacaccgccgccgctgcctgctgctactgctgctgttgccggttgaagttgatcatgtcgtcgcggacgcgtagctcctccgcctgcttcgccatctctaggactcaagctgttgcagcgatggcgaatgcgagagggagagagcccctggtcttcaccacgctgtccgcaccggcgccgagctgcaccggcgccgccgaacgcagggaatgcttcgtggtgctggtggatagccgacagcgtgtccgactgcggcggtgacgtcgatgaccgggattgctgctgctgtgtgggttcatcaagaagaggtgcatcgccatagctgggtcggtggcaaggccaaccatggcaaagttcatcgcaattttagtaaacaacacaaagcacaacaatccgtcatcatcgatctgctctgctcctctcatggtcaggcatctcagtaatccgtcggtggttggttgccgtcaatgtcataggtctctgccacagcatgatccctttgtagctgctgttcttggtcctgatctcgtcggtgcaccttcttgctcaccttcattcagattgcagttgggttagtggagaagggatttcaaaagattaattattggttgcaaagtgcaaaatgttgcatcaatggagaagtagtttgcaaagattgattcttagagtgactcgattaatttgcttgtttgattgattgatcaccttgtgtgatcttgcgtggaggcggtgatcggaggacaccaccttccggcgaggtaggctccagcagccgcccctgagggggctcttgctgccgggcttgtaccagttgacaatggacatgtcgttgaccctgcaacgctccttctcctcgccggcgccggcgaggtcgcgccgccactgaaccatgatcacctgcgcaccgcgattcctgggagtgggacatatatagaagaactcatcatggccgccgatcagatcctcgcgcagccttggtgggttggctcacgaacatggcggtttggcctagctgagacgatggtgctgctatttccactgccaacatcgtcggctgatggaaaagagaggagagaggaagatagtgaggggaaaagaggagagtcattgatatataggacccacattttatgttagcaaaccattaaaaaagtctatttataccggtttttaaagataggggagctcttatatctgattttacggttgagagatgagattcaagtattcaaccaagagttaagtagccatttgggcaaccagcgagcagcatgcattgatgcatagcaggagaagtgcgacacggcagcaagcagcagatgcatgcacatgtagtggcaccttgataattgctcggaggagtggtttaaagaggatgaataatttggaccttttacacgaaacgataaataactatagtgtgttgtaatgaaagtaaactaccggagaaataatctttattaggtcggttctaatataagctgggactaaaaaattttatttagtcccggttaaaaatttgttgatctttatcaactgggactaaagacatctttagtcctggttcatcccctgtcagaggcctgtcaggggaccgagaatctttagtcctggttgatactactaaccgggactaaagattaccaatttaatcccagtttaaaaatctatctttagtaactccaaccgggagtaaatatttctctcctatctctgatcggttaagtcctagacgagacttttctcctcaccaagatatttagataagattagatcgatctcattccctctccacctaactcctcagatccccttcctcctcctcctccctcatctcctcctccccctctcctccccctcctcccctcccatccggcggtcggcggcggcaggtaggcagggccgcgcggcggcggctggcgggaccgcgcacgggcgtggcgagcggcggcaggcaaggccgcgcgcgggcgtgatgagcggcggcaggcggcagccgtggtgggcaatagcgtcgattctctttttttttagataatttgtgattcactgagatgtataatttctttttttttagaatttgttattcattgcatagatctgagatgtatttgatttgtgtgtaatttttgtaggatttgtgatgtatttgatttgtgtgtataagtaacttaggatttgtgatgtgaatggtttgtgatgttactctgatttggggatttgaggtttgatttgaagatatgactggcactcgatttgggagaaaatatagggattaactctgtcaattagcaaagaaataatgaaaaaaaaagaaaaggggaccaaccgggactgtcctaccctctctttactcccggttggtaatactaaccgggactaaagattcaactttactctcggttatttcacctggaactaatgatgggtattttagtcctggttagaaaaccgggattatagaggttctcaatcaggagtaaaaacggttttcccagtggtggtataatctaataaattgtgttggatctaaaaccattaattttcagggatgcagctactctgacgtaaagtcataggaatatagatccctgatagatgagattcaccaatatagatccattcccgagtgaccgatgttactctgacgtaggccctgtttgggagagcttctcctagctgtagctttttctaaaagctgcttctgcttgaagctgccacaaacggtccacagcttctgagaatctgtagttacagattctgaaaaatgaactaagaagacagaagctggagaagctgggtttcagagcttttccagattctcagaatctaaaactcccccaaacagggcggccgtagtatgttagaggagcctagcattttcaggtgttaacagttatgcattgttcgggtcttaggagtgacacatcgtacgagcatatggaccacagcaaactagatagttcttggggtaagttgccaatattactaagttttggcatgtttgcttatgtatctactaaagtttgataaaaaactaaatatatgtatatttttagtaactttattagaaaatggtatagtttaaaatgatattaatctgaacaacctatttatatggaccgttgaactgagcaattaaaaagtgtggtctatacagaaattatgatacttagggggtgtttcgatctagatactaaactttagtccttgtcacattaaatatttggacacctatttagagtattaaacatagactaataataaaactaatttcacaaatgagagctaattcgcgagacgaattctttaagcctaattaatccataattagcagatgtttactgtagcatcacataggctaatcatagattaattaggctcaatagattcgtctcgcgaataagtgcagggttataaaatgggttttgtaattagtctatattgaatactctaaattagcgtcaaacatccgatgtgacagggacaaaaagaaaatttagccccatccaaatacccccttaagagacctaggttcggcctttcaaccttctcatatttcatctggattaactgatggcttctcctatcttattatcattggatggctagcttcttctggctatcccaatattttttaggatttgatatcctggatttttcaccttttagttcttttagaaaaactcattatttttaaaaaacttattctataaatagatgtcacgcccggaatttctatccaaaattccaaacgcttacatgtgtgtgaaccctcgtccaggaatcagccgagacacacaataacaaattgataatagagtacaattattactctaattaataagcgaataaaatgtcattacagaggtagatagttcctctcaatcaataaatatctaagcagcggaaaataaaataaacggcgcagacgactccactccactggcagcttgaccagggctacgcctaatcctccacaccatcagcatcattgtagaactcttcctctgatgaatgattgcaaggtgagtatatgacatactcagcaagccacgcagcaaatatgcaagtgcacaaggataccaaagaatggcataatatagggctcatttgcaaaagcagcatttagcaaacatttgagaattataaaacagttaagtaataattaaacaatattaatccaacactatacaacataccctgttgcataggcccaaccattctgaacaaccatcccggctgcacaattctatctccaaacaaggaatataccattccaaaccaggagctaaacaaattaataccagttataacatcttctattatgatgagaagtgtgaaactaatcacgaaagacattgtttgacccgcccataactgcgggcacggctattcgaatagttttactctgatcagaggtgtaccactgtacccacaagacacagccccacatcatgtcaccatgtgcctcaataccaccacggtaccttggaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacgattaacgtttcacaaccgaaactcgtgaactggtccttaattgtcatgagcacgactctcaaaaccatgtgctcacaacccaccattatcaagttttagttggcaattaattaattaaccaatcacgattgaccatcgcgaactatcattaagccatcattaaataatagtgagtcataagttatcccaatagtgtgctaatgtttctaagcatgactaagcaatcacatctaatatctagctgaaccaatatatataaagctcaactagtcaagttataataacccaaggtatcaaggaataaagtaatcaagaacaaaagggctataacaaataataggttaattccacccaatgacattcgaaaataaatgcaatagttgaatagaaacaatagctttaaacgggatcaacatgctcaaagggttgtttggaatctgtgtgacttgccttgctggccttggaactcttcaaattcttctcctgcgaaaacggactctccggaaacgtcggaatctaagcagaaagaagcaaaatcaccaaaacagcacataaacaagcatgaacagtatatgtggatatttttaaaatgtagatctcaattttagaaaaatttagagacttgaaccaactaaatccgagctaagatgaattagttatgaattttagaagattaaatcggattaaaacacttatatggattttaattgaattatgacgcaataatgaattattttagaaaaggaaaagggatttattgcgtcagcggctagggtttgcggtggaccgggcgcacggcagcggttcacgggaacggacggccgagatcaatccatccaaaacggacggccgagatcgatcgggtctacggcggctcacggaaaaacgacgacgatgacgtcggcgatgacgtcaccaccggcgacggctcggcggctcgagcgcgcatgctcgctggcgaacgacggcacggcggtgcaaacggaggacaccaaaacggtgcgggcatcgcggcgaactcaccggtgaccaaagcaacggcggaggagcaacgaacgacgtcggcgacgaggtcgaagcggcggagaaggtcgggtcgacggcggcgacggtgctccggcggttgacagcgacggcgaaggggcggacgaggacggcgacgacttggcgaccacgatggcgatcttcccgaacgacgacgacgaccggaacggcggcggcgcacggctggagcggcggcgacgacggcggctcgaggtttcacggcgctagggcgctcccgacggcgagagacgaaggcgagggtggcggcgggtagaggagacaccggggatccttttataggggcaaggaggcggcggcgaaggcccacggcgaccggcaacgcgaaggaaaggtgaggatccggaggaaagagacgaatccgactcgagatcgaatccacggatttccaaacgattttagccggtgattccaaaagagaaaagatagaggagatcccgaagatcatttcccctctattgatttcactggaaacggaaaggatcggccgaatttggaaggagacggcggcggcacggcgctagggtttcgggcgacgggcggccggaggaagacgacgaccccgacaggcgggccccacctgtcagcgagcgaaagcgcgcgcgcggctgcggcggactgggccgacttgggccgggggagagagagaaggttttgggccgactttcggcccaaagccaaaagagacttttaaaatcatttttcaatttaaattattcattaaatgcaattccatttattaaaaatacttccttagctcaaataaatcccagaaaaatctaggaattatagaattaagcaaagtatttaatgaaattttatctggccccattttacattggaatttattaattaaaattagatcttctcttctaggcttttaaaataaattctaataattccaattaaacaacaatttatatatttttggatttttagggtgtgacaatagacctcagaaaaaaatttattttaaaaattttctttttcttcttcgtactgattcgtatggaattagcctgactcggcgcacgatgccaatgttattagtgtcgtggtcaaatatgaagacggtcattggcaccatcccctccatccccaggtggaagctatggcactgatgtgagagggagaacgtcaatatcattggtgtcgatgatttatttgtaaaaaaataaaaattatctatttataattaaaaagtatatacaaataggtcatcagcgtcaatgctgaggatctatttgtaaatattattttattgcaaataggaccatttttgttacaaatagatcttttttatataaaaaagtgcgatttggttatcctttacattagtgacttagctttcacctagaagtggagggcgctgtcttattggactacgacaccaatgatattggtgcagtgaatgttatgaaaatagatgcataatggagacacgaattttacgtggaaaaaccttacgagaaaaaaccatgggtggcgatcggcaatgatcactattgagcagttgattttaaacgtaggggaataacaatgagaacccaccccttcccatacaacttacaagagtatatataggagataaaagaaagtcacataataagaaaagacatagagtcctattaggaaactaattcgaatacattgtaggcctaaaatttgtatcacataccgtatttaacaatctgcaccttgagacgaatttcctcttgtaacataaaaatcatcaatcaccagaatacctcatgtaggtaaaatcaccgtgcaccaaataatctgtaggactataatgcaacacgaaccaaacttgagcaaagctcaaacttagtagcatgaattagctttgtcatcatatcagataggttatcatgattacttatcttgcataacttgacatcaccttcagcaatcacacctcgaataaagtgatatctcacattaatgtgctttgttctctcatgaaatatctgatccttagtaaggcatatatcacccatcaaaatagtaccaccttgcacaacttcatagttggcaaaccaatccctattcgagcacatgtgataggtgcaagcagtatcaaaaatccattggtcactactttatgcacaaccagcataagcaataagcaattctgcattagacttctcattaataacaaccgcggctttaccttccacttctttattactttttggtatgtactttccggttcttttgtccttgttctgtagcttccaacactcagagatattatgtccatatctcttgtagtatttgcatgacttatacatgcatttagactttgatctcccacgatagctacttgaactttcatctcttgattggttctttatgttcttctcctattgcctgccccgaacaaccaaaccttctgcttgtgaacttgaactttcagagggtaacatcttcctttcttttgaattcaaagcttcataaacttctttcaaagttagagtataacgactataaagaatagtatctctaaaatttgcatatgagctaagcaacgaacacaacagaataagacctaaatcctcttcatcatactttacctccatggagtcaaggtcaacaacaattaagtggagagataatccatcacatattcatcatattgcaacttgtgcaaaaaaaaaaacttttgctttaggtgcatcttattggtcaaatcgtttgtcatgcatatcttctagcttcaaccacaacccaacggttgtcttctccttgagcacctccaacaaaatattgttagatagatgaagatgaatatgtgacatagccttatgtccattttcttcttattgtcggactaatcctgagtcctcttgttaaatccagataacacatcatcgaggtcttgctgtgcaagaacggttcgcatcttcacttgccatagtgagaatcttgtgtttcggtccaggagcggtagatcatatttcaaactcgccatgggaattgatcctgaatttgctactaagaaattaatgtaaacctagcaaaacgtgaacctctggtgcacttgtcatgtgcacgtactgtagatctggaatcctcatgttaagcaggctgtgtgtgcgtagcaatttctaaccgtgaaaattaattcagccctgccttttctctttctcgatgcgcatgctgctggatggttttccttgctgctctgctttttctcctgctacgcgtgatcattctttttttttttttttgagaaacgcgtgatgagtcaacagatgactccggttcggcctgcgacgagaactacgcgtaacgccgctgcagccgatgagatggatttcttcgaacggagaaacacgccggtaaccggaatagtagatcagattttcaatggatatcacttattatgaaaatagatgtataacggagacacaaattttacgcggaaaacatttatagaaaaaactatgagcgccgaccggcaatgatcaccgttgaggaattgattataaacgtagaggaataacaatggaacgtcatccctctctgttcggcttacaagagtatatgtaaaaaaaaaagacatctagtagaaaaagatatgaagtcctatttaaaaaactaatacaaatatattgtaggcctaaaattcagatcacatatttaagtgtgaaaataatcattttaaaataagtttttaggatctatttgtagaataattattttaaaaggatcaaaatataaaaatccagctttgacctcccctcattagtcagttctcaccaaatctggtaaagaacagcatcactcagatcggatccactgcctagagctagcttagcacctactgcagatatcgcgcaagcgagcatggagacacagctgccgaccgtgatggagctggatagctccgagccggccaatttcacgcagccgtcacggagatacagctacctggagaagatccgtagcctgtccgtcgtctcgggcgaggtcgccgggtggtcgtcgtcggcgtcggcgtcgtcgtctcggtcggcgagatccagttactacagcagcagcatgtcaagcaacgcgtcgggtggccctcataatcatcggtacgccccttactcaaactcgtcgccgggtgacattgacctccacggtgctcaggacattgcgcggcagatggtccacgacgggttcatggtgaacttgatcagagagttcgaccgagcgcccgggccagcgctggagaggtggttctccgagctcgacgtcggctggttactccggtcggcggcggcggcggataaggagcaatccgagctcggcttggctgatctcgtgcggcggtggacgcgaggatataccgtgatggccgaagcactcagcgccacgcagactaaggttgcaggtgtacccgccataatacttccgcaggcccagcgggaccataacaatattatgtgtgatcaagagctggaagacgacctccgacttcaattcgcgcggttcgttgaggcgacagtatccaagatgcttgcctttgttgatgccctcgccgctgaaaacactcggctgtcaatagacaacctctcgagactcgtgggcctgtgcagctgcatctacagctgcttctacaagtgcaatgtagtagtaataactgattcagaagaaatagttgattcagaattgcaatgcctaggccgcaaagtggttggtgctttcataattacaacgacaaccttgtgcaatgcgatagagagtatggcgatggtcgccgaagctgttacccctgtcttaattggttgggattcctgtgaaaattttaagcagaatgcagaaatccacgaagctactaggctaattgttgactatgtaagattgttttggggataccagagcttgcggagtaacatgcggtatcttaaatgggttcaaattccgatcaccatgattccacaaatgctcatcaactttgaagatcagctggagaagatctcagagtcattctctgaccctagcctgaggtacctgttcctgcttaacaattcctacttcgtaagagaagagtttcttgagcccagcaattacgtgttcatccttccgtcaggcacaacgctcaaatttatgcagtaccaagagaagtacatgcttgcctcctgggaacccgttctgtattgcctacacgaaaagatgccactgtggtttcctaaacactcctcgcagctggcaagattcaagtcagaatttcagaaaacatttagacatcagaagctatggaaggtccccaacccaaggctcaggcagaaactgcgagaagccatcattgataaggtcattactggatacaaaaggtacctggaggaccatccggagctggagaaatgcagcagtgatctacaggacatggaagacatggtcaacgagctatttgaaggatgaataaggattgttccagttttagactgacatggccatgcgtatggagtgtaaactttaaatcagttacgacgataagagagggcgaggctaaggttaaataagttcaactgtattttgatatgttcccacctcattctacttttttcctaggaaatcctcattctaccttactatgaataaaatatatgggcagtttatttttttttacgccagatctgttgacagataacaatacagatcttcttcctacattatttcctccacggctccaccctttgattcttcaccataccgctaataacttgctcaggcctcacagcctccaacggttggggagagagacactacagggcaattgctattttctcctctaatcccctccataatcaccagtggttagcggcggcagcagcaaattgcattggtcgccttgcctgttctcccgtgggtgcggcagtgttgcaaaatctgcaacaattagttgtgcgcgtgttgctggagcggctggtgatttccatgatctgctatatcttgttcgtctcaactcgcgtgtttgcgtggcccgcgcgtgctgcacgtacgtcccttggcgttactgtgctgcttctcttaggcctcaaatttgttgagcagtagatataccatagtggtgtcgtatatatatatccgtggacaggtggctaggtggcagataattgtttctctggaaccgtgactttgtcatgctttgctaggcttctgtatagttgggagtgtccttatttgtgacaaaaaaggtccctctctatcttgtgatattatgtttgagacttgctaagtgctagtactgaatcaattattgttagttgttagctttctattgtggagtaaattgagagccatagcttgaaaggcatgttcggcattaacattataaaattatgagtgaattacactttagaccatgttttattgctaaagtttcactttgaaccatcctgtacacaatctttttactttggactaggtaactttacttttgttgcataatggacgaccaccctaactcttttcgctagtgatgtctagcgtctctttcaacaataactcttttcgctagtgatgcctagcgtctcattcgacaaaggtatggcatgtatataggtatgaaaatttgctggcatgtcgttaataatttgctcgaagtcatcgaagaactgaaggcgtggtttagggtggtccattgtgtaacaaaggtaaagttacctagtccaaagtgaaaatactggacaaagggtagttcaaagtgaaactttggcaataaaatatggtccaaagtgaaattaactataaaattattgttggttcttcttgactaaccacacggagacttaattagtagtgtagggcgaatccaccccatttcccacgcacgcacattcataacgaacgacgttgtgactggaggcacactttcccttctgggctagcccccgtgtaactatcaccaggcaccagcgctacatacaaaagtagagaaggccccgtgcatggagacatggcgatatttcgcaccgtatgtaccctactatcgaaagagatttgctccggtccaataaaaagtaacttgaggtacccactactacggaaatcatctttcgtggcggtcattttgtatttttgctggtggaatttggagccgccacaaagcaaaggccagtgaagatctaagattttcgctggcggttttattccgcttgcgaaaatctattttcgccagcggacaaacgatttttgctggcagttgaggtccactagcgaaaacccattttcactggtggttgcctaaagagaactgctagtgaaaatcaacctaccccaccaaaaatccccaagcccaaattcaaaattctctgcccggccaaattcaaaacagtccatatctgaaaatggacataaacatcattcaagcatcaatccaaatccagagcatcacaaatacataatattggcatcaattcaaacacaacacattggcattatcaacaaaacagattaacaacacacagattaacctaacatccttacaaaccaaaacacacaagagaaccctagccgctgaagccatcggggacgagccgccgccgctgccatctgttggctgcctcccctccagccagatctggaagaggggaggggagggggggaggggaggggagggcagtggtgccaccgctgcaggcctcctccagaagggtcgcgcgtggtcaaggtcactgagcccggcaggcagcgtcgttgtcatcgtcgttgttgccgcggtcgcggtcgtcgtcgtcagctccgctgtcgcccgcgccgcgtgctccccgcgccgccgctgaggcagatccgtcctccccaccgccgcctttgttgcgccgccggcggcggcctcctcccctcggacagatttgggagaggggatgggacggcaggggcagtgcagggagccgccggtcaccgccgccagagccgccgccaccgtcgccggtgggaaggccgggagggaggaggagagtgaggaggagagaagaggagtggataatgtgactggatatggagagaagaggaggggatatggagagaaggagaagaggatgaggtaggtgggtggttttaatgtgaccagatatttttggatcactgagctgggttttctctggcggttttgtttattagccgccaggaaaaattcgaccgctaacgaagattatctatttttgctggcagcgcacctaagtgaccgccagtaaaaatagacatattttcgctggcggccgcgttagacaggccgccagtgaaaattcattttctctggcggtcggtgcccctcatccactcgttacgactttgcggtggttttcacatttttccgccagcgaaaataataggccaacgccatgaaaaatcgtttttctagtagtaccagtacctcacggtaccaaatcatttctgatcgttggatctagcaatgcacatcctgcccagctagatccaaagatcggaaatgatttgataccgtgaggtaccggtacctcgaggtactttttgttggaccggagcaaatctcggtacttgtaaattgcttttcgttaagcaatttctgttcgaatgatttttttttgaaaagtcatggttgtggtctgcagacttgttgatcatatggcgtatccatgtaaatggaggaagaaacctttagaggatatggtaaacaaataagaaaatttgcaggtgaagaaatgttaaagccataaaaaggtaagttcgctatcaatctgtcataataattcattcaactttgcacttttctgatttcatatctgataaatttcctgagacatcactaacatgataatattcaatatttatctgtttaaaatggaagagactgatagacaagggcacaacaacatctatagttctagactccaaacataatatttttacagtccttgaagtaggtatcaagagataccaaatttataatagaaaaggtggtatttcatggtaaaattgttctattatttaggatatggagaatgttttactacatatactcgttggtttcagatattccacatcccctacatgagtcttcttgttctcttgagtttgtgagagctagctctgcgttggtttggttatgtaccctacccaaagttgatggagccaaaacattggcattgttaaatttgttaggatagagatgaagaatatgtttgatttagtgctaaaattgtgaatatatggcattgccaatttgctataatttttgcagggtggcattgtgatggagaccataccaaaattctagcactaccaagttttggtaggttagcaaactgaactagataaacatcacactgaacatgaactgcctgtctctgttctcccatatctgtcggagcccctgaggccgagcgggacaagccatgaacaaggaaaggaggatctaatacaagaggaagcacgcattgcaatgtgccaacaaatctggcacagcaagactgaagtacatattattccttgtcaaggtagaatgaagatttccttaaaaaaaatcagaacactagaaaaaagaggcatcgaatgaacttgtttaaccttagccccttgtcctgttagctgcttcaaaatttatcctatacgcatggccaattaggccatgtaattctaaaacaggaattagtactccttcatccttcaaatagctcgttcaccatgtcttccatggccagcagatcgctgctacttttctctggctccagatggccctccaggtactttctgtatgcagtgatgaccttgtcactaatggcttttcgcagcgagttcctgtgctcggtgttcgggactttccacagcttctgatgcctgcacgctttctgaaattccgactggaatctggccagcagctgcggggagtgtttggggaagaactttggcatcttattgtataggtaaaggaaagacagcacgggctcccatgagacatcgaggtaacaattctggtagtgccaatatctgatccctttgctcgatgggaagctgtaatcggtgttggtggcaagaaactggtcctgtatgaagtaggagttgttaatcaagaagatgtacctcaggctagggtcagagaatgactcggatttcttctcgagctggtccaggaaggtgatgatcatttgctcaatcaggctttgtactatctcccaacaattctggctactttcactcctgtaacaacataggatggactccagcactctacggtatccccagaacaaacttgcatagtccacgattaaccgagtagccctgtggattccttcagtctgtgtgaatttttcccaggaatccatggcgctcaagacaggagtaacagcttcagcatccttggccgtcttccgtatggcttcacccaagctgtcctgtgtgttcgccatggcttcaccgatcttgttgactaggctttgcatttgttctgaatcaggtagccggagatcgagagcctcctgtttcaaggcgggcatgaggatctctgacacgtcggagatgcaggtgtgcacctccatgagcccaaagaagctatccgcggttggagttgggcaagtcccggccttaccggcggcggcgagggcggcggcgaaggcgatcatcttggagatggtcgtgtcagtgaaccgcacgaggcagaggtcatcgccgccgccgacgacgccgcgtagcagcagttcatgatcggaggaagaagctaccgcgggcgccgtgtgatgtggcggctgggagattgcgaattccacacctccaacgacggcgacggcggcggcggcggcggcggcggctgacctctcgtcgtggaggtggccctgcgtggcgctcagcgcatgggccatcacggtgagcgctcgcgtccaccgccataccagccgctcggcctcctcctcctcctcctcctcctgctgctgctgatcagttggccggagcacccagccgacgtcgagctcggagaaccacctctccagcacgggtcccggcgcgcggccgaacgctccgatcagggcaagcacgaagccgtcacggaccatttggctggcgatatcgcgagggcctgggacttggaaccctaccactctcaggaaggagccgccggaggcagcgccggttttgcagcgacgacggtgagagccggcgccggactcggtgctggagacggtgctgctgtagttactggatcttgccgagcgagacgacgacgacgacgacgatgacccgacgacggacatgctccggatcttctccaggtagctgtagctccatctccacgacggcagggagaggctggcctcggtggcatccaactccgacagcgccgccattaattctagctctactgttttgtagtgcactgtatgtaggtgtagagaatttcggatcgggcgattgagaggtcgacttcagaagttcagaattcagattggagttcagtatagcttagcttaatttgctggctttcgatttcctgacacgcaactaaccgccttaagcgatagagacgaatataaatgacgtcgttgttgattggcaaccgcaacaataaaattacgaaacagacaaatgcatgcgtgcgactttcacaggaaacgctgcaaagtttggcggcgccaaatcgactctgtgtgcttgctcaacacctttgtttgccaggtgttcgtccatcatcttagtcttggtagctaattgtttttataaatataatatttttttcttttccaccactctcgtttccagtctctaccgaaataattaattgtctaattgtaaactcacagtggttctcttttcttgagttggtacataatacttacttcaggaaattaatagaatgtcatctagctactaactgtgttgtaatcccttgccaagaaaaaaagaatgactgttgtgtaatctggaagtcaagggtagcaatgtttagttgcctagctacttatgagttatgacttgtgaattgtttacgtggtgttttctgttttgtgcaacttccgttgtttacatacggtgtcgctttctgttttgttttaagagatgtagtatttctatcgactacctccctttatcccaaaatataagaacataagatcggattagacagaatttagataggttttctgtctagattcgtcttattaggatatactccatccatttcataatataatgtacaaccacttttctcagatgttccataatataagagcaggtacaatagcaggctataagccagctgcaaatatattttaaggagataactgaggagagagaagggtagcgggctacagatttgtagccagctgtagcacgaactccaagacgcagtgtgtgtatgacaggtgggaccagatattaatagtgtagtatataactattgtatgaatgagctattagattggctatagatgaattggagtatactattgaacttgctctaagacatgcatgcaagcatgcaattaattatgacatcttctctattagataacatgagagtgtaggatttaaaaaagtatagagaagatgtcataattaattagagaagatgtcataattaattgcatgcttgcatacatctcatgttatctaatagagtttaccactgtgccttatattttggaatggatgaagtatatgtcttgtctggttttagttttagattcttatattttgagaattgggatggatgtagtactcagttagaagtaactttaacttgcatacatttcattgtttcattaatcaacttcagttagaactagtttttttttgtgaaaaaaaatattcatggttgacttgttatattacggagtataatccatttaataggaaaatcgaggccactaggttgacgacgatcgaggtggttcttggtgatagatcagcgggcatcggctgaccatgagaggtcaccggtgatcaatttgcagatcggtttctttcaagcatctcctgcaaggccttgaatcggtccttagggtcccttccagcaccctaatgattgggcgataagagttaaggtttgggagagtagggtacttacggtgcgagatatcgccatgtccatgcacggggccttctctccttttgtatgttaccctggtgcctgatggtagttactcgggggctagcccaaaaggaaaaaagtgtgcctccaatcacaacgtcgttcgttatgaatgtgcgtgcgtgggaaattgggtggattcgccctacaccactaattaagtctccatggctagccatgatcaaccaacaataatttaacatggcaatgccgaacatgcatgtaaagctatggctcgcaatttactccacaatagcaagctaacaactaacaataattaattcaggactagcatttagcaagtctcaaacataatatcacagttcaacagtgtgctagtaggtgttcgcaagctaccagtgacggccatagtatcgtttaccttcataaagtgcaacgagcttttcacactacactagataaggtcacatgtgacgggcccaaccctcacctttgacgggtttaggcttggtcagtgatcagtggtcactggtgactccagtcgcctttgacgggtggccggccgtcacctctgacggacaaataactagaggaccgtcagaggtgttggtctctgctagcctagggccagttaggacccatcacaggtgacccatctctgatgggcatgtaaagaaaggccgtcagaggtgatggtctttggtagatagaagccgtcacaggtgatccacctgtgacgggcccgaaagtaaaggcccgtcacaggtgggtcacctctgacgggccgcgatttgcgtatccgtcacgggcatggttacctttgacgcattttgtttccgacatgtcactaatgagttaattccagaaaaaaaatgctaaatattggctagcctcaggatttgctagccatgccctctgaaaaacagaaacatcacagatacatgccagtcatcacccaatatcacatattccccaacatcacagatccatctcaaaactgacatcattcacatatgcagttcaaatgccacaattttgcacagcaaattcataccccatgaaagccacaatttcgaaattcataccccatgaaagccacaatttcggtcgttgctcatagaaccgcatacttaccaaactttcttgtatcctgttccttgtgaacctccacgacctgctattgtaaaaaatggagaaaacaattgaatagtacaacgtaaatcgtagttgatcaaatttgatgacaatttagcaaactaccataaatattgcacatataaaagtaaattacattgcattccataccacagaatcatagaaacaactttttttacatcacaagaaattagataattgtattgttcatgacttaacatctaccccgttcaatcatctaactggcatgaaaacgtcctttcttgttcattatttcggcaagaatgaaggcgcacacttcgcctttgatagcgccggggggggggggttgatgggtgaaatcttcaagccaactctacctttatgttcaataaatcaaaggttagcatgtttagaagattaatgttggtattgaaatgagcttatttgccattagcaacaatctcagagtcgaaatctttcacctcttagaagtgttgacatgttgtggcacacgtggaaaccacactggtctccgatctgttgtgtgcatgcgaacttggtgtcatgataaagtttgtccttgccctccttatgcctaccagccttttccacatatgggccccaagccatatttaaggccttggtgattgcagtgaaattataatcttttgccttatttgagttaagataggagaccctactccatttagggtctccgtcatcggcgccttacggagctccgccaccgtccttagcatcgcacggagcttagccaacgtcgtcgacgccgcggagctcagctgcgtccgtgtgtccaccgtcatcgaagacgcacggagcttgctgctgccgtcgtcgatgccgcgcgaagttcctacgcgcgtccgtgtggccgcctctgccttctccatcgccgcatgcacaccatcgtcgatgctgccatcgatcgcctgcgtctgcctccgttgatgaaagagtagagagagaagaagaaaaggataaggatgcggtttgctggaaatgagataagcgtgtgggagaccgatatttccttcccgcatcggtcgcccgataataagcattttcgtatggattaggttgtgaattgggcaatgctcactaggaaaataaggatataattcaagtagtccttatcggatccaaatcgaactctatatctctctttttcttatctaggacttctttcttatctactcatcactttatccatatgtacgagggttatttttgtataggacttagtatatgatgatcccatcgagctaagaatacatgtatagggtatcccatatctagaacactgatgtaaagatcatgcaaatatgttggatcatctacaatttattaccccctccaaaacacagggacttttaggttgtttaggaaatataaggttacatttcttttagtcgcttcagttgttaatttaaaaattttgaattgcttagattccatttgcaagcatgtgattggcttcggaattattgaaatgattagaaccgtgggaatcaatgcaagaatccttatagcaagtttaatagtatagccaactattagctttaaattatctatagtcaatttaatagccaattcattcaatagttatctataaacatatactacactattaatacttggtcccacctgtcatacacatattacatcttggagtctgtgttgtagctggctataaatctatagcccgctgctcttatctctcctcttttatctacttgaaatgtatttatagctggcttatagtctgttattgtacgtgctcttatattgtgagacagaatttgaattatagagatccttatattttaaaacgatcctcattattgtgatacaaaatttgaggtatagaaatccttatattctaaaatgagggggagtatattttaaggcccaattaatatacaagtatgtcaaaacatcatctcccacatccttttcataatattttaaaatatatccatccaccatccatttcctctaaaatatttaatatatatttattcatatatttcgtaacaaagcacgagacattattggtatttctagttttaaaacgcgattacggccctgtttgagggagtttaagattttgagaagcagttggttggggtagccagcttctgagaatctgaaaaagctggattttccggcttctaacttctagttcattttcttgattccataactacaatttttcataattcggactaaaagttagactgtctagggaattcctgattcggaaagaagctgctgtagctacaagcttcccaaatacggagtatgtcctatatgttaaacgtgcatggcacccggcacgcgtactagctagtggataaattaaatatggagtaactttaaaagagtgggttggagatagaaagagagattttttagggatcacttggagacagtgtcccttggagatagtgaacagtcatctctatcacattttacgcggttataattagttaatcgcactcttagagcaagtaaatataatatagagtaagttcaaaagagtgggttggagatataaaagagtgaatttattttagggatccatggagtcagtgagtccctcttagacagaacggtcgtcggtcaagtctatcactttttacgcggttataatttagttaatcgctctcttagagatagtactgaaagcaaaagcaagtactgaagtacttgccctaaataccttgtagagtaatactccctccatcctaaaatataaaaatattgattagatatgacatatcctaatactatgaatctagacatgatagtattagaatatgtcacatccaaccaaaatccgttatatttagggacagagtgaatatgctgatatggaaaaaaaaggagaaattggagccacctctcatgtaaggataacttaaactagaaaaaaatacacgt

SEQ ID NO: 75196 - DNA, 1672 bp, Oryza sativa
gtttcgctacttgggtttgtagcatatccacagtggactgaaggacatccaccttcttctccaccgcagggatccacgattctaccgcctccttgaagaccctcatctccaaactctgcttcttctcaccctcctctcgcttgcgctctgtctcctccattttcttcaacagaaggtcaagcttagcctcattctccatgattttggccgtctgcttcgtcacaaatcgtggtttctccagggtttcagatcaagtgatcaactcttcccgaattccaccaactcaagcaaggcaaggctgggtagccttttcgcggattcactcaagagcgatccaatccttgcccaagaattttacagcggaatcaaggatttccgaggatcacgaagctctgataccaagttgttaggattctctcgcaatctctcgatcagctcactcaagaacaagaattatcgatacgatcaacgagatcgcatcgcctccgccgccaacgccgccgttcgattgatctccaaagatacctttctgttcttacaagttttgtttatattcaacacactctctctcactggttgctgggtcccagccaggctgtcgacagagccatagccagctattacttacaagcccattcaggcccactcagacgaacattagacttcttaattctagtagctcgcttcagcggcctagtaattgtgttctcctgtgcttagtcagacaacggcaactccctggaagcagtattgctgctgacagacatgtacaaaattctactgaagctacttccctttgtcgtgctatggtatcaactcaaccacagaactgatttttaagatattaaaataacttttaggtatgagagagagagagagagagcactacacttttagcatcagattcccttcttagttgacacagtgctcggcagagatctttctccatatcaccaaagcatcctagtaacacatacaaaagttatatgcatggttaattggtcgaaaggcgaggcggcaggagcgatagaaagaggagccagtgcgcggtgattttgcccgggggaggggaagcgatccgcgatctggatcggatcgggagggagcaggggagccgtcggatttaagtcatcagatggattttggatcgttggatgtgtgacatgatgaatgatgaatgagtaaaattttgataactttactttaaaaaaaatagtatggttaaaaatgatatcaaagtggacagaccataaatttacgatatacttgtactcagtacaaagtagtactattatacttgctgtgggtgatgtagcgcgtcacccgcccgcccacccgaccggaagaacccacttgggaatagcgaaaacgaaaattccgtggtcgctgatactaccacatcttgccgaactcgagcgcgtgcgttcccaccaccacacctgggcgatcgatcgatcgctacagcgatccacgcagcacagccagccgcctgagccgcggacgcacgcaggcgcaggacgtacgggtagtggtccgctcgatcggtcccgcgagtcgcggcgcatcgctggtcgcggtcggcgagtacgaacgtactccgtatacgtacgggtacgcccgcgggggcaaggagtctcggctgtcacacacacccggtctccaattctatggt

SEQ ID NO: 75197 - DNA, 655 bp, Oryza sativa
caatatccaaaatgttcagaatagaggcatcaaagcgattctccgataagctaaattcatctccaaacaaactagagtagtctgtacaaagtacttggtcagaagcatcatctaacaatggatcgggctccagaagttcttgcaggacctttgatgcctaatttcaaaataaatacatgtcatgaaaaccctctgaggggaagagtttgtaatcaataagaaaggaaaaggacatcaaagaacctactttcaggcaaacaattccaagggctctgtctctgtgtgctttccttaagagcagtacggctgtttcagatcgaaatgccagaaaacaagcaggctgaacagaagatggactccgtgatctcctaggttgtgcctggagggaatcaaagaattcagaaactgaaaggagcaattaagataaatgcccatatgaaaaacgcataaatcctaaatactccctcggtttcatattatatgtcacttcggttttgtcaagtcaaacctcttcaagtttgaccaagtttataggtaagtgtactaacatttaaagcaccaaattagtttctttatattcccctttaaatatttttgtagtatatttattttgtggaaatgttgctatattttcttataagcttggtcacaaaag

SEQ ID NO: 75198 - DNA, 4453 bp, Oryza sativa
aggtggggtaatctgaggcgttggattggatgattttagaccattggatatgtgatatgatgaatgatgagtgagtaaaaggatttgttgaactatagggtactcacaaataataaaaaattctttaattgagtaccttatagttcaacaaatggttttactccttcatcattcatcgtatcacacatccaacgcacctcctcgctcaacacttatccaacggtcagactcatcgacgcgctcagcccctctatccccaaacgcgcgattctcctcattctcgcgattctcccaaaaaaaaaattccatcctcaccctcctcccgtctccaggtcgccgcccgcgccgatctgctctgtaccgatctctcccactggcattgccttcctcaccgatcttctccgctccgccaccgttcctcgccgccggaagccctcaccaccatcgcactccgtcgccttcgcgattcccaaccctaaccgccgtctccccgcaggtcgccgtcaatcgccgtcgccccgcaggtcaccatcgcaccgccgccacccggtcaccgtcgcgcctccttcggtctctctacatcgcgccgcagacggatttccccgccgacggggcgccgcccatgccatccggtctagcgcgacctccgccaaggagttcggtatgtccctctcaccactgatctgtacgtactctgtactaactaatgcagggaagagttttcatattattcgttttttttatttcagtttttactattagttgtcagtcaaattctgctttgtgcagactaataattttttccttgaaaatgtaatttgaaaatgagatggtatgatgtcatgatgatgggatttacaataaattgagcttcatgtttcatgggtttttatttatttgtatatttgcaatggagaagagaacatcgttgttaaattattttacaagcagttcgagtatatatatgaaaagagtattcactacaataactatatcataataatgttacttttatttgcagatgtgtgcccatattatttactcaatcatatgtagtcatttgtttactgaaatctaaatcaggtactagactttatacattggatgagctgcagttcaatggtatcgtcactgctgcttttctgactcctgtggatctgaatttgggtgtcagacgcccacccaaacggcatctgaatttgggtgtcggacgcccaaacagccagaccctaacaacagctgctagaaaggtctttgtttctcctcaactctcatcgtgtatatatgtttccctacctgattccatgttaaaaatgttactaagtctgaaccattaattttggtatgaatcgtgtgaattttgaagagaatagcatgtgcactgttaattctgttggacagaataaaacctagacttggttggtactataatctatccaacatattcagttattatgctctgtattgtagtgtagccaatttattcaattattcttctttgtactgtagtctagccaatttattcagttgtactatttccagaataggggtatctagggtatcaaattatttgattattctatgagctacatgctagaaccattatgttaagtggtatctctacatcgcgccgcagactgattccatcaccggccggtcgccgcccaatggttcacaaactctcaaaacatgctctcagatacgttgtacttattgtccttcaatatataaactcacaatggttgagtgctcaatatatcttatctaatttgggaacatactatttgattatcattcatataaagctggtagtatccccaggtatactaattgactttgttgtggatgggtgaataactgcagatcatcagcagatgtatcaacatggggaatctcgcctaatttctaccctggcacctcaagctgcatatcaatggcctttgataactatcaaggataagaatgtagtttagttttttgtgttcaggtatgaccaccctcgaaaaaaaaggtatcacaaatggttatgagatagtagagatttatgctcccatgagactaaatctctcataaggatgccgatttactgtaagtgaaaacaagctaaagtgcatggagagtatctatggaagtaatatgagcactgagtaggcgtctgcatcaaatcttacatttatttctatctacagttaaagaatgctaattaatctgtaatttgtcaacctcctaagctatatctcgtattattccttcctgtcattttactctgccaattacatttgcttttaccaattttttaaatcttccaacatgcacaatataggccctggtattttgctttttttacaggattcctgtaagataacatgattgcaatataccttgatcccgagagatgatttttgcaatgtttacccaactttatttgctgacactattaatatccttctggtaatggttaggtttcctgttattcattcgatgttataaaatttgtaacaaaagtgcataccaaaaggttattgttgctaatatatcctcaagaattagtgtgttacagacatctgtagatcattttttcttcgtggtctttgacgagcagatcatagtactcattatcggttatcaatggtttggcaattgcatatcaaacaagtatcctgtttacgattaaacatatggttgccactgaaatttcttcctaacattttagagggaacctgatcatgctatctcatcagaggatagagaagcggtcatgggcaattatgtgtttgccatttagcttatataactgctgtgtgtgcagtattgggtatttatcctttttatgtcttttgtgctgcagaatgagagcagctcagcaagcgattgttagagaagaataggatcgagccccgcaccaagtagaggtgtttgtaaaaagtggctagcagaataggaaaagaagattacaaagctgcttgacttgaatagccttgacttgtgaaaatttttcatgcttgatacataggaggcggcaaaagcgagtgcaaaaggaacctcgacaatacgggtgaaatggtgggctgcagctcttcaatttgttcatccaattaatatacataagcctgttctgtagcttcgatgaaattcgacggatccatatgtttcaatgtttcctcccctctgaattgattccgagaggtaattttcttaattcgccgatgtggtgcttttcaaaatacattatactcatacatatgaaaaattaaattggtctgcccatttaaatatgaatacaaataaatccttaaatacactaactatcgaatgcacgccataaaaaggattgtgaaaaaaactatttaattactgcatggaaaaaaagttctcacgtgacatgaatcacattgtagtgctttaaaataggggaattcgattaatgagaaacaaaatatattttttgtctgtcaaatatgtaaaaggaaaacgtgaaaatccatcttttaatataggcattggcgatagttattaaagataaatagagttacaccgtagcgtttagcacacgtaaaatagcaaggatacaaaaaatttaagtaattattaattcttttcgtatcatttgatttattgttaaatatacttttatgtatacatatagttttatatatttcacaaaagtttttgaataagatgaacggtcaaacatgtttaaaaaagttatcggcatcaaatatttagagatggatggagtataaaaatcctgtgacactaatatactccatggagtgacaacggtcctctttattacagaaccatcccacaccgttcatatcatgccaagttgacgacaaacgagagctggcactatcattcatcaattttgtaatagggcccgtgcacatctatctgacaaccattcaatattttgggctgttcaaatggtagacaaaataaaccaaattttgacaatttgataatattgttaaaattttagtaggatttcgtatgtactaaagtttggcaaaaactctaccaaaaagtgatatgatttgaaataacatcaatataaacaagcctttcaacgtattttttctcataaaaaactaatctaaaataaaatatgctatttttttaatatacttaaatttattgtactagtaaacgtcatatttcatcatagatcgttcttttatgggacggagggaataggagccgcctaaccaccaaccgacgtcccaccacatgttggaatgcatatgacagttgatcacaccgccgaagttgtacgtacggcggtagacaacgttgcgtgggggtcggccactcggctggacctatccgcgccgtcgatcgatcgtgtacgtacggcgccccactactcaccgcgcatagtactgtacacgtacgacgtatactactcctacctaagaccggtcgaactaatcggcaaaatacgacggcggcg

SEQ ID NO: 75199 - DNA, 816 bp, Oryza sativa
ttttagaaaggttaatggacttttagtatataatagaagataggtaaagaaaagataaagattaggaaaggagatgaaaattatattgaatacaaaaatttagggacggaatattcagtttttgttagcaataaataaataaataaattcctcaataagaagggggtttctcttttctttgccgcgtgcgttcctctcctcaggtggtgactcggtcaccccttgcctccttcggccaccctctcctcctctcctctcctctcctcttcctcttcctccctctcctcgtcgcccttccaccaaagcgagagatcgaccgactcctctccctccgccgccgacccccctaggtgagcgatccagcctagatcctttcctcctcctcgcgttgctcgatccccactccgttgttgtttcctacctgtactgtatcgcgcgcggttcttggggggaaaaaatcctttctgattaagatacagaattgttttaaaatatcaattaattcttttttttcaagtctctctcgctctcgctccggcgtgtgcggcgcgtgtaatgggggattggtcatactgtaatgggggattaattagttacaatgtgttttcttggtgcctgaaactctgaattctttaaacattattgtcattgtcctagtaaattatatatttcatcgaagatatatagtagattctaggacgaattcgatttggacatagcaattttctgatatctctagtaaattacaatttaattccgaaatgttgggtgatacaggtatttgtctttcaccttgagtcggccccaatttccaat

SEQ ID NO: 75200 - DNA, 10035 bp, Oryza sativa
tgtggtcaccacctcactacttcactgtctctctcggtctaccctttgatttttggcccatcaagggctagatcgggcatgacgctgatgctgctgtgctcctcggcctgcaccaccatggagagaaagggaaagtagagcggaactgaaataatctgatccaattgggccagtgccatttctaacatttcaaattatttccataaacctaaataaatattttattagatgtggtgtctagcagcaaattgacaaattttgatagtgttttcctccaaaaattaacttttgtcgtgcccacgaactaagatcctcaggacaataaattttgccatttttctgatgtcttcatttgggttcatttggttagatttattgggctatttattaattagatcaggatcaacgatagttgacgtattcaccgtacattcaatttgatactaaccaaagatctagatcaaggagatgatatctgtaatttgtatttgcaactaattgttgttccaagctatttgcattttgttatgaccatattttcctctctttatctataaatataaccaaataattcagtactttgtcatcataaatttaagacttagttgttcgacaatatttgcagagctcctggtctcataataaatgcagctcagagcgctaatttgatttattagtcttgattatacttatattacttttcaataagttcaattcctcgctcaccaggatgcatgtgacttttaatgttatatttgttgagacttgagaaccctcctttatatctatcccttctctcttcttatctaacctagtagttatctctggcacctttgtaatatacctcattctatttagtctgttttgctccatgtgtgtttctgtttcaatttaaatccactagacactagtgtttgtttaatgggaatagtcccacatgaagagtttagattagtctggagctgcttgtatacccacctcactccaaccataatacatgcgggttaacccttttatatgaactgaggatgaaagtgtaagtggagtgctatatgaacatggacccacgtaacgtgtagagaagactaatgtaattattatttggggctaggatgtaccatggtgcttgggaagtacatataattttctcaagttatttgcatacatgtttaatcagggagactggaataagtgagatgtatatactccctccaatcccaaatgatacttcctccgtccttaaaaaaaactctacttctagagtttgaattttgtcccataaaaaccaacttctaccatcctacctaccctcacaaataaaacaagaacttttatcccctttacctacctatcattacttttttaaataatgagggacattttggtcatttttctctccattaattttaccttggcatgttaggaatgctctttttgtgggatagagggagtacttgtcacctgacatcatttataactaaatcacttctgtttcttttgaaaaaaaataagctgttgcattctataaataaacattaagattccgttaatcataatctaaccataccatttaaaatatattaatattcaaagattaaataaacaatgacaaatatttggaataacaagtatgaaacagagggagtatattttaggatgaattccgatttacctctaaactattgcgtttgtccaatttacacccctaaactacaataccagatacttttaatcgtgatctatccaaaccggacgaattacccccctaagtccatccgagggggttttagtcgtaagtgcacacatggcatcggccccgcttgtcagcctccacttcatttgccctcccctatcaggctagtgggaccctcctatcagcgtcgactcatctcatcttcttcctttggccatgagggcaataaaagggcagggcaggtagtcgggctagagcttgagccctcccatcccctccgctctgcaatcctccttgtgaccttttcaccgctcgatgccgctctccttcctccgtacttacttccctcatttctccgtcaggtctgatcacggtgagccaggcaagcctagatctatctggtcaagctaatatggtcccatggagtggtgtgcccctagtgatgccggtgcccggtggtgcgaagaggagggacaatggggctgatggagaggagggggaaagggccctcgtgcaaaaactggaggcttgctgccggtggagttcctacttcctagaagggtttcatggtagacctgcagcgaagctgatggcgagacaattctctggaacatgcagctagtggtagatcaaagattgagacgaccagcccgagaggagatggcaacaggcatggtgatggctgtggtggtgggagaccaggacagattaaagtacgcgagcagttgtacccacctagcgtgggtgaggttttcggtatggccgacggcagcgcctgcatctgtgcctcctgcttgcaggagaagctcgggatgctcgactcttcgtcccagtcaaacccttcccacccactgtctgtgtgtcgtccaccttctcttcctattctttgaccagcaacctcaccgctgagaatggttgttggtgagctcactgagagaaaagcaggttgaatggtgaggaatagggatgaagatatatttttatctcagaatggttgttggtgagccgacgccgctcttccccctcgtaggcttgccgttagcgccgtgcgtcctcgtctgccatctaggagggcaagtgtagagtcccggagcaaatacacaagcacgccgtcctcgtcggcagcggcagcagcacgaacaagcagggccctgctgcaggagcttgcgactccactgctggcgccaggagatccaaatcaagagcaaaagttcaagcttgttgtcctcgtcgccgtcggcagttcgtcagttcggcaagttgatctgcttaattttggttggcctaggattcactaggaagaatataggatgtctgcttggttttttgtttggttccaatataacgaagctttcagatctataagctcggttctgttgatgggtgcaatattccaaattgatgtgtacaaaaattttgtggcaagactttgtgatttgtcggttgtttgatctattatgcaattacaaaaaatattgttcgcagccacaatcttcgatattttctttgaagcaaaagatttttgttgagtcactggtgtctattgactcgcaagctaaacgagctagctcgagctaccaaccgagccgagccgagctaggattttagcacgttaggataacgagctgagccgatcctaacgagctagaccgagctaagccgacccgagccgagtcagctcagtatccacctctaattatgtaggaccattaatgtctcgaaatatattagagggtaatttgtctgctttaaaaagtttgagacttgaaacgtccggtattgaaaatgagggggtaaaacaaactatgtcagaggttgagggggataattaagactttttcctatattttattgacaaatactggctagatatatcacacctaattcttttttattctgttttattatttagagcaaagatatttcaatctagctttataaaaatgctacatacggtacatacattcatgtctataatgtgaaagtgttgcatgacaagtatacgctataacataacatagggtgttaaaagcaaaatatattaatgaccggggtgagtataggttataagcactacccagaaaaaaaaacatggaaaccgacaggagtcttttccgccttggaagaaattttaaatatgaatgaaaaattgcaggtctatgagtaaatttcaagaaagggaataatcaagggggaacaaaattgccacagaatgacagaaacttcagcaacaatgaaatcaatacagttttgtaaaatttctttcagctagcgtagatatgatgctgtaaaacagtagtaaaattggtaccttgagttgtagatcaagatagctaactcaaactagctcatgcatggaagaacagccggttgatgttggtagcaaggaaaatatggacccgaacttcagatcgtgatgcaacaagccttctaaatatatctacttttctcgttttgccccctctcaattattatgaaatattcgttgaaggcttcaggcctacggctgtgttgtatctagtgggcaagtttcattgagaataataaacgcataatcaacattattggtacactttgggtcatcaacattctattcttcatcatattcttctctatcagattcatccttactagctagcatccacttttgttttagtgtgtaataggtccccacttcccaggatgcatgacatgcatgccttcattgaattgatggcattttctacattactataaatatctacatctatatattgcttaaaaaaccagtggggtgagttctgtcactaggggcggatcagaaaggactaacaggaggggctgaacaaactatacaaaactatagcctcatcttctaatggatgcatgacagaaaattttagtggtgacttcatggggactcccgtggttacaacgtacgccggtagtgggggctcaagaccccatagctcccgttgtagatcggctcctgtctgcactcctaccaccaactcccctaaactgaaatgtgagagtgagacctgattgaaaggcctttttcattcaaatatcttgtacctctaacctctacctttaatagtacaaaagtaatgctttttatgctggtggtagtgagtttgtcactcccaccataactttctctaaactgattttgtgggactgcttgaaaggcatttttcattcaaatattttataccttaacatctacctttaatggtccaaaagcaatggttgaaaactgaaaaaaaaagataaaacctaattaattttaaaaataagttctcgctctctcagtcagatctagatccgcccacctctctctctctctcccctcatcgtcgacgccgagtgccgcctccccgctgttgactactggttaccgtctccttgccctcgacaactaccgccgccttctccttggcctcgacgacgatggctgcctccttggtctccacgacaatggccgcctccccgatgctgagcacctcctgtccgccccctatgaccgccggctacctcctccttggcctccacgaggacggccgcctccccgccctccttgataccgagcgcctcctcccctccctcaacgacaactgccgccaactcctcggtctccacgacgacggccgcctccttgccctcctcgatgctgagcacctcctccttgccctctacgaccgttggccaccgccgacccgccatccactaccaccggccgccgcctccaccaggttttcggcgaaatttttcaataatgtcttaggaatttgtaggaaatgttttagaaatttatagataatgctttaggaatgtgtaggaattcgtaggaaatgttttagaaatttttaggaaatgctttagaaatgtgtaggaatttgtaggaaatgttttagtaatttttaggaaatgctttaggaatttgtaggaaatgttttaggaattttttatgaaattatttgggaaatttttggaacttttaggaaattatttgggaatttttaggattttgtaggaaatgctttaggaatgtgtaggaatttgtaggagatgcgtaggattgttttggaaaatgtttaggaaatgctataggaaattttaggacatgccataggaaatgatatgggacatgttagaaaatgcgtaggaaatttcagtagtttcttcgctgcagaaatgtctaagcaacatgatatgtccatatcgggcggtacaagtggagctacatctgggcagaaccctcggacgcaaaaccacctaccgaccacccggcaagttatcaccgttgtggatgaaagtggtaagcctacagcgtcgaggagtgtcatctccaaatggtcgaacagttgcaggcgtgtagcacttgatcattttggtatccttcataaaggtattaacaaggtgcagctggtcgagaaagagcgagctttgacaacattagtcacatggttcaactatcctgctgaagcagaaactagacggcactacagaagatgggcaaagcatggaagaattttaagtggaagcttttctccgaatatttcatcccgcccagtaatcggaccccttcaacgattacctacaaataatagagaaggtgtgggaggagttcttcgggctcaaaagcattcaagagttcgggaatgagcacccacaccgacccggcacaacggggtacatcgagaaggaggaaatatgggctcaagaggatgatgctactgctgcagcaaatgtccctatccctttcactgacatctctgaagtactagctcgaaactgggctagacccagtggtaaggtcaaccaggacgacaccattacatttccaaaacaaaatgatgccactgtctatcagcaactagtgagttcccttttaacttaagtaatgctgtactcgcaagctcctttcatacttcctacatgtcattaacgattgacccttataatatatagatggggttgattgctgaagaaacttcacaatgcgaggttgagtctgcatcgaggaggccgaagatgacgttttcacgagggcgctcggaaatccagaacatcctagacgaactcggggaataggctgcgacgtgccatggaggcatggcttgccccaatatgttgcgcattgtcagaaaaggaaaatctcaatagaagagatggatgcttgcatgaaggagccgttcaaggaggtcattcaagagctgaagcaggacatggacgctagggtggaataaagggtggcaaaggtcctcggcgatatgaacataactcgagggcatgaacaagcgacacaccatctcctcatccacacgttgacgtgggaaaatcacaacgaaggagtagttgtgtgtccatagagttgcatcatcttccggtccaactactggctatggtggacagcatagaggtagctgattttttatgcctcatctcatttcaaatgcctcacccttgacacgtttaattaagaaattttcattgcaatgcaggacgtagcactgtgtatcctagtggttagggtcacaccaacctttttgtctgaagtcgcaagggcatggcttacataccctctagcatagaaagggtgcccacggtagacctcatggctggatatgcgaagctggtaatcaattcggttatgcccaaccagctttcatatccaatacctgcgccatcaaatgatggaattctaactttgggcgatgcacgtcaaacgtacatacaatggttcaaggcagatattatcataaaaggtggttcctcgtccaaaacacccggtagaatctgaacctcctatggctcaactatcaattaaggcttgtcatgaacctgatttgacgaaaccacattcaccccgggaaaccatgcatgggtttgactgatgtagcagccaccatgactccagttaagaccacatggaaggccgatagctctccaccacctgtcaagagaccaaaaggtgactggagtcattagtgaccactaatatctgatcagggccaaatccatcaaaggtgagggttagggtccgttagagatggcctgattcgggtatccggcgtagtgcgggctacagagcacatattcgatccatacattttttagataatagattcgatccaacattcgatccatacatgaaagcatggacagctgcgcctgcgacagcgagcatcagaatgttgaggaggttttcttcttaggtaatggaactagagtatatatggagaagatatgttgatatgggtatatgatccataattgataattattttgaaccgtgaattgcattgcatatgattaactggttcaatcgttcggattactactattaattaataaccccccttcctttgtgtagcttttaattgatgtgtgaaacacaagtgtatgcagactttacactcttgaaattggctgaaatttcggttgttttggaacctctttatggaattatttcaaaatttaacaaatattgactgaatttgaataatttttaccaaattcacaaaaaatcgataatttcaaaccgaaatttcaattcccgatcagagcaagccaattggagacgagcatcgattggacacttgccatgatctagggtcgtttttatgataatagggttttcatgaagcatataaaatgaaagcatccgtctttaacatgaaagtgcactagctccattagatgggcctagttggccggggtctacaagggtcctcacttatattcttttcattacacgggaaactctattcattgctcgaggaaatgttcacttgtttttatgtcactcagaaggtcatcaattttttttcaaaaaaataataagatatatcaatatgtgataagtcgctacacaaatatataggtttaacttcaatttatataagtagaaacaaaatttacaaatctaacactaaatagaacgtgtaattcgcaatcaaatttgtttatttagtttctaattatataagatgaattcgaacttgcatataatgagatatcacatatcgatcaattttgctaaatggttttaaattattttgtaactttctaagcgccatgcataaaataaagggatgtctctcaggggaaaaaaaaactcccattatattgctctgcactccacctgaaggacgtacgcgcacagctgttcatacgactatacgaagccctgtctagctaaaagtctcctcggtctcgatcctcaccttgcccctgcagctgcatacccggccctttcgatctggttatcaatcgatccggtcgccatgaacgacggtcaaggtcctctcttttctagcttcatgctgtctatacttccctttctcagagatattgcaacgatagcacagtctgttaattactaacattttcttggcgatatcatatcggcagctcgattgatcgctctgtaataatttggctgtcgttactgctttgcttaattagtgcgtgagtagcatgtaacaccgtaccacttcatggtcactactagggtactttgctggcaaaccagcgaaacccaacgacaaagaacaacaggccggtgatgaggagacgcaagctgttgatgcacaaacacctggcggtacgtaacgcttaattaatcatatatgcgtgtattgcttcactacttcttaatttgagttactaattatcagccaaagcatttgtttttctcttttcaaagggtttaagaccgaaagtgcaaattttacattgttttccttgttcgcaattgtgttagtgaatttgtgtatgaagacacttaatttctgatgcttttttatctcaaccgatcacaacttctcgaatcatttccgtatgcgctcttaatacgcgtgtctacctaaaagatgcttacattctgggacagaggaagtagcagatttttagtattatgatttgtcatatctgctaatatgttgctatatttttgagatttagctagtagtatgtattacattcctcaccaatcttagtttgcatatgagagcacgtacgggacagtagattttaatctcatatatcttaatttcttgagaaataaactaatcaattttggtggcatacaagattacttcttgggccctccagcaaaccttcaacagcagccagcagcgaagcaatccgccgatcagaacagatcaagcactacactggtcaaggtcacctgtgacgggcccaaaccctcacctttgacggttttgggcttggtcagtgatcagtggtcactggtaagtccagtcacctttgacgggtggccggccgtcagtggtgacatccacctctgacgggcaagttaataaaaggccgtcagaggtgttggtctaagctag

SEQ ID NO: 75201 - DNA, 10983 bp, Oryza sativa
  unsure (1)..(10983): unsure at all n locations
ttcactttgcatagaaaaccgaatatgctacatttaatactaagtcacaatcaagcttcatggtttcttattttggactacaagaatatttttcacagaaaaaaaaagcattaaaagaagaggaagtaataaaaaaaggattatctcctatactactgttgctcagctgttatggtcctctacttacagataaaaaaaaaacatattgaggaaaaataattcattttataggtaaagggaatatgtcttttcaatcctttcccatgctaggttttgaccaataaattggccatggctggtactatttccaaagctaagacaaggccatttagtaaagtctaatggcaagatggcaacatcaatgatggcacaatccaacaggaggggacattgcacaagtaatcttggagttacagaaaataaaacaccctatacgattgtacccagctggcgagaagttttgcaatacagacacaaaaggagaatcctatagctactcatattggcatgtgaatgaaaacgtctaatggtatatacaactttgaggtttcatggttaaatacacataaactgtgacgaacaggtagtaacatagccattgaacaaaactggcagatattggaagctatcagaaaactgttacttaataaacatgctcagtggtcagccagaatttctgatttcaaaaaaactataggtcattcagaaacaaactcgaaaattaattaattgatttgtagtattcagtcaaaaaattgtgatacgccacaagactcctactgatgggagtaaagtcggtttgattctccaaagagattctctctaacaagactacataagttgtacttaataaattcaaaatcttcacaaaatacattcgcacataaaagcatgagcaacgaatagtaccatatgagcaggctcaacgatcttgtaaccggtccctcccctgaacatggcaaccaaattatctggcaatattccgagccattaacaaaaaagcttgaagcgcctgaaagaattaccggcattccattacctaacctggaaatggattttttacccccgggccccttgtcaacaatgatcacaccatccttctcaccaacggtgcaactctctccttgggccgtttctgagctgaaaccagaattcggcttggcactcatgactatgtttccaatgttgagtccaattctcggcaacttgacaaagctagcagaattcctgacatcaatgctcctaattccaacaaacaagaggttgtgtgttacggcaagaactagcagaagttaactagcatgaaagaaaaagaatgcatgtcatggagacaaagtcttacttaccatgatgtcagtttgtttgtatgggtcgcacttaagggttggaaggggattgagatagtatgcatagaccaccctccaaaggcccaggagcaccactatgtgattcttgttgaaaataggtgatgacagggcagtggcggatgccgaattccacagctgagtatttggagttatgagatgttaattcattgtatggaacgcatagtgttcgctataacagtagcacacatgacgatacaaatagtagcaacctacaacctcttcgtttttttaaaaaacaaagttgtacagtatccatcaccaatcaagaatgattaccactaatggcagaagcaagttaccacaagagcaaggggggacaggacattttcagaatttcaggcgacttcacctatggattggacggtgggggatggatggattcgttgccttgattcactcaccgcctctggagcacaggggtgagtagcctctctcgctctcaaaagctgcggcgcgccccggtttgctcctcccgcgcgctctgagccgtggttggccgtcaaccccaccgcgtccgccgtccgccgccgggggaacgggagaggagtggttgggaggggagacctcgttaggggatgggcgctggatttgttttgccgcagcagccaatggcgagagaatgacgacgttgtccaaccgagtttcagcgaggagggggtcgcgagccgccgactcaggctcgcctcgcgctcgcacggtcgccgccgctgccttctttcgatggggaaaaacgcgaacagtagggagatagggttaccacttctggggtgaaatttgtatattcgtcgccgtttcggtagaatgccaccatcataataggattcaattaaatgccactctcaagccctcgactattcactgcaataccattttacttttttatttggctattcactgcaataccattttacttttttatttggatttctaaattgttttttcctcaatttatttttttcttggacttctatgcccctggctcagtaggttgaaccggagaggaggggtggcgacttgggacctcgccggtggagtaagagaggcgctgccgccttcaccaacttggccgcaccgcctctcccaccgagctgcctctccactcctcgttgtgtcgcgctgcctcttgtggccagtcgagccgcgcgcctttctcgtccttggcgccaccgccgcaaggacggcagtgtacggcatcctcgcccccgtcaaccgggagatgagcgcgtcggtgggctaggagggtgcgccgccacaagatttctccgagggcgcagccagcgcggttagggaaggcggcggagaacgaggtgagcggtgccggcgctgttggggaagacggccgcgcggatggcgagggaggcagcgcgggtgtgcctcggttggggaaggtggtgccgcaggcgtggctgcccctccctttggtcttctctcctctccctcggctagcgcagcggaacagcaacagaacaatggtggtgggcggcgccggtgtctccaccttttctccgctcgcgctcacgcttgcgtgctcgattcaaccaaatgagagagaccaagaagaaaccaagtccgattcaaccagttgacccatgggcataaacgtacaacaaaaattgtaattgaggaaaattaatttcgaaatgtaaaaaaccacgaaagtggcattgcagcgaatgcgcgcagcttgagagtggcgtttgatcaaatcccattttgacggtggcattctaactaagctagtttttatgggtggcagatatgcaaatttctcactcctgggaggggcgtgcacctcacgtgcgcgaggaggagcaaagtgcattcgatctgtccagttatttttcaatgatctggtcaacccaaatacgagtggaatattcgcttttaaaaccaacccaacctgcttagtcttgaaaccaaataactttaaaaatgggatggcctcaacctggacctagttgttaacatcaaattttggtaagccccaaagtcatcatcggtttagaatcactattggcttcagcatcttggaattggccgatgagaattatcaagtcgccaatagtcgcattcttagtagattcggttaaggaaattaatctattaaaggaagtttatccagaagtgaccgagttcaaggaggatgcggcatggtagtttatctattaattaggaagagttttttattttctttttatctttaggaaagtgtgcttagtgtccgataagaactttatgtttttattttatatttaggaaagtttctttcttgtccaataaggactagtatctacccatggatataaatatgtacacctagggtaattataaactacctctcgatcaatagaactactatcggtgcatcaccaccctcttttccgaggtttttacttatcaccggtggaacttggcacctgatgcgggactgcatcggctttcgatcttcggcgaaggggtaagtcctatgttttaccgaccctggtaattgtatcggctacattggtgtggttcaaggctgcatcgcttcgacctctcaaatcactctggttcggttgatatatttgtctgcctatttatcatatatataagttaatctagtttggtagatttacttgtatcggctgggatctgctttagagtttttgccggtatcagctaaattgctttgccagattagattagctaaggtatccacctctcttaaagtcagtaaaaggcttgattgtttagactttatgtttctttgcatacttcgagtttcatcgaccttaatcgtgcttggaactataaaaactaacctgcctttgattgccaataagggtttcatcggggtttcaaccgatgagttatctggatgttgcatcgtcttctaaggattacacaagttggattcagccaatcgcaataaaggtttcattgtttaactaatcatttggatttaatgacatcggacttccaaccgatgtatgctttaaccatcggatcacttattctatcatattatttttagacgattggtttctattgaattatattattgttatattacattatcattagccgactgtgtttatatctttatttactcaagtatcaaaatatacgggatatatagccgacagttcaagactctattgacatcagttggtatcggcatcggctggaactactccatcggcttgtcagccgatcagctctttggtgatcaacatatttgtctattttgtcaattgcaagatcaaactgataggcacgccagcatctcatcaatattttggatatgcactggagctaagcggatctcctaggccattgtgttcgtcgacttagttcgcgctaacacagatctggcaccatcgggcgagcgtggatttttcgtcaatactagcaaaaccctccaaccaacaagtttaggctctctttgtttaggcttataagttactccttccatttcatattataagtcgttttaattttttttttcagtcaagcttcttcaggtttgagcaagtttataagaaaatttagaaacatctaccacatctgattagttttattaaatataatattgaatatattttgataatttaacactctttaaaatgtgttttgattatttgacatcctggcctactttcattcactcagatggtcccacgtatcatcctcacaagtgtcaattagagcaattgggcaataaaaaaaatgttaaattatcaaatatatttcataagagagatgaaagagagggaggggagacagaggataagaaaagagtggaggaagttaaaacgtggaggtggaggagtttggattatattctatgggtggatttttagtccactaacaatagtaggaggctagacatcttttaaaccgagactaaaaataatttttacaccaaccgggactaaaaattataaaatagcgttggacttttcaactgggcctggcgttggacttttagtctcgattcccattcaaaccaagactaacatggtttttgcaccatccatcaaaagatcacttctccgattaatggtcatggattgacgtggatgaaagagagggccaacaatggtgaaagcgtagactccaacgctgcatcagcatcacggaggaaggcagcagcgcggcgcaattagcgcgtgatcgcatgattagtgcgtgccgtaccgtgtaaaaatactcgaagcattcgtcactactgatcagcggcgaatcctttagcagattcttttcttgtagcctgccttttgttttgttatttccttcctgttttgctcagtctcaagctgcatataatgctctcatgcatagtgatataatcagaagcactcctttcactcacccgagccaaccatggcgaggcaaaccaacggcggcggcagcaacaagaaaccttctactgctgccggcggcgatgcctcaccggacaagcaaaatgcgccgcctcccgaggacaagaagccgccgccggacggcactgcaccgtcgcccaccacccctgccaccggcaataataatccataaggatcctccgccgccgccgccgccgcgacagccggcggcggcgaagggcacgctggacgccttcggccgcgacctcaccgcggaggcggcgaacgccgaccccgtggtggggcgcgaggaggagatcgaccgcgtggtctgcatcctctcccgcaagtccaagaacagcgccgtgctcgtcggcgccgcgggcgtcgggaagacggcgatcgccgagggcctcgcgcagcgcatcgcccgtggcgaggtgtccggcgtcctggagggggcgcgcgtggtggagctcaacgtcgcggcgatgatctccggcacctcgtaccgcggcacgttcgaggagcgcatgacgggggtgatcgccgaggcggaggcggaggccgacgcggccgccgggaaggtggtgctgttcgtggacgagatccacatgctcctcggcgccggccgcgtctcgggcggctgcatcgacgcctccnnnnnnnnnnnnnnnnnnnnnnnnaggggccgcgtccggtgcctcggcgccaccacgcacgacgagtaccatcggtacatggtgagggacgccgcgttcgagcgccggttccagaaggtgcacgtcgcggagcccagcgtggacgacaccgtcgccatcctccgccggctcaagccctcgtaccaggaccaccacgcgtggatatccaggacgccgccctcgtcgccgccgccaagctctccggtcgctacatcccaggtgagagaccattgcgtcgcgcttgatcaccaatcaactctgctcacgatgtgtgcttctcagcgaggcacttcccggacaaggcgatcgacctggtcgacgaggcgtgcgcgacggcgaggctgctgatggatcgccggaagaagaagcaggcgcaggcggcggtggcgcccaaggacgaaaacgtcggccccgaccacatcgcacaggtacgacgcacgccggcgcgcgccaccgcatcgacgtcgcgcgccggcgagacactgaccgcggttgatgcgcatgcgtacgtgcaagtggacgggcatcccggtggcgagcctgggggaggacgagaggaagaagctgctcgagctgccgcagctgctgcaccgtcgcgtgatcgggcaggacgaggcggttggcgccgtcgccgaggcggtggtgcggtcgcggtcgggactcggcaacccgaaccagccgtcgggctccttcctcttcctcggcccgaccggcgtcagcaagacggagctcgccaaggccctcgccgagcagctgttcggcaacgccaagctgctcgtccgcatcgacatgtccgagtacgtcaacgccagctccgtcactcgcctcatcggctccgctccagggtatgtctcgtccgttgcatccgtcagtgccattgctgtgagcttgcatgcccaaggctctaatggcggccgccgtgtgtgatcgcgtcgcatgcgtgcaggacgaacgggtacgacaagggcgggcagctgaccgagctggtgcggtgtcggccatacagcgtggtgctgttcgacgaggtggagaaggcggacgccgccgtgttcaacgtcttcctccagatcctcgacgatgggcggctcaccgacgggcagggccgcaccgtcgacttcaccaacaccatcatcatcatgacctccaacctcggcgcgcagcacctcgccgacgccgccgccgccgacgccagccacaaggacgacgccacggaggccgccgccgccgccgccaagcagcgcgtcctcgccgacgtgcagaggcacttccggccggagctcatcagccggctgacggagatggtggtgttccggccgctgtccggcgagcagctgcggaaggtggcgaggctgcagctccgtggcatggccgcgcgcctcgccgagaagggcatcggcctcgacgtcgccaacgcggcgctcgacgtcgtgctggcgcggtcgagcgaccaggtgcgggcgtacggggcgcggccgatcaagcggtgcctggagaaggacgtgatgacgaggatctccaagatggtggtgcaggaggaggcggacgacgactgctacgtcaccgtcgaggcagaccaggggaaggaggagctcgtgttcaccgtcgacaagcaggcagacgcagaagagaacgacgcggcggcggcgtcgtcttcgtcgtcggcggcggggaagaagaggaagcggaggccgccggcgaggtatctcgtcgtgattgacgacgacgaatagtgaatccaatcctgatcgtactgatcgttgggctatgatttctcacaatttggaactgtgcctcaaaattcagatttctgaattctgatcaatcctcaatgttcttttattaccggttgttaaaattccttgcacatccattcatctggtcattcccgcaaaaatattggccattgtcacgaggtgatgcaagtcttgaactcctggtcccatattgtctaagagcatctccagcagaggtcctaaacacgggggtttctcttccgcacatacgcgctaggaaccggagacggcgcgcactttcctaccgctaacagcgcttagagctctctttttttttcctaactgtgtcgttcttttttttaataaaaactagctgggtggcccgcgcaattgcgcggctaacacccaaacaaaatcatatctatttcagtatgattttacttaagatttattaaatagctatccccgtatttctatttatatagtttttaaaagtcacaccagttactaccccttacttctgtcatatgcttctttatttgcttgctcggtctaccacggcatatggaacctctcaactgctccctcgggataggtaggcccatcccccacccccctttcccgagaggcggccggccgcggactgggatcgctcgttccgtgcttgacttacgagctcgtgtagtaaggcctccgccctatctatatctatggatactgaagtgtggccagctaataacattgattcaattggcattgacataataagaataccactatttctattcattctctttgaaacatttaaaatttggatcttatagttttttgagtttattatctcgttgggtttctttttataatttctagaagtcccgtcaaatgctgccattatactcctctacgacccgtccactgtcttttctttttattatcattgggattttataaatcgaacataattatcgtttgggttcattttttactttttataagtcccgccaaaccgtcagcggctttgccattgtactcctttatggcttgcccgctgcctcccttctttattatcattgagattttaaaatcgaacatgattatcattggttttttactttttagaagttccgaacctttaaaggttggaccttgtagtttttagagtgaccttgtagtttttagagtttattgtctcgttgggtttcattttttataatttttagaagtcccgtcaaacgatgccactatacttctctacagcccatctaccgcctatttttcattgtcattgggattctaaaaatcgaacataacaatcattggaattcattttttattttctagaagtcccaccaaccgtcggcggctctgcaactgtactcctatacacgtcgcacgctgtttctcatttttattgtcattaaaattttaaaaatcgaatatgattatcaatggggtttatttttttttactttcagaagtcctggcaactgctttacccatttgcttcacgatctgcctaccgtcccttcttttaatcatcattaggattcgatttggtgctttactaacagtttttatatgtcgtatcaacctccgccactctactcttttataggcatgttacttaatttatctcgtcatggattttagatggtctttttttcaatagtctttatttttatcatcattttttgttatttataaattttattcctaattgaagtattttttttcttttttaatttcagaatttattttttttcaaattttaattaataccgtatagtgttcttttaatatttttattttttattttttgaagtccagttgtttcaaaattgtattcctatttgaaatctcttttagtttttccaattttggatattattttattttttattatgaattttaattaatgtcgtattgggttcttatatattgggttcttatatggactttcaatattgcttattttaaatcccgaatttcagttgattttaaattatattcctacttgaactcttcgtttctttttgctaatttcagatcttatttttatttttattccgaatattaactaatctcatattgggttcttatatggactcttctctcaatattccttatttttaattacaaatttcggtaatttttaaattatattactacttggactctccttttattttctaatttcggattttattttatttttattttgaatttcgattaatcccgtattgggttcttacatggacacttcttttaatattgcttatttttaattccgaatttcagctatttttgaagtgtatttctacttggactctccttttctttttcaccaattaatataggaatttctagcccccacagcgaacgtggtgcctcctttcaaagctgttttaataatataatacatagatagatagatttgccaccatctgttttttattttgtttagttgactgaaacaaactttcaactcagatttatttcagatttggaaacttttcaactaagatttgaaaactctcaagtctagatttgaacacagatttaaaaattttcaagtcaagatttgaatacattgaacttaaatttaaaaattttaaacttagattttaaaactttcaaatatgatttgaaaattttcnaagtcaagaatttgaaaaaaaaaaccccntttttncaaaaaaaaccttttcccggggaaaaaaacctttttccngaaaaaattttttttaaaaacattcaactaaatatttaaaactttcagctcatatttaaaaactttcatctcagattcaaaaacatt

SEQ ID NO: 75202 - DNA, 4092 bp, Oryza sativa
agaaaaaaaatcaggtccaacagaacccctactaaaggccctaaaatagaaaggcctccaaattatctcctcaagcccctaggcttcgggactttctcgctggcccctattccacgcgcaggagagatctcccaccgccgcgcgctgatctctttttcgcgcgaaaaattttgctagcgccgccgctaaagcctctcctccgcatgcgcgccgcctggatcagcgccctcctctccggctagccacctcctttctcgccgcattcttccctggctggcgacttcctcccctgccggccacctccccacccggtggcctcctccctggcgccctcctgaactactggccacctccctgcagggcagcctcctccctggcggctggcgccctccctctcggctgccagcccgcccgacgccctcctccccagtaaaccacctccacgtccggcacccttctcctcggccggcaatagtcgatggtagtttttttttctttttgcaatggatttgtcgatgcaattagataaggcttgttctttgtggagatttagcttgtcggggagataaattggatgtatgtatttagaaatatttggttggagccaattttttggtctttccaaagataagcatgtgaacatttctattcagttcagatattagtagggaaattatataagataggtggttaattgtgcccgaactgatcgtgtgaatgaattggtgagaaagaatctggtggtgggcactttgttgtattttagtgatcataataaaaatcgataatatcacaactcagcagagaatcagtactataactgaaattggcaggggtgatgcttggatcgagctaatatggttttgggcaaagctcctcccctttctattactgaaaaaaatggatagttcttgatgtagatgtactctgtaaatgaatagttcttgatgtactctgtaaattttggctgcgaatcgatgcttttatcactcttttatcgctactaaaattttacatttccatgtatcggctgcttgcagaatgacaagatgaaacccatgacagtgccatactaattgatatcatctgcattgtcaaactttttaacttttttagcatggtgtaactgcctatttgtgtgcattgaaatctctagactacttacattgcaccttttctgcaacagtgcatatgcatgactttaagatactgtgtcagctgaaatcttgtgatcgtattctagaggatatgggtgtattgctgtttaatttcctgagctacacaattttatttgtaccgatgttagttatatgcaggttcttcgagcagactgttacaaaaagtaaaaaaataagctgctttggggtgctatatggttttctttttaatgcaactttgtagagctctagcataacctgttctaaattctaatgattggaaaattttgctaccattatgcattctaccaacatatattagctagtatctaccatttttcctaagattgattggagaagttgtcaatttatctacttattgcagtgactagattgtgatggcaagtgaaagtgattcctttgtgcgcatgatgtctgaagagacccatgttgaagcatattccttgccaatgcaaaatgaagaccttcatacttcaacaaatggtgcaaaaggaagagccaaaagatcaagcaactttaatcgtacggaggacgttcaactgtgcatttcatggcaaagcattagctcggattctattattggcaatgagcaaccaaggaaggcatattggcaaaggattgcagagcactaccatgctaaccgtgattttgagtctgataggaatgcaaactctcttgagcaccgttggggtaacattcagaaggaagtaagaaagtttcagggctgctacgatcaaattgagcgtcgacatccaagtggcataccacatcaggagcttgtaagttaaattgtttattcatttttattaataacaatcttgtatgtatgtcaactaacacttgaattttgctacaggttcttgaagtcgaggcattgtactcatcgaatgcaccaaagaatagggcatttcagtttaatcattgttggctcaagttgaggaattctccgaagtttcaaactctagaatcccacaagaggccaaggtctaggaagtcttcgaccccaattgagatagctggtgaagaagatgaagaaggagatgatgctaggaagagtacaactcctgatttatcacagccaagtgctaaaaagagaccaatcggtaggaagcaagcaaaggagaagttgaagaatggaggagaagatggaccatacaaagaggcgatgaaagtgttagagtttgtgtcgaatatgtgtacgtagtcggttacagtttaggacttggagttgtactaggtgtaggactagagtatgagtcgaactctgtcctaggatctctcataaatagaggggcgtgcctgttgtaaccgcatggcgacttagcatagcgagagggagcggcagccggcggcgaccggccgtgagtcgttgtaactctgatacgctgtaatatgccggatcggggaggagcgcccgtaatcagtgccccggagatgtaggcctcggctgaactccgttatcaaatatcgtgcctcggtgttgtcatcatgtttggatctcctatggcattttcttccgcgtttggtttccgatgtgatttcggggccggttttataacaagtggtatcagaacctgcgggagatccatggtagaggtacgagggaggtggtccactccgcgacgactacacagggtgtccagggacggacatagacgcaaggtggagcacggcgacgatcagcggaatttgatcggtggaatcggacactttaggcggtggtctgaaccgttcgatggctgcaatcaatagggaaatgaccagacgtggtgctcgggttgatggcggcggaagcgattggcgatccaatcggtgggttggacacttcgggcgggtggctcgaactttctggtgagctactttcaacaggaagacgtgaggcttcacgctcggggttgattgaagctggaggcgatcggcgatctcgatcggtgcaatcgaacactctgggcggggtagcccgggtctttcgatgagctgcgttcgacagggagacggctagacgtagcgctcgggtcgttcggtggctgggaagacggcatgtgatttgtcggcttcggctcgcggctagattgatgggtgatcaatcggaggtcggagtggatttgtttgcgacgaactctgggtggcaggaacacggtttggtgtggtcgttgtgtaggtgctgacgggattcgacgcgggccggctccggtgattggaggcggcggctttcgcggggagcagtggtgtcggttgcttcggggagaagcggcggcgaacctccaaggcggaggcggagacggtcctgtgagcgttggttgttcctgaccggcggggagctcgcaggggcgtcggacggaggtgacaatgacttctggcagagtcgacgcgatatccgacggggagtgcgtcggagtgtgggcagggaacgaaagaggattgggatccggttcggagtgaaccgtttccaggtgggcttaatcggcaattaagaaggaaaaaagggattttttttttgggccggttggtgaagcttgatagtattttgtaggagccaatactgctcacgtgttgttagggtactgttcaccaggagcaaagctgaggactattattacaagtcacagtggtgcatgctaaagaaactgaggcggtttgtgcttggcttgtttgcacgtggaggcgtgttaagtcaagtattggctcggtaggatagcagcacaagggtggctcgacatgtctagcagagtgtgagaaattcccgggcaacagtgggtgaaaatcgttgagggcgtcaacgggctgtttggcagtacaggatatatccagaatctgcggggattgcatgatggggatatatgaaatctacgtcactgaaggagaagagcgaacgctatggtgataatttcttcgggtgattcaaggcaacagt

SEQ ID NO: 75203 - DNA, 14857 bp, Oryza sativa
gccgcttgaaccattataggaaaaaaaaaacttttcagctgaagtataggagtagcccctataaagctttacttgatacagtcagtagcggcattattgatgcttcatcggtaggccagaggattattttgccaggttcattcactggaagtccacgctattactaccaaaattaccaagattgtgtggctctctgtcgtagatttggatgcccggatcttttcatcacttacacgtgtaatgctgcttggccagagataacagaagctttagcatttataccaggacaacaaccttctgatcggcccgatattgttgatcgagtttttgaaatgaagctcaagctgtttgttgatgatataaaaaaaatatgagttctttggtcccatactcggaagttagctcgtttaattactatgttttaattcttatgttttaatatgagttcttatgttttaattactatgttttgtttcagttttgtttacctcaatattttttttcagttgtctacacgattgaatttcagaaacatggtcttccgcatgtccacttgatagtgtggcttaaaaaggatagaccccttgatgccgatcagatagacactttcatatcagcgcagttaccagacccatctattgaccctattggttatgaggctgtctcacaattcatgattcatggtccttgcaatattccaggttcctcttctccttgcatggctgatggtaaatgcactaaattctatcccaaggaattttctgacaaaacagttgtgctacctaatggccatgttaggtatgctcgaccaaataatggaatcatacaaagaaacgtggcattgagattgataatcaatttgtggttccacataatgtagacttattagttaagtatcaggcacacataaatgtggaaagtgttaatcgtgatggtatggagaaatacatgtttaagtatacaaacaagggccctgattttgctaaagttggaatcaaaagaaaaagatacccccggttcttctacagaggaaataaatgaaataaaggaataccttgaatgtagatgtgttacaccacatgatgcagcttggcggcttttgcaatttgatatccatcacaccgatccagccgtggaacgtcttccagtgcatctcccactagaaaatggtgttgtatttactgaggatgaccatcttcaccaggtgattgataatccatgcaatctcataacaaaattgactgcatggtttgaggcaaacaagacatatccagaggctcgacaacacacatttgtagagttccctgaacattggacatggcatggtgatggaaaattttggaaaccgcgtcgtaatgcccgtggaaaggttggccgtatagccaatgttagtcctaaccaaggagaaagattttatctgcgtatgctattgcatattataaaaggggcacaagacttttctgatcttcacaccatggctggccaactatacccaacatttcgtgctgcatgtcaagcattaggtttacttggtgatgattgtgagtggtccaatgctatggctgatgcagcacaatgggcattaccataccaacttcgccagctatttgtcacattacttcttttttgtgaagtcactgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccggcccatcttcccctctctccccgggcgctctctctctctctctctctctctctctctctcgcactctcccatctctccccccctcccgctcggcctcgcccgtacgctgctcgcgcgtgcgagagccgccctgagcgcctctctccccgctcccccgctcagcctcgcccgcacgccacgcgcgcgtgcgcgtaagccgccgcgccgagcgccccctccctttcccctcgctctgtcgcgcctgcagccgcgcagccgctcgtcctcgcgagccagcgtgtgcgcgcccgcgcacgtggtggccgaccgcccggtcgccgccgccgccagcctctgcacgcgcctgtcgccagtgtcgccgctccgctccaaaccgccccgccgtcatcgtcgtcgtcatcgcccggcccccgcccctccgcgcgcaagccgccaagggacggaggcagcgcccctcctccctctgccgcgttgcccccgctcccctcctcctttttcccgaatcggcaaaagggcaagcccctttctccccctcctttttttcccctttttcccccgccggcgtcatcctccctgtcgccgctttggccgcgaccgccgagcgccagctcgcgccttgaccgccctaagtcggttcccaaaccgacattgccgccccctttaaaccccagctccttcccctccaatctccctcgttttcgcctcctcgccatagctgccgcccccgtgctctgttcgccgtcgccgtttgttgttgcacgtgtcgaaggagtcggcacgagcaaggacgcggaaggggactccggccgcgccctctccttcctcttccccggcccgaggccggagatattactcccgcgccgtcggcctctcgtcacagcgccccgacccgcacggtagtgcctccctccgttcttcctcctcgccccatctcctccccctagctttcggtagtagctcgagtagactacccgtagctagccggcgccgccccgaccgttgccgtcgctcgccgcgtgctcgccgccatcgccgctcgagctccgtagcacccgcacgtcgccagcctcgctcggcgtagctccgtccaatccgacgctagcatcggattcccgtggtcgcgtggatgctctcaccgccgggaatcggtctctcgtgacctcgtcgccgtttccctcttctcccgccgccggttgccgccgccgcaatccgccgccgtcgagcaacctccggcgaatccgagccgttggctcgtctccccttgtcacgtgcaaccgcccggtgtgcacgcttttgcccgtatcgccgtggttcgctccgccgctcgccgccgccgcccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcggaccgcgcgcatgcaccgcgtcccttccccgcccgcgcgcgtgcgtcgcgtgctccctccgcacggtgagccgagccgctaacaagcgggtcccacccgggaccgcgcgtgatgagcccggtccaccggctctctctctcctccctcccgcgcgcgcgcgagtttgggccgccttgggccggccagcccatttagcttggccagaccgctccatttctcttgggccgcgccctagccatccgagaaaagtctatattccctccctcccttcttttctttttcttttccaaaaaaggatttaaataaatcctttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcaagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattcccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgctcgaacagccgtgcccacggtcatgggcggatgtgaggtgattcctagcgtagttttgtttgactactgcttgtgaaattgttgttgtgaaaaggggttcgatgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctactgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagtcaccgacccaataaaattgcttgaagattatatcaagccaatgggagaagatttggcatatcgtactattcggcccacacaaggtatctctcaaccattagtgcagcaacacattaggtcatatgtcttggatgaattagacaaattactcaaagattctggatatagcctaggtcacttcaacttgccagagccagaacaccatgattacaatgttttgaacaacaggttggtagtggatgagctctcttatgaccttgatgctactttagtagaagcaaatgagcaacttaacaataaactcaagtcagagatctatttatgatgccatagaacactcagttctgaatggttcaggtcacactttctttgtatatggatatggtggtaccggcaaaacatttctgtggaatgcacttctcaataatataagaagtcgtggaaagatagccttagcagttgcatcttctggtatagcagctttgttgttgccaggtggtcgaacaccacactcacggtttagaattcctatagatattcaagagtattccatgtgtgctattaagaaaaatacacatgtcgctgagctcatagaaagaacatcactaatcacatgggatgaggcacctgtaaaccataagcactgttttgaagcacttgatcgaactcttagagatatcatgccatcaaacaattgttatctaccaaacaagcaatttggtggtgtcacggttgttctaggtggtgattttaggcaaacattgcctgtcatcccaaatgcaaataagcagcagatcctcaatgcttcaatcacacgatcccatttgtggcagaattgtgtggttctccatttaactgaaaacatgagacttagatgcccaacactttctcaggttgataggattgaattagaacagttttctcactggcttctttctattggtgatggcacactacctaatagcatgccaacagatcgacctgacacaacatggatccaaattccagagtatcttttgttacctgctcaggaaagaaaccttacaggtttaatttcttttgtctatgagtaaacaccagatgcctcagaattaccagcctatttgtgtcagcgagcaattttggccccaacaaatgaggtggctgctgctataaatgctcagattattggccagatagctaatgaggaaatgtcatattatagctttgatacaattgatgataccacagctaactattgcactcttcaagacctgtatcctccagagtttctcaacacggttcgcatgagtggccttccagatcaccatttacaacttaagattggtgtcccaataatgttacttagaaatttgagtccatccaagggcttatacaatggaactagacttattgtgacgcagctcactcatcgtgtaattgaagcccaaataataacaggaagcgctaaaggttctaaagcttatatccctagaattgtttctgtttcgacagacccgaaatggcctttcaagatgagacgtcgtcaatttccagtgcgtgtttcatatgcaatgacgataaacaagagccaaggatagagacttagcaaggttggtgtttacttgccaagtcccgtgttctctcatgggcagctttatgttgccttctcccgcgtaacatcttcaaaaggattacgaatcctcattgaaaataactctgctgagtatgaaagaaagacacataatgttgtgtattctgacattttccatgatatattaagccaatgttgtcagttctccccagatacccatgtccaatagatcagctttcttactacaaggtatttatgttttacaatttatgctctggtagtctgtttagtataatcttttttatgcctgaattttccatattacatccagtagacaacctacacttgctaatgcgtttctcaatgctctttgatttattaaagtgtatctgtcatcaacggagtgcacaacacagaaccatcttcatatatatattttagtaatgcagtcctcttgcagttctatggttcttttgaaaggagtgacttaacaacaatacataataacaactgttgaatttatttcaagctaaagaaactgtagtgcttatgttgttcagctatgttttcaaagtagcttacttcctgttcacatgtaaattatgtgctttaagtcatgtatgcacatcaaattaccccatttcaatataaatttagcattcttaaatatggttcccaccacctcaggtttgatttttcttttgtcccaagttgatatatctgatttctatctttctacatatccaaccatcctacattcatagctaaacatacaaattagataagtaatatctaaacttacatacttctataatccacatggatatatggtggtaagttcttatcattacttattgttgatatagataagcacagttctaatgctcctctgctcatatgttaacatgagtaaccattttgttacattgtactgctaaattttaattctatttggacagcccattgttaaaagatattctcccctcaacttcctattgaatggtaataggaaatgtcccatttcttattgttttatgtagagatagagacctcaaattcacgtctcatactatcgggtaatgattgacaagtatatttgatctgagttcattttacttattgcagatcaagaatgacatataaagaagaatattacttaatattatatgagggaatttctatcgtttaacaaggtatgacatatgacactgaaaggaataaaatttccaatttataagctcaagagttaaactatgttcctatcagaactaaactgaacgatctatgcgctttggcttcattttagtgtttattttgtagctcctttacatggtgatgaaatttccattaggcgttgatgcaaaattcaacagcgcctactatttcaggattaccaagtaggtactgcaggagacgtgctcacatattatcacaactactctgttttgccacaaatgatgcctatccggacatgtgcaacttggttatctcttctgcagttctgctgattgatcctactgatttacagagcttcttaatgtatgttttattcttagtggttttgtatattctcatatgagtaggctgagatttgtataaacctaatgccatgcccaatgttaaaaaaacatgtaggatacgatttaaccctatgattgttgtactgaactttccatctaattcttccaatatttagtgcccgcggcaacgctcggggtatagagtagtataactatatcagcgtcatgctgtcaaaacatatctacacatgcatacatgtgtacttttatgtattttatgatttgatcgcatggcatctcttgatatggatcattatcatttcataattaagctgcagtggtatatatatatacatatactgtatggccaaggatagcatgccacgagcaaagatatttgacgtcgattaatctatatgcatgattcttgctctcacaaattctaacggtctcggggaataagccaaacgatatatttataataaaaaataatttataaataaaatttttatatatgtattattagcgatatataaaagtaaaggctgtaaaataaatttcgataaaaaaaacttaaaatcaactttaaattaagattgaaaattcaaattctggctggtaagcataaatataaatgcaaagatgaggctggttgatgaaaggcacgtaaagttaataagaacgatcgatccatatgaagctgaatcaatcaatatcagtctctcattttcggtgatctgcccgtacctggaccaaaacctgcatgaggttgatccaccaatgtgtatgcagcgaactgccgaggttcactcgctcacggtttgcaatctcgttttgggttgaaatgcgagcttgtttgtttgaatggacatgaatattatcactatctttccaaatccaattgacgactctgaataatcagatcgatctgtagtccatggatttatgcaggtgaatgttgatttcccacgcaaagtgtacgtagatgggatatttggatttgtataaagactttgacttttttaactgggactggtcaactaattaattggttccaagacttattgccaactgtactactccattatacaagaatatttttccttagtccccacaaaacaaatattatgggaaagagtgcaagatactctttatgggaagggacagaattttgcagaggattaatgttttttctctaactaattctttacgtaaatataaaattacaaaagtagtataatactatgttacacaaatgaatttgaccacatcaattttcacatatatggttaaacgcacccattatccaaaacaaataatcataatgattatggtataatatgtgtgtgtgtgtgtatatatatatatatatatatatatatatatatatatatatatatatatatatatatatatatgccaccttgccaaataaaatggcattactcgttgtgggcgtctgtgtttgtactgtgtttcttaaaaaaatgacagtatttctctatgcgaccgaatagattagcactatccccttcccccttagcgtatgacaccattaacttctgtacacatgttttatctttaaccttactgaaaaaatatgtaataataataatattttttgttgttatttatttttaccattaaagctgctttaagtatgacttacatatattcttttatatttacatttttttaataaaatcactgttcacgcactacaaatcgatgacaacgtatattagaaatggagtgaatatttcatcgtgtagaacggataggatggtgatgtgtagggtctttggttggagttggcttggctaactattccaattctatctgcaagctagcatggccggcgtgcgtgcaccgggatggcgacgtcgactttagttcttagaatgaaattattggtagaaatttggaatgcccaagggccaagggacaatatgctgtgagacgagaagaatctgccaactgcttgcatgccacaggcaaccgccggcaatgatatcattcatgggattttttttccttatgataatggaataaaaacatcggatattatttagtttaaaaaaaacatgggatattattttattatctgaaagtcacaattataagaaacacccatacccaatcatatgtacagtactaccttcgttttatattataagactttctaacccatatatatatatatatatatatatatatatatgaatgtaggcaatggtagaaagtcttataacctgaaacggagggagtagtatacttcctccataaaaaaaaactcaacttaggaggggatgtgacccctcctagtacaatgaatctggactaccatttatccagattcgttgtctcacatcccctcctaggttgagttttttttgggacgggagagtaagaatcactcatatgagaagggctcactcttaaccaaaacacagcaggggagtctcccatagtaaaaacactcaagtatcatattgtgatatagtagtaataatatttaaaactgtacaattgaactgacacatagtaacaaattacctgtagcagtataccactatacttgtatagacatgtttcatctattgcacatatatgctcattattaaccatctagcccatcgttaatctagtaccacctattttatatactgatctcaaaaaagtatcgacaatagacatatgttgtgctctcttcgtaaaaaaaacgaatctggacatacactatgtccgtgtatgtccagattcatttatagaagtgggttttttttttgacatagggagtacgagcctaaacaattctactctgatatcgatgtcccacaggcgacaacaaacgaatttgcgaagcctccatatcctgcataccataaataaatcaataggataatcccatatagtttttccccgattgaattttcgtagctgcaaacacttatttataggcagagagagagagggagagagagagctgtggcttgggcaattacgccacagctcactgaattcgatcgcctctctctctcgttgctgccttctggcaaaccatggccgtccaggttcaacgaacgcccctcccccggtccacgtacaccggccatcgggtctatctcctgcgggccccacctgcagtgacacggtgcaccgtggaccgcgcctttccgcgcagtcatggacctccccttcctcctctcctgtataaaacctcgcgtcctgatgcttcctcctccaactccacgagccgccatttcccaaggaggagcaaggattgttgttgtttcgctgtcagatcggtaggcagtgccccccctctctgttgtctcggattggattggattggattggagtttttctgggttgatgtggtgattttgagggtgatttttttgtgtgtgtgtgtgtgttcttgatttttgttttttatttggtttgtttcagattcctgacgggataatgggtgagaccatcgccaaggatgtcaccgaggtgagcgagcgccaaaatggtttcttgttcttcatcgtggtggcatttttttggattggtattgggatgtgatttgagagagaaaaagaagaagattgaatcttttttgtgatgtgctgtagttgattgggaacacgccgttggtgtacctcaaccgggtgacggatgggtgcgtcgggcgcgtcgcggccaagctcgagtccatggagccatgctccagcgtcaaggataggtgaagctctactgaaatttatcatcttgtcatgttagggtggtggattatgtctgaaaaatcggttatttgtggttgtttccggaatggagatgtgatttttctctgtttagttctcagctgtttatgattagagctcttacttgcatcttggattttgagatgaaattttgatgtgtggttgtgttgggtttgtacaggattggatacagtatgatcactgatgcagaggagaaggggctgatcactccaggcaaggtgaggattttttttaatgatttcggtgttctgtaccaatggaacagtttggtcttataaactagttgttcttcctgcatcaatgtgaatgttgttcatttatttatttgttggatcccactgcggtttgatagtatgttggagctgatctgctgatgaaagggcgtgcatagcagagagtttgagttgaccggcgcatgtgcgaaagctcaaataagtagttagattgataagaaatggaccattcacctactgcattggtctagatattttatagaaaatgaataaggtgttcctcgcgttatctaagtcagaaggcaacgaaatgtgatccccagctgtcactcgattgcataatcataagttatccgatagctgttattctgccatctcatgttgtggcatgtttccctaatttattcttgatgaagaggccactaaacattatttttgcaatggagataacctaatgattgatgcttgggcctagactggttttgtttagttgattttattggaaaaataaattgattttcttcattaaatggaaacctgctgtatggactgattagtactagatgaaccagcatatgtttctagctagttatgtacaatagaccttgtcttgtcttattttagaaatagttttcgtagtacttatgctattaaagaatagatgaccaagtaaattttttttcagccaaataagatcacggctccattgcatcactgaagtttttcgatctgcttgctctttataagaacaatcatattattttcaatagcagcatattttgacataccatgcttcttctagattaatatatttgccgtgtctaggagtcatgaatgatgaatgtggccttgtttgcagtattgttcgttttctcctgcatctaggtgttttatttctgcagatactttgccagttgaccaaagtaatttttatattgccagttgaccaaagtaatttttatatttccagttgccatctgcatgattcaattagtagcttaaagcatactccctccgtcccaaaatataacttttagcattcagaatttgtctcaaaatataacaacttcttcacctacattcccttctcaaccaatcacaaccttccaccattcaaattcaccacctactttctcttcccaaccaatcacaaaccctcgtccatttaatcccacatactttcttaatacctgtgtctaagcctagaactccttatattttgggaaggaggtagtatttaaataagggaattttacaatgctttttatgtgatagtaagttagcagtttttttttgttggtaaacactttcttcaaactgctagtaaagctaaatctattataacttccatatagttaagaacgcaagatctggctttactgatgttttgctttgtctgtcaatgattgccagagtgtgctgattgagccaactagtggcaacacaggcattggactggccttcatggctgctgcaaagggttacaggcttgtactcacgatgccggcctccatgagcatggagaggagaatcatattgaaggcttttggtgctgaattgatacttactgacccactcttgggaatgaaaggagctgtccaaaaggcagaagaactggcagcgaagacaaacaactcatttatcctccaacaattcgagaaccctgctaacccaaaggtgtagcatgatttaacattttaatacccttgtttatatttgtgttctgtggactcatactgggatgttattatgcagatccattacgagaccactggacctgaaatctggaaaggaacaggaggtaaagttgatggtttagtttctggtattgggacaggtggcactattactggagctggacgatacctcagagagcaaaatcctgatatcaaggtaaggaccagaaaagctctatactacagttttggtttgccacattgaataattaaagttccagcatttgttcctttaggaaaagaatagtatctgattttattttttttcttatgtaagatctatggtgtggagccagtcgagagcgctgtcttatctggtggaaagcctggtaataaggagtcatccattaattccatgtcatgactttatttcattttctggttgtgtcaataaaaaaataataaattgtttgccgcactttagttttcccacaacagccaaaagctaaaacaaaatctttgatttgtggttgtctgggacttagtcatgtgaatatccttgttgaggagggagag

SEQ ID NO: 75204 - DNA, 646 bp, Oryza sativa
  unsure (1)..(646): unsure at all n locations
tgtggtggaaaaatgggaaagtaaaatattttgtggagtgatggaataaagaaatggttctccttttttcctttactttctcctccaattttcttttcttgcatgaatatggaaggggcatggctatatgcacttttttcatcatgctcaatgttttgagagcaagctttatttctctctttatttctctctcttttcttctatagccatgcctttccctccttttctcattttctttttgccaaggatcttctaggagaagaaaacatagtctaaagtaggagttttattgaatggaatttttgtgggaagctaacttccggtgtagaagcttagcttgattaaatatgtggaaatgaaagtggaaatgaccccttgatcatgagaatatgaaagatgtctatcacgagtcacacacatttgacaaagctcaatataatgtcaagcagtcatatgcatgataaggttcatcaatgatatacccttgcattatgggncccccccttnttggggtttaaaaggggggttttaaatttttaaaaaaaaaaaaatgggaaaaaaaaaacccaataggaggaatgacctttaaaacattttttattttgaaaaacaaattcccataaatcatgacaacagtcgcgataat

SEQ ID NO: 75205 - DNA, 5597 bp, Oryza sativa
aacttggatggggtagaatttttcccaggacttgcaagcttttatcctaaggacattgaaggctccgatttgataaaacttgagctccaacttgatacatatattgatgatatgagagaggatgatagattaaaaggcctaaacaacattgatgagctctctatattaagcttgttgaaacaaagaagcaaaagctcttgagttttgactagtattgtaatatccttgcgtcaaaaaaagtactgtaatatccaatttatctgaagactttatgtatgtttgaacaatttacatcttcatttaggtaagatttatacttatttgttattttctactacttgtattgaaccatttagagttatataccatattgtttaccacattttatatcgaatcatattgtattgcattcggatttttttttttggctaggcctaccctgggttcaaatcctgggtccgccactgatcctgtgttcatatgtgcatataattttgtatacgatagatacatattagttgaattggatttctttttaagataatagttcaattggatttaagggcatcaccaatgtatattgtaaaagtgatccatatagatgggacccacataaagaaactttaactatagccatctccacaatgtatatagatacaaggtagcattaggatatgagagagaaatagagatagatagtattatttattccatatgggtaatccatatgcttatagatacctttagttattttcttcatatggactagttgtacaatggtagtaggtagctgaatgaagtataatattgactatggactattgactataacttgtttatgtttttactttgtatacaattatataattagaaatataattagaacccgctacgatgtaacaaacaatatatttattttttttcctctgactaaaatgtttagtcttcggagcaaacgtggtggctctaattcagattcatatatccaatcctgatactaattgaaaattaatcaacatgctcctatcttctatggtcccgatctcttctattaccagccatggaggcgtagacgaacaagcgagacgttgaacactaccttttgagactaacattggatcaataattaaaaaagatgaataccccaccgcattgctgtgaaaaattaagttgcataatatatacaaataagatgtaatatgattatcaaaactaaaacaaattgatacaattttgcagcctaaaaataattgagattgcatagttttataagagaaaaggaagagacaatttgaaccatagatctattattcaaaggctagaaataattagagtgatgtggtttaacgagagaagagagtaatagatcaaaactaaaacaaattgatacaattttgagcctaaaaataattgagattgcatggttttatgagaaaagaaataagagataatttgaaccatagatctatcatccaaaggctagaaataattagcgtgatatggcttaatgagagaagagaaaaatactattaactatacttagtggggaagaactatataagtatataggattcctttatttcctgatgagccacctatatatgttttttaagatgaggtgttggatttggaaagaacggaggggaggagaagagtcatggcacttccattagggcaacctcaatgtatgttgccaaacttgatagtagtgtggggccaagagtgagaggtggtagtggtacatgatagagtccacaatgtatctgtgtaagcactagaaaataagctgggaccctcttaaagaaaagcatctattctcagcatcatgttgttggaaatttggtcataattcggtatattttaatccaaaataacaagataataaacatgatatttacaatgggatttgatccagtggtagtggtgaatgtaatcaacatgagcatgcttaacgtagaataagcatcaacaatcacataataacacaatgttgacattgcgatgaacattaacagtaaaacttttaattgaaataatgtaagaaggttataccccaagaatggtcctccgccggagtttggggcagtattgcctccgttggtgttgacgggagcctccttctctttgtctccactgttgccgttgtctccagtgttcgacatgttggtgaaggtgaagtagatgttgacgaacagtgagtagtcgtgccttgtgctccccaaaaacatgatcgcccgcccgtccgtgcaaacgtcgcagcagcgctggtttcggaggcctactctcccaacgcgtatgcacacactcgttgggatgggattaccgtagcagcaatagcattggaaaatggatgaaagtgtgtctctcttctctcgcgggagatcaaatccattatcattttataagaggaatggaagatgaagagtaagagtcatggaataggaagaggaatagagtaactaattctcatcaattagccatcaaccatcctccactacacaaccatcaaccaacaatcaattaggagtaattgatgtaagttaccaacagaataggaagagtaatagagcaactaattgtcatcaactagccatgaaccatcctccactacacaaccatcaaccatccatcaattaggactaattgatataagttaccaattccctaattccctaatcaaatggattaattctcaaaactattcatcccattgatatcccataaaagaatgaatacacatgaattcctagcataatgagccttagaatttatttgatttaattgatttaaatggatcaattacccaattaaatctaacacatgtgaccctatagtactgtatcaaaattatagtttatttcttattaccggcaatagcactatgacctggttgttgttgttgtttatcacttccacaatgcttcttactaggtagtaggggtctttttcatgtttattacctggttttttatacattgtggatgcccttagaagatctcgagaaggcatgtgggaataaaaaaacaagtcatggataactttaaccagaaaaggaatatcatcgataaaaatttcagagttaagctggaaaaaaaggggtttgcaagaattatgacactatattcttttaattttagtcacttttttccatgtgattactctctcttctctatgtataagattttatgtctcccatctcatttttcaaataggtaataaattatttttcatgtccacctaccacaccaccgttgttagggaggaagagatgatagcgcgggtttgagttgggatggaggaggaagcgcgggtgcagatggagaaatcaaagatgaacgaacaagagaaaggggggattgagttacgaatgactaaaacaaaagtatataattcaaaacaaggttatccaaatattcagaaattaatacttatttaagtgttcaaaagttatttggactgatacttcaaatataatacatgctaataggagtacatagctgagaaccttctaatattatatttacaataaatttaatacgcttggcatgttaattatttgtcatcatgataaataaaagaatgttactacacttcctaccaaatctgttcctcaagaacctatttacaatatataataacatgttataacatttattagatacgagaggttatactcatacgaacgcgcgactctgctgtctagtagatttggatggtaaagattttttccccctccaattaacgaggaaattttaaaaatcgtaaaatgttgtgagaacttctagctttatatattctagattaatttaggggctctaataaattcattcgataattaaaaatatatgatacattatattcatgttggactaaaatggccgttttgaggcctggttaatcttagccactattagcatatccaaacttgccttttgcaactgtatcttcattttcatgcgcaaacggtgttctttttaacaaaaaaaaattgtatagaaaagttgcttgaaacactcatattaatctatttttaaatttctttagataatgcttaatttgtcaaacgctaataactcgttgtgttttacatacgcgtgagagaagagatagggacgaacacagccttaaccgcataattgcatttgcatgcatggctgaccagctgaaggggagggtgggggaactgggaaaactaaagctcgggtcatggcattgcctgatctagaagaaaaggatggactgatctggtcaaatataccgtgtcaatagtgttgttcaaagggatggaattgaaacagcgatatgcatgtaattggctctgtgcgaatgtgtgttcataacaaaatatactatatatatatgcgcatggtcaaattcaagtgggtgtaccgagggtaggcataatagacataattataattaaatatagtagttcgatcctcgaaacaacctgacttagggattaggatccggtgcagtcatagtagagactacaagtttagcagttggaatcatttttcatcattagatcaagacaattaacagctgaaacaaatgctacaggtgtattaaacagtaattgctacagtacatgctacaggaactaactttgtacggtcctttgtgaacagtatttaggaaaaatctagggcgttaatttgtaatccaatggtgtcggtaggactgcttaagtcgcagtggctatagccactgcatgtgatcccctttggtcaacacctctccgaaaaaaaaaagttggtaaaaataagttgcttcgtacttcgtaatttcttaagagtgttgatactaggctctgccttagtacatatccacattttgaaataacctaattctagtgtactccatccgtttcatattataaattatttgactttatataaaaaattagaaatatttaaaatatcaaattagttttattaaatctaatattaatatatgtttataatatgtttgttttgtgttgaaaattctaatatacttttctataaacttggccaaatttaaacaagtttgtcaagaaaaaaaagtcaaatgacttataatatgaaacggagggagtagcatatcaacaacagtgttaatcttgagcggtacatgtctaaaccaagattttgtaccaaagtttctcttagaaatacaaactcttcaatcttactcatcgttctagcttcatagccatttttttatctttggtcattaatttttagaaatttatttagtttggcatcatactatttaattatagtatttatgtttttagatttattacgagaaatatctcataatatattaattaaactacatgaatttttaaaaatcaatggtcaaagcgaagtgagtatagctcaactggttaagttctttatggtggaaccagcccacccagatttaagtattagacttaacacatgtactgctcgtattattcagtggtaggcgacgtatccatcgacaatgagatatctgtagtgacttcgttaattttaagatatgtcagcttagtttttcggagaagctcgatgtatgtgtatatttatagaggtgagtgtatacccattataaacgtatgtgttttt

SEQ ID NO: 75206 - DNA, 77593 bp, Oryza sativa
agactgtcccggtggggtcgctccttaccggcgaaatgagaaggtgaaacaaaaagaaacacagtaaaaaaaattagtactacctctgttccatagtaagtgtagccatgatattccgcgtcaactttgatcgagctaactttgatcatccgttttatttgaaatttttttataattagcatttttgttgtcatgaaatgataaaatatgaatagtactttacctcgtgacttatgtttttaattttttttaaaaaattttcaaataagacgaacggtcaaagttggacgcggaaaaccatggctgcacttattttgggacggagtaagtactccctccgtcccataataataagggattttgagtttttgtttgtaacgtttgaccactcgtcttattcaaatttttttgaaattattatttattttatttgtgacttactttattatctacagtactttaagcataacttttttttatatttgaaaaaaaaattaaataagaagagtggttaaacgttgtaatcaaaagctcaaaatttaagtgggactgatggagtagtatatgtaccagtacttgtctgatccaacaagcaaaaactctctgtgtactttgttcgatcgctttcctatgcaaaatgtcggtagcggagatagcgcccggctagcacgggcgcccgggctccaccctccaccacatttaacagctgcacacttaattaatgtcatacttaatctgttggttcgccggtcaaatcaggtgggcaaactagcgaagtaatccctccatcccatacctccatcctataatataggagatttttggtggacgtaacacatgctaatacaataaatttagacagacggttttaactaaatttattgtactaagatgcgtcacatccatcaaaaatctcctgtattataagacagagagagtatggtttaacatcatcacattgtgcagtctgcagcttatggaccaaagagaggcagtacacagccatattattgttccatcgcaataatttgtagcactggtccatcacaagttagcaactactcctcgctatttttcattttatattaggagtattaaatttgcccgcatctatattaaatcataactgctatgtgtaggtgtatggattaatgtcccgagttcgaaaatgccgacgatggcaatcaactaatgtctccgtccaaaataaatttatttttcacctatttcatgcatacaaatataaaataaaaaatagaatatcatactttatcaaatcgcaatgtaactactttttaatttatctactcctaatataattattctctacttttataaactccgatgcaataattactcaaaaataaacttactgtaagataaatgaaatgatctaaaaccaaacttattatgaagcatttttcacttatctcacacatatcaatacaaaataaaaaataacacagccatattttattaaatcctaatacaattatttctctttttatctattactaatatatttatcttatctcacatatatcaatacaaaataatgattactaaaattaagtttatgttggatacaagaagttattatgtaacagagggaggagtaactattaaggcttgtactctcttcatcccattttaaacgcagtcatgagttttttttccaactctaattatacgtattatttaaaattattttatggttagtattttttattgttattttataataaaacataaatagtactttgtgtcttatttatgtgttttaaatttttttaaataaaacgaacaacaaaaattagacatgaaaactcatgtgtgcgcttaaactgggactatactacctaagctcggtatcgtaaaaagctgcttagctcggctatatatatattggtgcgctgaaagcctaggttggttccggttcgcaagttaactcattacgagctttggcttattcatattacctttacgacttttagctagagttctgacattatacatttgccgatttatcatttgctagtcttaaacattattccttccatcctaaaatataaacattaaaaatcaaattcataactaaaatttactgtattttaaaatggatgtagtacactacaagacttagaacctagcctgtaggagcgaaacaagtaattaaaaacttacgagcagggttcactgtaccgtcggtaaccgcgcggttaccgtggggtacggtaatgtaaataccacggtaacctccttaaattcaaataaatttaaaaaataatttaaatttttgatgaattttgtacagtttttcacagttaccgtggtttaccgtgcggtaaccgtgcttacggccggggcgcggtaaccccagcctcagcggtttgggaaaccctgcttacgagtaaatacaaatacaatagcttacaaacaatcggagacttacgagtagtattgagtaagaagcataagcataaatagagatattggtcttgcatactaccaagcttaacacgccccactcccgtctcaaaatattacaagcaagctaaaactggacgagatacattctagtataataaatctagacagatttatttagattgtaacacataattaattaactattagctaaaaatgtttaaaaaatgaattgatatgatctttttctaaagattattttcccaaaaacatattgtttaatagttaaggatacgtgcatgcgaggaatgagagagtgcaggttgagaatcttgagttaagaagacagccaagggcaaatgaaatggtgaaactattctaaactctcgaggcgacatcccttcgttgtttacatgtcactcaaatgataagaaaaaaattgataagatagattaataacgatgtgttagatcactccacaaacatgcaaattaaattttaacttctacactttgtaaaaaagacatgtgtgactacgaataaacattaattagctgtagtttatttttctcattgcaacttataaaagttggattttaacttacatgtttctaaagtgatatagtatatgttaatacatcttctcaatttttacaatatttttataactattctacgtgtcatgcaaacaataaaaagacatcacctcgagagtttaaaatccactctcaaatgaaatgccattcaaaattgtctgatcggttgagcaacaaaataagctataaaaaaattaacaaagcaaaaaaagtaatttataggtaaataattattactagaattttaaaagtagtaggcataaaaatacaatcaccaaaattaaattataaagttctaaaaagaatcaaacccaagggatgaatattaacatacatgtgtggattcatcccaggttttgatttcttttttcacagagagagtataagccagcaaaaagacatgaaaaccgaatctctctaaagaaatctactcgacgtacgtgttgcagttcccacgctagttgcattgggaagacgaggaaaaccaagccatggcgtcggcgaggcacctccggaacgtgtccatgcgctccggcagcagagctatgcccacctcgatgccgccggcgccagaacgatcctccgccgccgacaccgcgccggtcttcgccacggacacgatctccaccttcgccggcctcccgaacccgaagtcgacgtcgtacacgcggaacctcgtcgacccggccaccgagaacggcgcgtcgtccctgcacgcctccacgatgcgctccttccacccctcccagtacgcgggctcgccgcgcaccgcctcgtcgatggcggcggccaccgccgcgcaggccgtgaagacgccgcccgccacggcggcgccggcgagctcctcctcgggcgccgagacgaagcccgggccgacgcagttgccgaggtacttgtcggggacgcggggcaccagccgcgaccggtggtcgacggagaagatgaagtgggcggcggcggcggcacggccgctgccgccgttgtcgctttcccgtctggagcggcggtagcagtgccacatgaggccgtacatcgccacgagggacgtgcaccgaggcggcggaacgccgcgacgtgcggcctcggcggcgacggcgtccttgacgccctggaggtgctctctggacagggtgaaggtggcgaggaacttgccggcgtcgggcgccttgaacagatctttggcttcgttcgtgggtgcggcgaactcgtcgtgcatctccggtacgtcgcggatgagcgtgcggtcgatgacgggcggctccgggagcttccggtcgccggcgcaggcggcggcccaggtgtggaggaagtgcgtcgagcccaccccgtcgcaggcggagtggtggacgatgacgccgagagcgaggccgcggcgcttgggcggcagcacggtcacctgcagcgcgagctccgcgccgccctcgggaagctccgggacgagcggcgcgatcttggcgagctccctcggctcgtccgtggcgagctcgtcgacgccgacgccgacgccgtcgtgctcggcgacggtgaacgccacgccgtcgccgggctggtagaggagctcgtaccggttggtctcgccgggcgtggggcggacgcggccggcgagcgggtagaaggcgtggatcgcccgtggcagcgactcctccatccgggacagcacggcgtcgacatcgtcgtcggggccgaggcggtagaagaagacgcgctcgacgggctgggcgcggagccacatcacgtccatgaagatgagaggcagggctcgcttgggcagcgcgggctggccggcgggcggcgccggcgcgacgcgcgtcgtgcggaggacgcggaggccagcggcgtgagcggccggtggcggcgccatggtctcgccgcagaacaggtgtggtttgtgttgctcgtggcttagctgcagagcgatggagctttgcttctactcctataatacaatacaatacttatatctctctcacttcacttgtccatatagtaattaatttctaaggttaattagatacatatatcattacaaatttaacggttttaaaatattttattactattcatctaattgaaacaaatatgccactaaatatctccctcacttcactagtccgtagccattaatttctaaggggtactttctttcttaaataaaacgttttgagttttaaatagatcatgtaagcttgatatatatatatatatatatatatatatatatatatatatataatttaaattatacgtatattagtgactctaaacgactgacggtggtggagaaactaaactatcatattattagaatggaggatgagagtaggttattctacctaatcatgtgggactaattgccaatttcccattggcatttgccgagatgaacagtgatgtcacggctgacgacgggtactacgaaatgcttgcaattttgaggctatgagccaacagtttttgggtgctagtttaagctgggatggagggtctgtttggcacaactccagctctaactccacctcttctgaagttggagttcagccaaacagtttcagctccacctaaaatgtgagcggagctgggtgaagctctctcacaaaatgaactagaaaggtggaggtgggtttagacagctccacaactgcactccagacctaacttttggagcaaaatttttaggagttggagctctaccaaacaggtccagagtgtatggtttggcgtcagattcgttggtgccataaaacatggaagtggattcagaggatctcgttagtgccttcacaatgtgctgagctgtcatttagcccgatctctccacgtcagaggttcaatacgaatctttaccatgttcatgagcgggcccaccaaattgaagcccgtgtgaccctttttgtcatccgttcttggcacggggagagaaggctgcaaacgcgttgggagggtgtggcttcattccgcttttcctacatgcactgttgaccttgtggctttcctaggttttggtggcgccttaggccaagcctatgcgtgacccccttaccctcccatctatagatgcaatcatgctcttagggatggcaatgatgatattagatttgctttgaggttcgtgcaagccctcaaccctaactccctctctttctttgtttcctcgtaatgccgctagttctctactctacccaatttccccgcctcctatgttgctacaacgccacccccaagccttctctcacacaatctaaatagaaccctatctgacattgatttatttttaaaccatactagaataattttgtttaagattttaccggaatcaataaaaccattactgacatgtgctattgttaataattagtacatccgtctcaaaatgaatctatcactactacaaaactcctaatatgtactagttttccaccttcaaaaaatagagaaaatataaaaccgatatctttgatcaactatatgtaccggttttaaataaaactagcacatataatattagtgcaactggcatctacacttgtattatctgtgccagctctaaataaaaaatcaacacatgaaaaaacgatctgagctaagagccgagctgaacccatccttatctactcaagtgacttgtacttatcctcgactctctctcgtgcttctctccctcttcctctccttctccagcatctcaccctctccttctccagcgtgcttctccagccattgtctactaccttcaacgacactggcgatgcagcggcagaggcggccgccctctgtccatggagagcagaggtggccagtcccgagctcgggacaaccagatccacgcgcggtagcctcttccttcctctcccctgcgtggcgcggtggcggccgcctcttcctctacctagtgcagtggcggtgaccccttcttgttctctgcacgtcacgacaacagttgcgatgattgtctcttcctctccctgccccagcacgatagacactggatccggccaacacgatggtgactgcaggttattcatggtggagagtaggaatctaattggattgccaatatttcagaatgaatttttgtgatttatgatgtttgatttgtgcggggatgttgttgttggatggatccatggtgatttgtcctatgtgatttggggatgttgtaggatggattgatggtggtatgtggatttctgatgtgtgatttgggtaatggggaggggctcgatgcatcggctcgttttgagccgatacatcgagctgtcttttcatttgtggagtttcaaaggtgtcagttcgtaaactgccacagttgattcctccatatcaatgcctcttgggctgcgtaggttgagaaatccaaacatctatgtgggcttcccaaccgacacctaacacatttatgtgtatttctcccttgccccatcatttcaactaattacaagcattctccatttaatttcttcacctacttactttttttcaattaatcaaaatttttataatcattttcacatatcctcttactataaagttagagcccactaaatcctaaagcttaacatacaaagatgtcacatcatcatccactgataattacaacactcaggctgtgtttggtacggagagtttggaactctcccttcaaacacgtaaaacgaggtggttcattaacacgtgattaattaagtattatctttttttctaaaaaatgatttaatatgatttttttaaagcaacttatgtataaattttttttacaaaaaacgcaccgtttagcagtttgggaagcgtgcgcgcggaaaacgaaagtggtgtggttgggagctcaagctgccgaacacgaccttaaacatcatgcaagcatgttatattatctataattttataatatattaaattttatagcttatcaaatgcaaatatattaaatcatctcacataatatttgattatgtctcatcatctttttttataatatcttatatacctatatagttcatcctaactcgtaacttagttaatgcgctctctctctctcttctctcattaagtcatatcacatcaattgttttgtccttaaatgattatctatggtccaaatcatctcactccttttcttctcttactagaccttacatgattaatctatgatccaaactatctccctccttttcacatcaatttacttttatatttgaatcatcattctatatactatttaaatttaaattatcataaaccatacttgttagggttacgagtaaggtataccctctacccttcgatatacgctacatatcgatatggtatgcttgcgcgtatacggacgttttcggcataagttaaggaagtccattatggagtccacagatggaaagagtcctacttagatagaactgggtcgtcattgtatcgtaccgaatccgatgtctccgagtcctacttggaaaccagttgacctgcggtataaaagggacccccgagaggacctaaggcatcgaatcttaccaccaacacatccactacagcttacgaagccggagcctccaggagccaagtcgccgggatatctagtcgaatctgtggtttccatcatataatcccatatcaactggattagggctattacctaccaaggggcttgaaccaatataatctttgtttttctgcctgcttgatgtcgtactacgtagatcctcgtaccagcgtaccccaataccctctatatccggtctacgtgtatctcccgtcgatagtggcgcgccaggtagggggacttggtgctcaaggttctactattatgacatcctgcttcgtcgacaacagcatcaacaccaacttcaaccaagtagttcctacttcaacaacgctggtgtggactcaagtcggcgaaatcgtcttcccggtttacaccacagtgccgatctcagctggcccgccgatggccggaaatgagaacgcagtggctacaacccaggacgactctatgtcgaaggatcctcccgccgaagcggagatcggaacgtcgacgatatccgagctcgagaaggaacctagtgcggccaagccttgtccttctgacaagaatcacgagccgacgaggatgacttctgaggtgacaaggtcctggtgtcctatccacaaaaccagaaaacatgccttgcaagcctattgggtttttctcaacgtccacgctgaaattcgtgccggcaaaaagcgcggaattcagcgtacttctccaactcgtgatgtctattgtcctattcacaagtcaaagaatcatgacctctcgagctgcaaggtctttctcagcgccatgaagacgccacctcctaaggtccagcagtcacgcgtcgcccttagggatgaggacaaggaacaaggagcgacgccgatttcagatcgatttgttagggtagtcgacatcgatccccacgaaccatcagtcttgcacctgctcaaagactatggttcattgacaacgagtacgccgcgcgaggtattggctatcgacgatgtcggcacgtcagcacacgcaaatgcggaagcggaaaatcaagtgactacaccggcccagcacattggagccgtcaacgcaatattgagggaaaccctctatgatcccgttctgaacgacgatctcgcacgatggacagagcgtttacgggaatcagtgaccaacctcagcaacgcgttcgaagaggccgctgctgtagcgcacccggaacagccaccaactggcgatgctaatggtgaaaaccctgaacagcgggaatcgcctcactgagccacccctccacctcgcggcaccggcgatctccgtgatcacctgaatggtcgccgagaggcgcgacacacacaagacaatgagaaccgttcccgacatcgcatctcttcacggcgtcatgataatgaagaacgaggaggccgttcgagcgaagaccgagaccatgataaccgccacaaccgccgcgatcacgacgatcgcgaacggcgggtgctgggcgatactagtcgaggacgtcgccataatgacgacgacgatggagatcggcgccgagacaacaatgggagacgacgacaagattctcaaaaactcggccgacgtcctcgtaatcgtacgcgaaaccaagcgacccatcgtcatcatcgtcatcttcctcatcctcatcatcagatagacatccgcaaaggacgtacgatcgccgacaacccaccgcccccagcgctgtgttacagctttcggccattcacttcgagatgtccgatggcctgaaagattccgacctggagcaatagagaaatacgatgggagcaccgacccagaagaattccttcaggtttactccacggtactctacgctgccagagcggacaacaacgcattggcgaattacttgccaacggcattgaaaggctctgcacgttcatggctgatgcatctcccccctactccatttcttcgtgggcagacctatggcagcatttcgtcgccaacttccaaggaacttacaagcgccacgcatcgaagacgacctacatgcattgacatagaacccgggtgaatccttgagggattatgttcggcactttaacgagtgcagaaaaacaatccccgaaatcaccgatacttctgtaattcgcgccttcaaatccggtgtcagagatcgctacactactcaggagttggcaacgagacacgtcacgactactcggagattatttgaaattgtcgatcgatgcgcccatgcggacgacgcactgagacgcaagaacgacaaaccgaaaaccggaggagagaagaaaccagccaagggtgcacctgagtcaagtaagaagaaaaatcgcaaaagtggaaaaaggaaagctcaatcggaagtcctcgcaacagaatacgcggaccctcccaagcgcccagacccacaaggtagcgacgcgaagaaaacatggtgccctatacacaagtcagacatacactctttagaagattgcctcgtcttcaaaaagtcgctcgcaaaacatatggcattggaaaaaggcaagcgagtacgtgtggtcgagaaggacgctgagccagctactcaggaatcagactcaacatatccagactccgatctccatgtctcgcacatcttcgggggttccacggcatactcctcaaagcgagaatacaagaaggtggaacgtgaagtttgttcgatgtggcaggggctgcgcccaagatgaagtggtccgagtagaagatagaattctcagaagaggaccacccaaagactgctgtcatcccagggcgatatccgatcgtgatcgaacccactattcgtaacatcaaggtcgcacgagttctaattgatggcggcagctcaatgaaccttctcttcgccagcaccttggacgcgatgtggatcccacgaagcgagttgacacccaccgatcaacccttccatggaatcactcctcagtcatcgtccaaaccattggacaaaattacgttgcctgtgactttcggccaagcaaacaacttccgaatggaatagatcacctttgatgtcgctgaattcgatacatcatacaatgccatcatcgggagaactgcactcgcgaagttcatggccgcatctcactacgcgtatcaagtactcaagatgccgggaccgaagggaacaatcactattcaaggaaatgctaagctggcagtgcaatgcgacaagcggagcgtcgacatggtcgagcacacgcccaacccacctgccacagctgagccacccaagaaagtgagcaaaacaaacaagatgccgaaaccggacggtgcaatcaagatcgttccactctccagtgcaaaccccaacaagaccgtcaaggtcggggcatcactgggcgagaaataggaactcgcgctcatcaccttcctccgtgacaatgctgacgtgttcgcttggcagccgtccgacatgccgggggtacccagggaggtgattgagcacaaacccatggtgcgacccgatgccaagccagtaaagcaaaaactatggagatttgcaccagatcgaaaacaagccatacgagaagaactcgacaagcttctcaaagccagtttcatcagagagatactccatccagagtggctagcaaacccagtcatggtgcggaaggccaacgggaaatagagaatgtgcattgatttcaccgacctcaacaaggcgtgtcccaaggatcacttccctcttcctcgaatagaccaactggtggactcaacagccggttgtgagttgttgagctttctcgacgcttactccggctaccaccaaatcagcatggcgaaagaggacgaggagaagacagcattcatcacgccgttcggggtattctgctacgttaagatgccgttcggactaataaccgcaggaaacactttccagcgcacggtccaaggtgcacttagaaaccaactcggaaacaatgtcgaggcctatgtcgatgacattgttgtcaagaccaagacaagctactcattgattgatgatctgtaggaaacgttcgacaacctccggcgatatcgcctcatgctcaatccagagaagtgcacgttcggagtaccatcgggcaagcttctcggcttcctcgtctctagcagaggaatagaagcaaatcccaagaagatcaaggcaatcgagaacatgaagtcgcctacaagactcaaggaagtacagaagctaaccggatgcatggcggcactaagcaggttcgtcgctaggataggagagcgaggacaacctttttttgctctgctgaaaaagcaagacaaatttgtatggacacaggaagtcgaagaggcattcattgcactcaagcgctacctatcaaatccacctgtacttgttgccccccaacctaatgaagaattatttctctatattgctgccacgccatattccgttagcactgtcattgttgtcgagagagaaggtgcaacgaccagtctactatgtcagcgaagctctccacgatgcaaagacgagatatccacagatccaaaaactgctctacgcggtaatcatgacatcaagaaagctacgccactactttatagcccacagggtcatagttgtatcctccttccctcttggtaaagtagtgagaaacaaagacgttgtcggccgcattgcaaaatgggtagtcgagctaagctagtttgatgtccgctttgcaccacgaacagccatcaagtcccaggtacttgccgacttcatcaccgattggactatgcctgataacaggtcagacaaccaaatcgacaacaaaacgtggacaatggcgttcaacggcacactcaacaaccaaggagtaggggcaggattcatcttgacatcacctttgggagatcaattcaagcatacaattcacctcaacttcagggcgactaataacatagccgagtacgaaggactactcgccgggataaaagttgcagctgcactcggagtcaggagactgatcgtgaaaggcgattccgaactagtcgcaaaccaggtgcataaagattacaagtgctctagccccgagttatccaagtatctcgcagaagtcaggaagctggaaaaaaggttcgatgggatcgaggtccggcatgtataccgcaaagacaacatcgaaccggatgatctagcagggcgtgcgtccagacaagagccacttgaacctggcacctttctggacatgctgaccaggccatcagtgaaagaggcaagcgacgaagatagcctggtcgcccccagcatcagctcgagggctattgaggcagagcgcgccgttcccgatatcgagaccacagacgactggcgcaccccactcattaaattcataggcagcgaagagttgcccgaggacgacgcagaagctgagaaaatatcccgaaaagcaagagtctactgtatgatcggcaacgatctacacaagaaggcaccaaacggggttctcctaaaatgcgtctcgtccgacgacggcagacacctcctcctcgacatacatgaagggatctgtgggtcacatgccgccggtcggacattagtcggaaaagcttttctacaagggttcttctggccaaccgccctcatagacgcctgtgacatggttcagcggtgtgaagcctgttaattccacagtaaacacacaaggttaccagcgcaagcactctagactatccctctcacttggtcgttctcgtgctgggggctagatatactcgggccattcccacgaggacagggtggctacaggttcctattcgtggcgatcgacaagttcactaagtggattgaagcgacacccacggggaaatcaaggccgacaacgccatcaaattcatcaaagggatattttgcagattcggattgccccaccgtatcataacggacaacggctcccagttcatcagtgccgatttccaggattactgcatcaggctaggagtcaagatctgcttcgcctcggtttctcaccctcagagcaatggacaagtcgagagggcaaacggcatagtactacaaggaatcaagacccgcgtctacgacaggctcatgtcgcatgacaagaaatgggtcgaagaacttccatcagtactatgggccgtgcgtaccacaccgacaacatccaacaaggagacacccttcttcctcgtgtacggcttagaggccatgctccccaccgagctacgacatcaaagtacacgagtacagaagtattccgatgaggatcaggaggagcggcgaaatgacgatgtgaatctactcgaggaacatcgcgaacgagttgccgttcgagcagccagctaccaacagtcccttcgccgttaccacgagaagcgcatccgagcacgcacgctttcgatcggcgactacgtcctccgacgggttcaaagccaagcagggcggaacaaactctcacccaaatgggaaggaccgtacacgatcacacaagttgtgcggccaggcgcattcaaaattgcagatggcgatggtcgcgagttgacaaattctttgaacattgatcaattacgtaatttctatgtataagtcaatagtatccatacttgtgagacatcttacagcttcaacaaggcctattttcaggtccagaccacaatcaaagtgttccttcccgatgatcccttacccagatgacacctagcgttgaaacctatcatcatgtccctttacgccgtcttgacaaggcctccgaggtacctaagggaacttcggctagggacgcccagagccgataaggccttgtcggatcctgtagagacgaaagaccatgtaagacctggtcgtgtaagagttctcaccgtgcgtattaaccaagccgtgtaattggaaataaactttccaacttcacggctgggggctaggatcagtgcttgttcaaccgaggcaggtcaaaggtccaagagccttatcttccgagaacaattctccaatgacaaggctgggggctagcgagagtgtataactcaaacgactgatcgaagtcgcgaagtgagaagacactcatacacgctacatctagagtaagaaagcttagttatatagatttcttcactatttcacaagtacttacaattccgtcaaaatcaaaagttatattacaccttttttcctaagacatttgtcacaggatacagagactactaggaaggccaacgctagtccatcgactggaagaccttctccgccagcggcgccatcgacttcgccaggccgtctatctccgtaggagttctccgagaacgagaaaacccttcgcggaggaactcgaggtgcagttgcggacgatgatctcgtatgcaagccaacacatgccccccggcatatcagcttgatcgacgacactcctgcttcaaggcctcgtcgatgcgttgaccgatgccttcaagctgggctcaagccccattcagccacgagatgtatctggccaccgattcctcgggatccccacggggtactcagagctccctacaaactcttgacatgaacgtgcaacaactcttcctatacaagttgaaccacacctcacgaccccggagtgtctctacggcttggtccttcttcacttccagcatagccctctcgagttccgcgacctcaaacttcgtcctccaatactggatgcgacaatcctggtctgcaagcgcactctcgaggtctgcgcagcatggaaacaattaagtcaagctactcttctctcccgagaacacagcaaatctagtcggtccagacagaagcataaagaagatgagaacaaagacaaccgacctaagggagtcgttgctaggctcgtccccacaggcgaactttgatctacatcgccccccggcacaagtggctcgaacgcaagtgctggaacgatcactggcaactcaggcttctcgcgctgctggacatcctcgacatcaacatctctacaaacgacaacaaagtactcaagatcaaaatgctaaagaaagctaaggtgatgaccgcacacacaaaggcagttggaaccaataagagttttacaaagcatgactaaagagtacaagagagctaagatcctactcttcaaaaagtgggaggacggactcccccaggtcgccgacctcctccatcacatccttgcgcgcatcgctggccgccccctgatccaagatcttccgcagatcgagttcagggtgcgccagcctcacacatgcatggacatggcacgccccggtatagatcctgttggacgtctcctctccgatcctggccgcgtgcttagaggggatctcctccatcgccgccgccagctccgcaagagaagtcgtcagggagaactcatcgggatacgccgggatggtagacttgatgccgcactccccggcgagctggtgcagcccagtataggtggcccacaacgagccacggatctccgacaagttgttctcgagctccaacatgcagtgctcaagtccctgccgttgtcactcattgccgaccactagttccctcatcttctggaggtcctcgcgaacctccgccaagttgcccgccagccggtcgtcgcgctcattcgccgacgacgccaccgccgccctcgcctccgcaatctcgtggctaatgccgcaagcactagcctcgaggaggcgccccatctccacctggagctcctcccaggtgaggacggcagccggcgaacaacggccagccacaagatcgctggttgggccgctaggtgtcgcctcgcggctcctgggcactgccacgacatccgtcgaggccacagcaggagacgcgctggaggtccctccagacccgtcttgcgccgccatcgcccgcgccgccctgcgaaaggctgcaattgagacagactgcaagagttcgacgaaatcacggaacctcgaattcattcacttacttctcgccgagcgtcactagctgctgccgtcgcggaggcgggggagacgcgtccgaggcctgaagtatgacagatataatgtgaggtgaaaatcttccgactacgtgataaaagaacaggagaacttaccgagggggtgggtgtcttccgacgatgtccgaccacagaggagaatttcctcccctttttcggaacgttgccaccactcgttgtggcagcggcagcagcagcgtcaggcgcctccttggcgaccttctccttcagcgacgccgccacctgatggtccacgagcggcccgatgatgtcagtcagagggagagcctacacttcatgaagtcataatgcgatcccggaagaaaaatgcaaaaggaccactcagtacacttacattgatggcagcgtcgcgctcggctgcccctttctcgcaaaggggaacggggacatcgctcgacgttgtcgggccactgatcatcagttggccgacgcggcgctccacaggtgcgctgtccaagcctgtagattgagaccagagtcagataagtcgggaagaacacgcacaaaagggagtcaatttaactaaaaaaggaaaataccccgaggaggggcactggaagggaatgtatcgtgacttcaggccatcccgaagtcggaagccaacacacccggacacctttgtgggttccatccaatgtaactcatagtaaaagcggaagaggtcgagaaacagctctaccccaatgtaggcttcacaaagatgcgaaaagacactcaggaaggcgatggaattggggttcaaatggagcaaggaaagaccatagaaattcaagaccaagaggagaaattcagaaggcggaggaagaaaaccgcagagaataaagtcctcgatcacaaccatgtgacccaggacaggctggggttcagtacctcctacttctctctccgcggtctcgcgaccggggagggcgccttcttcctgcagtttcttcagcgacgcgctggtggaggtagacttgtcgagatccattgccgccggggatcgccgaagaatggaccgagatgagctagctagggtttttgcgggagcgaagaagacgagggacgcttggaagctggagagctttttcaacaggcgggcttcaaattggatccccaaaacccccgtaaatagacgcactcccgatggtgcgaattccaaggaaaggagagagatggccgccggaaatttctgggtccgttacgcgcggcagtttttcggacttcaatttaaattcactcacgaccgttgagcttcactcgacgttgtcgatcactccttgtctctcggccctcacatcgagaacgacgacaacttcgacatcagaagtcgcgatcggtctcacgagttcatttaagcataagtcgggggctactgtcagggttacgggtaaggtataccctctacccttcgatatacgctacatatcgatatggtatgcttgcgcgtatacggacgtttccgacataagttaaggaagtccattatggagtccacagatggaaagagtcctactcggatagaactgggtcgtcattgtatcgtaccgagtccgatgtctccgagtcctacttggagaccagttaacctgcggtataaaaggggcccccccgagagtacctaaggcatcgaatcttaccaccaacacatccaccacagcctacgaagccggagcctccaggagccaagtcgccgggagatctagtcgaatcaactcgactacgatctcatcggtatcgtcaagttccgctattccctttgtaatatgtggtttccatcatataatcccatatcaactggattagggctattacctaccaaggggcctgaaccagtataatctttgtttttctgcctgcttgatgtcgtactacgtagatcctcgtaccagcgtaccccaataccctctatatccggtctacaggtatcgccagtcgacaaaacttacaaaccatatcaacttatctaagtttatattgtctagctatcttacacatcacgtttactttgtgctatcatacttaatacatgtgtacacctaaaaagaatcttactccctccttctcaaattgatcatcatataatggaatttaaaatttctcaaattgatcatcatgtaaccgtatggatacggatttcgtcagaatataattaatgcggtatggtcgaatgtgtgcatgctaaagtgtaattagcatagtcttttaatcgatacatacattgtgagagactgtatacatggcgtgttgattgatgtgatttaaattattcttggccttggtatagaaatatatacgattatcagaatgaggaaataccatttaggacaggttagtaatctctaactgttgacaataaaaacgaatctgagacgtggaaaaaaaatcaataattgacatacagaaaaatatgctagtaaaatagaaaggttcctgtgtccaacattgatcatccgtttatcacgtgaaaaattgattctccctgactacctgcactcctgcagccatttaattatcacatgaaaaattgtactatataggggtatctcttacttccttcgtcctattacatttcaagtactgtacttatgaactttttacgattacttttttatcataaaacgttaatagtactttatatgtgaatttttatttttttcataaatttttcaaataagacgaacggtcaaacattgaacacgaaattgcataactagacataatgggacggaggaagtactgaattctctacactgtagactttagagtagagctcacttcttacgccaatatatataatagattagctataaaattggctataattttcttctactctctctatacatatttaatgtatttgtcttgtaacctgtgataagagcagatacaatgggcctgctcgcctgccaggtacagtagctgcctgcgactagccgctgctttttttttcgcttgcttcactgcaggcttcaacactgctgcagcctttgtagctgaacagacccaataatagactataagacaactacagacttacgtgtaagagatagaacatatagaagagaagcggactacagatttgtaaccagttacagcatagacttcaaaaggttgtgcctgtatgaaaggtgggagcaattattaatgatgtagtatatatatttatagttaaatattatatgaattgactattaattgatttggagctagtaattggctatactatatagagcaaggataataatacagccaattgcttactgtatagatctttatagcatatgtgctcactcatatagtggttaactcttcatgcataagccggctgtaaactaacagcccgcttcacatctctctcctctcctctatcatccacctcagcattcagctttcttatagctctctattatacttgctctaaatcagctcttgcatgagagccaacgcccttgaaagctctcactattatacttgctcttatataaatataaatattgttgttttcaatgtcagcagacttttacgtcttcattatcagtatagaaaaagcgggaatttatgataatcggacaaaccgatgaagtagcttaagtagtcttaaatctaaaatagatcctagtacttgtatgatgactcgttcaccgttcaagatattgcagttttgtactactatcagtgattagccttaacatcgaatataaaattttttgggcatggtaaaattgcacattattttttttgttaatgtgatccatgccactgtaaatttaaatttggctattaaaaaaaataccactattcgctctactgaatttttatgaaattagaaccgtgtaactaccataacgttttccatccatccccaccttttccgtcttcctacttccttctcccatcttctgcggtggagcaagcgtcggcacggcacggcgtgagcatacccgacggcggcgacgaagactcgaagacggcggcgaggtgctcctgctgcttgccgtcgtcctctcagctgcagtcccaggcggtgacagtgcgcgccctgcgcgcccgcatctaccacgccgtcgcgccggcggagctcctcctagcggcgttccgccgcgtgtccgtgctcgccgaggaagctgcggcggcgctcccggcggacccggcggacgccgagtgcgtggcggggttcgtcggccgcgtggaccagctgcgcgacaccatcgaggcggtggtgcggcggcgacgaagactcgaagacagcggcgaggtgctcttgctgcttgccgtcgtcctcccagttctagtcccaggcggtggtgcgcgcgcatcgaccgcgccatcgcgccggcggagctcctcctagcggcgttccgccgcgtgtccgcgctcaccaaggaagccgcggaggcgctcccggcggaccctgcgtacgctgatggcgcggtggggttcgtcggccacgtggaccagctgtgcgacgccatcgaggaggcggtggcgcgtggggacgaggccgtgaggagggtggaggaggtcgtgggtttcctcggccaaaccaaggccatcggccgcagttgcgtgcggcggctgaccgatgcggtggcggcggcgctgcgcgcggtgtatgaggcggaggcggaggagatgcgcttcgagggccctctcgacgaggcgctgctcgacctccaggacctcttcgaggcggcgaggaggcggtcggagaggcccgccacgatggggaagaagagagcagctggtcacactcgacacccagctgcgttgctcgaccacgccctgcaggagaccaacgctagcatccacgctgcgctcgactgcgctcgaggttaccttgccggcaagctccctctccggcttgactccgggaagatgatgggagaaggaaggaagaagacggaaaagatgggggatggatggaaaatgtgacggtatggtatggtgctaatttcgtaaaattcaagtggcatggttattaatagatgaattataatggtatttttttaatagctagatttatagtggcatggatcaaattaaccctatttttgattggagggggtaacagattgataatttttgttgggtgtagttccatcgggttccatcgtgggtggggcacgcaagcattaggaaagttttttcaaaaacactatatcgaatttttggacacgtgcataaagtattaaatatagattaaaaaaattaattacacagttaggggagaaatcacgagacgaatttttgagtctaattagtccatgattaaccataagtgctacaataacctatatatgctaatgacagattaattaggctcaaaagattcgtctcgcggttttcagacgagttataaaattagttttttcattcgtgtaaaaaaaaaacatttccaatatccgataaaacctaaaatattttatttcgcgaactaaacagctccttattttccaagcgccatcattcgtgaggctcatacacccgctcagttcacatgcccctgctgcagctcagaatgatggcgctcggaaaatatctgcatatcgtcaaatttaattttctctggtaacctagctcaactgaacagattttctttaaccaatctacccggattttaattagatttgatccggattttaattagatttgatagggatattcgatgtgacagcttaaaattttttattttgggaactaaaattggccaacatatccctgattcgaaaataccgacgatggctatcacctgctacttctgtccgaaataaatttatttttcactcatctcatgcataacaatataaaataaaataaactaaaatatcatactttattaaatcacaatgcaactatttcttactttatctcactgctacgaaaatcaatttttcatagcatcaacctacttttttcttaagcggctatacacaaccaccgccagtgaaaatgtaacgaggggaagggagttacggtccaaggttaagagagccgccagcaaaaatatctagaatttcacaggcagacaacttaacatatcggccgtgaagattaaatttcacaagcggcaggttaagagcactgtctgcctaaaaaaaatccttaaaataccctcctctccctcccggccacacaccctctccttaattactcgctggcggtcgggttaacctagccgcttctgaaaattgatttgcgcaagtggtgaaggttcgcctgtgaagatgttgattttcactagcctttaatagatggtgaggagctgagccgcatgtgaaaacacgttcggactgcctggaaaaactcatttttctagtagtgtctactcctaatataattattctctatctttataaactctggtgcaataattatattactctaaaaataaacttattttaaataaatgaaaggatcttaaaaaaattattataggacatttttcacttatgtcatacatatcaacacaaaataaaaaaaataacattgccatactttatcaaatcctcatacaattatctctttttacctatttctaatatatttatcttgtgattttataaattttgatacaatgattactaaaaggaaaaagtatataataccctctaaactatcacggtcgaccgaattaccctcctatattgaatacacgaagttattctagaatagagggaggagtaactgttaaggcttgtactagctaagctcagtatcataacaagttgttaacgaccaaattcggtaatcgtcatcggagatggagattagactgaagcggaatctaaaatagagatcgtccaggaaacagagtgggaatcggctaagtccgaattggttgtggctttaattggcagagttcgagtcggacaaggttagccgaatccgacaatgtgacacggcatacgttgttgggttgagttaacgtgcttcatgaggattgccacgcatggattgagtcctgagaaggcaattgtatctattaattaggatatttcatgtaatttccttagagatatgtttggacaaaagtctgccgcaaagacttatggtatcttagagtttgttagagataagagtcgtgtgtgacatggacattttttgtaatatcgggtataaatagaccccgagccccatgtaatcaatctaacacacgctcaatataatctcggcgcatcgccaccctttactttcgttttgtttcgacgagttcttgctttcgggttgagctgcatcggattcgatcttcaactagaggtaaaacttcttatggcggcttgcgttctcgggattagtgcttccatctttatgatactctaatctcatttatgtaattcgtcgagttatcatatatcttatataatctctggcaatatcgctatttaaccttcaatcggctaacgtctgttaccagaagacagccgatcaggttaaataccgacgttgacctagattatataggatatctaccactctatgaaagatccaacggcttgattgtctagatattatccttcttttcatacttatagctgcatcagttgagtttgatcttataagtcgtgattagaatctcgatctctagcctgcttttggttgccgattagaggagcatcggggtttcagccgattttacctgatataactacttttatcttgtatgcttgattgacatgttaaatctaccctttatattaagatcttgttgcatttaagtatattagactttcgtttggtatattctacttgctttggtatcttaatatagagtagtatcggagtattagccgatacacgctagatatatatgatcagctatgttataaacatatgtagtcttgttgttaatacatatttcgatctaagtgatttatactgtctcagtatggcgaccgatctatcccaatcacttgatttaagtatatatcgatataaggattatatattgttaatgtctacagccgatcgagtagatttagtcctttcttacttattcatgactgccgatcgatttacatatgacatcggctcaaagataaatgatacgtcatcggcaactagccgatcggctattgtttatggatttaaccgcggtttctttgtctttatttcttgttgattgcaggatcaaatcaactggcatgctcacaaatctaaagacaagatttttggacctgcactgaagttaagcagatctttcaggcctcgtgtttttacatcaacacaagttgctaggctcggcttaatatagtgcgctaaaagtctaggttggttctggctcgcaagttaactcaagcgggttaataaactcattaagagctttggcttattcatatttcctttacgaattttagtgttctgacatatacatttgccgatttatcatttgctaatcataaacattattccttctatctaaaatataaaaatttaaaaccagattcgtaagtaaaagttatatattttaaaacagatgtagcagtaaatacaaatacaatagcttacaagtatttaaaggacgtagtattagaagcataagcataaataaatatatatattggtcttgcatattaccaagcttaccatgtactagtcctgtctcaaaatattacaagttagaacgggatggaatatattttagtacaacaatttaaacaaacttatccaaatttgttatatgtatctaatccgaacgaagggagtagcttgagctatgctggagtaaaatcccaacacgaaactcacttctttacatttagggtgtgtccatttggattggtttggaaatctctccccttcacacgtaaaacaaaatgacaaaataatacataattaattaagtattaacacaatagtttaaaaattaaattgatatgattttttacagcatctttttctaaagaatttttttaaataaacattatgtttagtagttcaggattcgtgcgtgtgggtaatgagagaattgatgttgggaaccttgagttaagaacacatcctaggacaaataaaatagtgatactattctaaactctcaaggtgacatccactcattgttgtatgtcactcaaatgactatgaaaaatttgaaaaagaaattaataatatagattaatatgtgttagatccctctacagacatgcaagttaaatttctcactttaacacgttgcaaaaaaaaattgactctgaatatacgttaactatctttaatttattttttcttattgcaacttataaaagtagaattttaccttacatgtttctaaagcgatatatctcatgttaatacatcttctcaatttttataataattttataactattctaagtgtcatgcaaacaatgaaaagacatccccttgagagtttaaaatccactttcaaatgaaatgccattcaaaattgtctgatcggttgagcaacaaaataagctataaaaaaattaacaaggcagcaaaaataatttttatgtaaataattattaccagcagtttaaaagtactccagaagggatgaaaatacaatcactaaaattaaattaaaaagttttaaattttatttcgacttactccttccgtccttaaaaaagaattgatcgaatgaatctaagtacatgtgccgatccatccctagggtttattattattattttttagagagagagagtataagccagcaaacagacatgaaaaccgaatctctgatgaaatctactccacgtactgcagttttcccacgatagttgcattgggaagacgaggaaagccaagcaatggcgtcggcgaggcatctccggaacctgtccatgcgctccggcggcagagctatgccaacctcgatgccgccggcgccggaacgatcctccgccaccgacaccgcgccggtcttcgccacggacacgatctccaccttcgccggcctcccgaacccgaagtcgacgtcgtacacgcggaacctcgtcgacccggccacagagaacggcgcgtcgtccctgcacgcctccacgacgcgctccgtccacccctcccagtacgcgagctcgccgcgcaccgcctcgtcgatggcggcggcgaccgtggcgcaggccgtgaagacgccgcccgcggcgtcggcgacggcgagctcctcctcgggcgccgaggcgaagcccgggccgacgcagttgccgaggtagttgtcggggacgcggggcaccagccgcgaccggtggtcgacggcgaagatgaaatgggcggcggcggcggcacggccgccgtcgtcccgtctggcccggcggtagcagtgccacatgaggccgtacatggccacgtgggacgtgcaccgaggcggcggcacgccgcgacgtgcggcctcgctggcgacggcgtccttgacgccctgcaggagctctttggacagggtgaaagtggcgaggacgtcgaggagcttgccggcgtcgggcgctttgaacagatctttggcttcgttcgtggatgaggtgatctcgtcgtgcatgttcggtaggtcacggatgagcgtgcggtcgatcacaggcggctctgggagcatccggtcgccggcgcaggcagcggcccaggtgtggaggaagtgcgtcgagcccaccccgtcgcaggcggagtggtggacgatgatgccgacagcgagaccacggcggttgggcggcagcacggtcacctgcagcgcgagcaccgcgccgccctcgggaagctccgggacgaacgacgcgatcttggcgagctccctcggctcgtccgtggcgagctcgtcgacgccgactccgacgccgtcgtgctcggcgacagtgaacgccacgccgtcgccgggctggtagaggagctcgtaccggttggtctcgccgggcgttgggcggacgcggccggcgagcgggtagaaggcgtggatcgcccggggtagcgactcctccatccgggacagcacagcgtcgacatcgtcgtcgtcgcaggggccgaggcggtagaagaagacgcgctcgacgggctgggcgtggagccaccccgcgtccatgaagatgagaggcagggctcgctcgggcagcgagggctcgccggcgggcggcgctggcgcgacgcgcgttgtgcggaggacgcggaggccagcggcgtgagcggccggttgcgacgccatggtctcgccgcagaacaggtcagggttgtgtgctcgtggctagctgcagagcgatcgagctttgcttctactcctataatacttgcatctccgcgagtgacttcacttcactggtccatactcgaattatgcccctaagttattaggtgagtacgaattaccccttaaactcaaaaataagataactttcaccctcaactattaatattggatgaaaacccccctcaaatagctttgagagcggttttggtcctacgtggtagttcagtcaacaattcttttatcaaataatcgatggggcccacccgtcagatctctcacctctctctctttcccctctcacacctctctctcgcgcgcacggatgccaacgacgaggatgaggcacgtgccggcagcactgcaccatcctgacggcgctcacttgccgccccaagttgccttagccacgccgccaccgcgccgccatccgccctccccgagtagccttcgctacctcccgccaccatcctgcccaccccgagctgcctccatacccccctccccgccgtacccccgccctcgcttgccgccatttgctgctgccctcagcgcccaagcggccttcgctaccgcccgccaccccgagctgcctctgccccctctgtcgtcccgctgccctcgcccaacaccatccaccgctatcctcgatgccctaagcggcctccgccatcgccatcgcgccgccccgaactgcgtccacccccgccgctgtcccactgtcctcgccagttgccgtcctgccgtccaccctcgttgttgtcacatcgctccgcccctaactcgccgccgtccggcactccccatttagtgatagagagagatggaggtgaggggagggagaagagagatgatttgggaaagagagatatagagaggagggggaaaagatagagggtgagagctgacaggtgggctcgttgataaaaaaactgatgactggactgccttgtagaaccaaaaccactctggtttgtcttagggaggtaattcgtctagtattaatagctcagggtgaaatatttctggttttcggtatatggagataatttatactcactcaatagttcaacggtataatccgtcccaaaaaacgaatctagaacgaaatgacgaatctagaacgaaatgtggcacattatagtataataaaactagacaaatgtatattcagattcgtagtactaggatgtgtcacatccagtactaagttggttttttataggacggagggagtagatatctagaaaaatcactaactgttcaacttaaattgataaagatattacaaggggcagaaaattataaaataaagcatactccccttgtatattgattcgccctagctacttgcagccacttaactatcacgtcgaaaaatatatctcttatcatgtatataaataatttttttcattgtggctataattgtttgtaataatagattgttgtagattagtacttatctatatctctctgagatatatagtttgaatccactgtcacttaaaactcaaaatacaaaaattggtcacatctctcacactagtcccaagtcccaactacctcttgtctttcccaagtcccaactacctcttgtctttatgatggctccaagcagtcaatgcctacatctcacacactactataaaaaaatacatttttcatgacactccattttattctcaacgatggacttaacaaaggccgtgtttagttcacccccaatttctaactttccatcacatcacatcacatctaaaattttcctacacatataaactctcaactttttttccaaactaccaactttccccaaactttcaacttttttcaagaactaaacacagacaaaagcatactgggagtatgtggtcacaactgtatgagaattaatttttacagattgtcggtttaggaggccacagccagaaaaataattctattttacgagtggacctcctaagggcaagttttatagtagaggtgaccatcacatccaattttatacatgatatacataattaaattaagaggtgacatgtataataggttgcctctaccacacaatccccaatatctctaacactctcacatgtttattaaagtttgtgtaggggttgccccttgcatgagatgtgactatttctctctcatctttcttctctcctccacctcactatatagtcctatgtggcatcttgaggtttgtgcttggatgcccatagtacttgccctaacctaaccaaccacctggaaaagaggaggccactttgaaaaaaaaattaatgaacctatctcctagttaccactcaccagcccccacttctcgatgtgtcctcccacaccggggacgtggtggatccggcattccggctccagctcaacatcgacatgagggcagcgatgacagtgaaacagagaaggtggagcacgtggaaaatatagtcatattttaatcctaaaaattaagacaataaacatgacatgtgtagcaggaattgatctagaaaaagtgctaaacatgaacatgctaatgactagaaaagcatcatagagaaacacatgtttaacacacaatagttaaaaatgtaacatacccggataacgcttcggtactggataatgcattgatggtgttgttgcctccgttgatgttgacgttctcgccttctccagtgacgttgcctccaggagcgccattgccgccacctctaggagcgtcgttactaccaatgcctctaccattacctcctccagtagacatagcgatgtagaggaagtagacgaagaagacgacgccgtgcagaaccgatgcagcagagcagttgcgctaggaagcgctccccaaaaacttaaacgcccgcatacccatgtaggtactcaagcgagctgagttcgggagacctgtttatcctaaacacttgttcatgcaagtgctttgaaccggggaagcagaggtgcagcgcaggaacagaagaagaaaagatgtagacaccgaggaggagccggtgcgcgaagagaggtggaatcaatccgggattgattcgttcatccggtgatgggtttgcatagtgtgtctctgttattggagtaataacggaatcaatcaatccgggaatgatttgattccccagccggctcggtgcgcatgtggtagtcccactaccacctctaccggttaacaagtgctctccaatagcaacctagttaagttgaaaccttccacataaatttttaaggtgacattaatctcttaacattaattgtgggcctataaaattcattaggaataaattaggcctaatccattttctctaacataggatacagcagtgacggggccggtgagcgttggatctggtggaggcaagcgttgagggtgccggatccaacagctgtagggttactgctcggcaaggtcgaccttgagtccatgatgacaccatcgggtggatacaggccgttgtgcctggtcgtctcctgcgcttgggcgatggtagctcgggagagctgtggcggctgtgctcgggggagtgacggaggcagttgcaatgagggagatgatgaccacgacgatcacgatctggatgctgtcggaggccgccgtgttttgatggttctcatgagctgttgtcccatctgcatgaatttatattttgatttggatgatattgagcttgtgtttagaggtgttaaagaggaaatacttacaagaaggaggtgtgttccaggtgaaaaatggtgttggctcccaattttggagaggtttgcttaatattagaaaatgggtgattttgggtgctgaatggaaagttggtgagggctcacatatctatttttggaaagatacttgggtggacaattgctctctaaaaattagatttccatccttatttgctatctgtaaccaacaagaggtggctgtctaatagattgctagtgagggcactgattgtctctctttcagaagatcttttggtccagctgaaataactgaatgggaggaactcaagaaagtaattgataatctggagacttcccctgttcctgacactttactttggggcctagctactaacaagaaatataccaccaaatctatgtacaggaccctgacctttaggggtataagagaggtgaatactgagatgtggaaaagcccctttcccatgaagattaaacactttctctggctagccattagagatagaattcagtctgcggaacaacttaaaaaaaaaagaggctggaatgattcagagttctgtcagctttgtggacatttggaaactaccaatcacatcttgtttaattgcgttatggctagacttatctggtgtatttgcagagatggcttaggctggaacgttattcctaggagtttggacgagttctttttgctttgtgacagtgataattcccctacttcgattagattgcatcttagcctacttgctgctgtgtgctggaatttgtggctaaccaaaaataatatggtgtttagagataaattgttgtatttccccctgtctctaacttttcaaattgttgcaaatttgctgcagtggaagaagctctttcgtcctgaaggctggagtacaggatcaagatggtgtcgactagtctaagatctccaagaatgggtgtgggttaaaattctatcgttctgttgcttagtcgttagagtttttgtttcccaggtagatgtttccctggctcatgtcgttgtcagcttagagtttcggctggaatctagatcgttcgctacttgttcgccagtctggttgctgttcctggtctgtattttcttgaactcctctttgtcgctggcaaccccagctgaacacttcgatgtggctttcagtaaaaagccgagtctctgaccttttctctaaaaaaaatttggatgatattgatgccgatctagaacgtttcttgcacgaacgattcaagaatttgaatattgttttgtttttctccggaaatcctccgtacaggtggttaaggttttcatctattacaatcgattttcccaagcggaccatattcgcttacaaatcatggactgtcataggcgttcagtcgcaggcggtcatcatgattgccagcaaaaattgattttggttacctctaaagtcaaattttttagcagtgccatacaccctgagaagagaacacgtctttttaccctggacaatactctcttaggacggagggagtattattccactgcatattaaagcttatgcaagaataacatatcattcataatcccttctttctatcaatctaatatcaactaaacatctaaaattcaacatacaagcatagtatttattagcactcctaaaacttacatgcaagcatgacacatcaacccattagacacacgaagctcaatatgtaaggatatagtaattatatctaaaatttatttcattctaaatctagcatacatatgctacatcatcgttctcaaatcattttcataatgtttcaatccaaatcattttattatttctccaatatataacatatatcctgcaacaaaacacgggagatcatctacgttattataatctagagtttagcatgcatacgagcatttttaatcatcctccacacgttattttcttaatatttcaacatatatcttcccatcatttttactagtataatatgcaacatatattttccattcattccgaagcaacgtctaggacatcaattagttatgtaattaatggttcgttcactgttgatatattgcagttttatacggtcaataattagcatttttccctaagtactgttttaacgtcacatataagcatttctccgcacattggtaaaatcgcacattattgtttcagtctagatgaacaccataccaaaacatgtgctgtatatagtgtatacgtagcaggctgataatttttgcgatctcgttctttcccaaggaccttcaaaacatgggttaatttgattcataccataataaatgggttaatttgattcataccataataaatgtgtttatacagataaatgtcattacaatttgctatatgtagccgtgccacttaaattttataaaattgaaaccatactatcgctgtcacgtcacgtttttcatcttctttcccatttgcacgtgaggtccagccatcaaattcatcatcttctttcatcctcccctcttctctttttgcccatctctgagagccttggcgcgacaccatgctcgtgggcaacctggagtccagcctctcgagatggcttgtcgaggagccctctgctcccacgcgtgagcacggttgggcggtggctgccattagctgcgcactccggcacggggagagatggattggtggagagaaggttgagaagtggtggacagataggaagagaagaggggaggacggaggaagaatataaaactgatgagtgaacccaatgcttagatggaggagaagatagaaaacgtgacggcaatggtatgattttaattttgtaaaatttgagtggcacggctataaatagataaattgtagtgatatttatctgagtagacaaatttgcaatggcacggagcaaattaacccttaaaacataggattgtcatttgtcaaaacgtaagactagaaaaacataagaatataatatcatgttcattgaattcctcaatttgaaaacatagaaaaactgtcgtttgatagtcacacataaaaacgtaggaattcaacatacgggaaaaataaaacattaggtaaaacctcatgcttattttcctttaaaattcgtctacaataatctattccatatgaatttaaaaggaattgatatgaatcaatccattgaaaccccttcaaggggtttcgtaggattatttcctgtagggtattaatcctttgaaatttctatgtttttcctttgtttcaaggcaaaatttgctacagtacaatcaaagaatgtgtaattggctaggagacacagcaaaaatgtgacacgactgatggacactccaaaaattatgtaattggctataagacacagaagacaatattttataattacgggccaaaagaggtgatatttttttcaaatggcgagattgcccctggtgccatcttcccctacccgagaactgcaatgccgtgaggatgagcttggccttggcggcggggcctgatctgttctcctccgcctggatcacgtagttgtggaagttgttacccagcacgcaaacatggcggagcagcaagggtggctcccagttgacggcaaagaaggcatcgtagagcgacgcctcgtagtgtggcatgtagaagagggtgggctcgtcggcgcggtggcagcaaccgtcattgacacctggcacggcacagagaagcccagcgctgccgcagaggcgcactcgaccgcagagaggatggggtcgaagaggtcggtgtgggcggatgattccggcaggaggaggaggagattgcagtggaggagcgcaagctggaggcggcatgagggagagttctcgaagctgccgacgccaagaagtgatagcctccgtcttcacccaccatgatggatcgatgcgtcgcccatcaagcaggaggcggccacatgcagggccagcggtggccacggcgacaacgtggagcacgagcaggaagcagccgcgtgcagaccggtggaggccacggcggtggcttggagcgcgagcaggaggtggccttgtgtgaggcggcggcagcgttccatggcaggggcaatctcaccatttgcaaaaaattatcacctcttttgacccggaaattataaaatattgtctccggtgtcttttttggagtgtccatcagccgtgtaacgtttttacggtgtctcctagccaattacatattttttcagtatcctgtagcaagttttgcctaggtttaatccggatacctcagatgcatgacctcataccgtaaatgtttgccttttctgcagcttcacaatcgtatcagataaaccatttgtccaaaaataacggaaacttcagttaaccaaaggaatctttacacaaaatgttcaaggatttgtactcaatcaaccctaattatattgtctctgactctaaatatgttgtctctgccaaatagtcaaattcaccatatcactatcttgtttcttgtgattgattctttatcctcaccagtggcaatgcaagggcattttgctagtaaaataaaaatcaaggaaaaaataccgaacaaaatctgttcggtttattcagaatacgtttttactgaagaaactaatgctctcgatctcccgttctctcagtgcccatcatgtgaagcgaggcatgggcccatgccatgcatacatgactacagcccaggaatgctgtgggcttcacagcccatgtgttaaaagaacaaagcacgacggccacaaaaaatcatagtaggaaatgtccaattaggtcataggttttatattttgtgacggaggagtagttgattgcatgatctgggggtgatttgatcagtttgttacatgctgaatttttttcattatattttttaaaacaattaatcattcaccaacctgtatataaaaaaggccataagctgatacgcaggatttaagtagtgaacacgttagaggcgcgctaattttttagttgtgttgcttgatgtgttgtctctagtctggttggctctcctgaatatattactttcaaccatctaacacaagacaagtttcgtctgcgcaagcatatatgagccctggaggataataagaaaaagcggaggtcctgtcacaattgaactaaagctccttagtataaattatgggaaataatagaaatcattctaaaaatcacttgagtttgatattcgatttcataagttattttactgtaaatatttaacacccagcgtaaatgcttaaccgaatcaccccgttatcgctgatatagagccaccgtaggttaagctagccgcttcaaaaaaaatttctgatgtttgcattagatttattttttatgtgtcactgaaatctttttctgcatatagagaaacaacgtttaaactctcatcaataattctatttatcaaatctcacaaaaagtgttaaagtctatactcctaaaggtaaattttgataagaaccatattgatggcttgcaatttataaagacatattgatttggataaacacatgtgcactggggtggtttttcaaaacaaaaccgagtagagatgatgatttgcaacaaaataatttgtggggtgaaatgtcaaatttgaagtgacttttatgatagtttttgttatcgcccacgcgcgcacatgacgtcgctagccatccagaatccagagacctcgatcagccgacacgcgcgccgcgcccgacgtactgcaatggcgtcgccaccagctcacggcggcagcttccgcgtcgtgcgcaccgctcgcgtcgcgccgtcgtcgcctgcggccggtgccggctgcaacccgcagccggaggccactctgccgctcacactagtacagatccttccatctgtaacggcccataacaagaatggaatttgcgggccgtcacaaggaagtaatctcaatcaggccgaagtttcgcctgattgagatatggtcgcacagctatggtatatcggcataaaactaaagcccgtcacggatgacacttatctgtgacgggctatagttgaggcccgattgagatgagggttccatatcttaatcgggccctaaaagaagcccgtcacagatgacccgatgacactcttttttgacggccttttattaaggcccgatagagagtacttgtatgcccgtcacggttgattgttttagagccgttacagatatttgttgcatagtataaatacccccaaccacctagtgtaactgtatcccactgttcactattttggtgggaggctatagggggcgattttttgtcctttttccaaggaaaacagaaattaaattcccaaaagtgatcaaaatggatcaatcaagtgagtaatataaatcattaattgagcaatttcatcacgtcttacttttacttttgcaatactgatcttataatatgtgtctctaatttgtttttttttagcaatcgatcgaagttggatgtatgccaaaaatttgaaacgtcattctacatagtaccgaaagggcgtaataaattttatgaacgccgcggaggagaatcggataagaagaaacagtgattacatgtgttgtccatgtgcagattgcaagaacgagaatatgtttgatagcggagaggacatacacggtcatctgatacaacgaggattcatggagggctatacatgttgggtgaagcatggagagcaataatcaggaagtggagcagcagcagacagaagtggtgtgcataatcaggaagatgaaaatgagcatgacatgtttataccttctccattgggcggtgaaatggttgatgtggatcacgatctgctgcaagacatgttacatgacgttgaggacctagcctagaatgagagagatggaatgaaattcagcaggttggtaagtgattccgagacgcctttgtacgctggatgcaaagcaaaacacactaagttgtcaattaccttggacctaatgaagctgaaggcaagtagtggatggacagacaagagtttcacagatcttttaggaattttgaaggctatgcttcctgttgagaatacattgcccgagacgacatacgaagcaaagcaggttctgtgtccactggggttagaggtccgtagaattcacgcttgtcccaacgactgcatattgtaccacaagcaatatgcggacttggatgctttcctgtctgcaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcacgccacggaaagaaggaatgatggtatgcttagacacccagcggattcgattgaatgaaggaatatagatcgaaaacacaaagactttgctgccgaccctagaaacatgaggatatgtctttgtacggatggcatgaatcctttcggtgacatgagtagtactcacagcacttggctagttcttattgcgaactataacctcccgccatggttatgctttaaacggaaatatattatgttatgcttgttaatccaaggtccaaggcaacccggcaatgatatcgatgtattcctggagcctattatcgacgatctggagattctttggaaagaaggtgtggaaacttgggatacatatggtcaggagaacttcaagctaagagttctattgttctgcaccattaatgactacctaccattcggtaatatttccggacaaactataaaaggaaagaaggcatgctccgattgcaaggaacatacacaaagccggtggctgaagaaatcacgaaagatggtatacatgggtcaccggaggtggctcccgctacgtcacacatttagaagaaagaagaaaatttttaatggtaagagagaacttcagcctgctcccaaagatttgtccggagatgaggtccacaatatggtcaaggacataagcaatgagtttgggaagaaaagtaaacgtaacaagacaaaggagaagggtatgtggaagaaaaaatccatattttggcggctaccttactggaaagatcttgatgtccatcattgcattgatctcatgcatgtagaaaagaatgtgtgtgagagtttggttggcctgatgttgaatattctcgggaagacaaaggacgggttgaacgcgcgccttgatctacagtcatgtaatatttacaaatgctgtttacatttgtcatattgtcaaaatcaatttcaagctgttggaaacaaagttatatagacaaatgaccaaaataaaagttgtagatcttgatgagaggatcaattttgttgttgaccatatttcgatttgaaatcatttactatccaaaaatgtgttatgactaataaaataaattattatacagcagctatatattttgtactcacaaatataaagacttatctgggaaatggaaaaatagtcatcggtgacgggccttagttcaagcccgatagagattaatcgatctctatcgggcattatcttagggcccgtcaccgatgactcatccgtgattggcctgaatggtatctcaatcgggcattagtatggagcccgtcaccgatgagtcatctctgacgggctctacggcaaagcccgattgagatgactcatcactctaatataactagggtttctcagatcggatcgaaaatttttctaagtcccgctacagtttcccacctccttagaaccctagcgttgctgtcatcctccctcaccaagcccgccgccgtcgccaccgagcccgccgccgccgcaatcgtcctccctcgccaagcctgccgccgtcaccactgagcctcctcggccctccattcggacctccgccaccgagcctcctcaccgacgacccccccccccccccgagcccgccgccgccgccaccgagcctttacaccgaccggaccggtgttggccttcctcgtcgtcgccgcccgcgtcctcaccgacccacgtcgccgaccctcaccgagcacgacgccgcctgcctggtgccgacctacccgatcggcgtctccaccgaccagcgccgccctccaccgagcccgggcgccgccgccaccgagccccatcggccatcctcaggtgagtcctccatcgcgccgccctctgctaactgtgaatgacatgtcattgaaatgtggatgtggatcatatgtgattgaactgtgagtgagacatgtcgatgttgggatgaaatgtggtgcatttattcatgttgtgatagatgattgtagtgattgatgaaatgtggttcatttaactttatttatatgcaatatggttcatgttgggatgaaatgtggtttatttatgttgggatgaaatgtggtttattcatgttgggatgaaatgtggtttattcatgttgggatgaaatgtggtttatttatgttgggatgaaatgtggtgcattaatgaaattattgtgaaatgtggtaaatagattgtaatagattgtagcactcaattgtgtttttttggaaaaaaagtagacaatgtctcagcaaggcgaaccaatgtcgacaacaactagtgggtcctcaagggcacgtactcctaggacagggaataaaattcctaaggaacggttccgcataacagtggtggacgccgtagggttgccgacatctccaaggaaaatattgagccgatttaggtctatctgcgaggtcatagggaggcagaaattcagtattctgcaagacgacttcaagctcgtgtcggccgcagagaaggacattgcttggctaacgttcaaggagagctttgattatcctgcggagcatgaggaccgtatcaggcgggctgctttcaaggttatgggcactgctcggaagaacttcaagactaagctagtcggcgagttcgtttacaacccggcaaatccagatccaagagagaaatttccttggatcacggaacaggtatgggaggaattctatgcgaagaagtcgacccccgagtccagagctagaagcgaggcatatcgcttgctccagaccaggaaccagcatccgcaccggcttagtaccgtcggatatgccggtaaggaagaggaatggcagcgtgaggatgaagaagcggaggaatcgtgcacaccgctcgtgtttggcgatatcccacaccctcgggctaggaactgggccaaggctaggtaccagaaacatgatgatggcacaatcttcatgcaaaatgcagaagatcaacgagtatatgaagctatagtaagtgtctaatcaaactagatgttcacattgtttcccatcatgcagtttatttgaccccactaagttgtaatgcagaaggagttggttgccgagcaacaagcctcgcaagaggcctgctctcaaagacgcgaggacgacctcctcacgaaagcgttgggcaacaaggaacaccgtggacggacacggggcgttgggtcttctgttccctggaagtatggatttccagactacgcgtggcagtacaagaagcggacttccaacaaggcggagaaagatgcacgccttgaagccaagatccgggagtcgatacgagctgagctgacatctgaattcgacgaaaagctcgagtcgatgagggccaagattaggcaagagatccgagaagagcaacagatcccccaggccgccgctgctgctgcgcacaaagagttaggaagtcccaccgaaaaatgcagcagttgcgcatcaactgagttggcggaaaatccaacatcgatcgacagcgccgtcgaccacataacggtaaccgtgaacttactcaatacatgaaagacgtaacgaatccatatgatatatagtattctaaaaaaattgattaatctatcgcaggaaccaacgagctgcaccctcacagttagggtgatgccgaccttcactgttctagcagccgagggacttgcgtacaagccgaccccagagacaacagtgcatggagcgcaactcagggccgactgtgcaaaagttcaagttgactcggtgaagcccgaatacgagctgttccctctgaagtatccaccgaacgacgaggtcctctcactaggaaatgctcgtggtaccttcatccaatggcccaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacgcggattttggggaggaccgaatggaggccgacagcaaggcgattcataaacccccaccgatgaagaagagcaggaaggcacactcttcccctcagagaattactctcgataaacccgaagcaaaggggagaggaaggggaggaaaggtgcaggcctcgcttctagctccaagaaagctagatctgggcaagggccaggaagagactaagggcaaagaggtcaagaagaaatacgtcgctccacaggagttccaactaggcatgccattggttggagatgacgtgcttgctgcaatgggcaccacttgtaaggaccttcacttatactacatggagaaatctaacgccaggaagccaagtaaagctaccgatattcttggacagcacgatggaaagtcattccttggtccaacaaattatatcgtggtcgacttcaaggatcttttcgacctctacaggctccgagcggtggacacaagcctccttaagtgttactccttgtaagtattgtcgcccaactcattctggtaataacaatcgatttaacttgcttacaagatcattgatcctgtgtgtaggttaagttggcaatggtgtcagaagcatgcaccggaagttgccttccttgatccacaagtggtcactgtcacaaatctccagaatgaccgtcaaggaatggtcaactacatctacgacacattgtggtcccgccgagacaagaagtacattatgtgtgcctataatcaatagtaagtgtgttaactaaatatacacaacagcatgacacattccttgagtacttaattaactttcactatattaatgccgcagtgcctattggatccttctggtcataacacataaatggagtacatgtcattacctgaactctagaattgataagaacgcatatgattggaccccaattcaactagcgatagatgaagcgtgggcccaatacgtgcaaagaggaggcctcaggaagacaggacatgacaccctcatccacaaaaaagacttcccggtgaagcaacaaataggtgaccagtgcggattccatgtgtgccacaacatgtgacttctgtatagagaaaaggtgaagactttggctgagtttgaggtcggtggtctcaattgtgatagactaactacattttagtacttatatatgatcgatggcataatctggaattatgacaatgtagggcacaataaccaagtctctgactaccagctttgaggaggttcgcgaggagatagccagcttcatcctccacgaaataattaaccccaaaggaatgtttaggcttaaactaaaatgatgaacaatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgatatggctgtgaatgtgtggttgtgtgaaatatattgatgtctgtgtatgttaatgcatatgtatgaatgggtgatgctggggagctggggatattggatatctgtgtttgtttctgtcatttttgcagcgggcatggctagcaaaggcctgaggctagccaaaaaacaaaatttttttttgtggattataatcatctgtgacgggccataactaaatgcccgactgagatgaggtcatctgtgacgggctctagcttaggcccgattgaggtcactagtcatctgtgacgggctctagtttaggcccgattgaggtcagcagtcatctgtgacgggctctagtttaggcccgattgaggtcatcagtcatctatgacgggctatagtttaggcccgattgagatgagtatcatctgtgacaggctctagtttaggcccgataaaggttagtagtcatctgtgacgggcgctagttgtgacccgatagagataggtcatctgtgacaggctatagtttgactggttgtctgggtcaaagctatcggtgacgggctttacttagggcccaattgagatatattcattcgtgacggccgtttgcccgattgagataactcttcacatcagtgacttctagcctgtgacggacgctgtgcccgattgagatggggcttaccgcccgattgagatgagggtatccgttctagtgtcaccttcctcgacgcgatgtggctcatcgccccacccgtcgagcgggtcttcttctaccgcctcggcgacggcggaggcggtgccacatgtgacgtcgacgttgcgctgtccaggttggtcgactccctagcccgcgcgctccacgtcttctacccgctcaccgtccgcctccgccgcacgcccggcaaggccaaccggtacgagctcttctaccagccaggcgacgccatcgccttcaccgtcgccgagcacacggcgtcggtgtcgatgagctggccacggatgacccgagggaggttgccaggattgagccgctcgtgccggagctcccggatggcggcgcggtgctggccgtgcaggccaccgtgctgttgcggccggcggcgccgcgcggcctcgccctcggcgtcaccgtgcaccacgccgcctgcgacggctcgagctccacgaacttcctccacacctgggccgccatctgctcaggcgccgccgccgcccgtcatcgaccgcacgtccatccctgaacgtgaagatatccaccatgtaaagacgaggacgaccaactcgcccgaccccgacgtcgtcgacagcaagctcctcaccacattcacgctgtcaagggaaaacctgcagagcatcagggacagggtcagcgccgcggcgtgctgcctccgcggtgcacgtccatcgtcgcgacgttcgccgtcatatggcggtgccatgtccgggccgcactaggcgcgggcggcgacgtcgaagcagagcctcggaaccatggccgccgtgcccacctcgtcttcgccaccgatctccggtcacggatggaaccccacatcccggacaagtacctcgggaactgcatcggcacgtgcttcgcgtcggcgcccagaatggacatcgccgcaaccggcgcggatggcctattcgcggcctgcgctgcgatcgccgccgccgtcgacgaaggaatgcgatatgatcaaggctactgggacaggtgcagggagcacagggcagaggtgacgacctggccgttgtcggtggccgggtcaccgaggttccgcgtgtacgacgtcgactttgggttcgggagtccggcgaaggtggagatcgtgtccgtggcgaagaccggcgcgatgtcggtggcggagggccgtggcggctgctccggcggcattgagattgaggtaggcatcgctttgtcgccggagcggatggagaggttccggaggtgcttccgcgatgaagtcgcgtggctgtcgtcgtgatccagtcatagctaggtggctgtcaatagctggtcagcgctataccagttatatactacttcgtactagtgtaatttaaatttgaatctgtaagactgtaaaattcagttttcaattgtatcaacttcattgtttgtggtggatatatttgacatggattagtatcctattgtgaccatttatgaagtgtttgttaaatactccctccgtccctaaatatgaaacgccgttgactttttaaacatgtttgaccgttcgtcttatttaaaaaatttatgtaattattaatttttttcctatcatttgattcattgttaaatacataaaagtatacatatagttttttaataagacgaacggtcaaacatgttttaaaaagtcaatggcgttaaatatttaggggcggagggagtatatgggactatttatttgacatttgatagaaaacactctcctaaatatggcaaattctagactgttgggttagcattacttccaaccctaacaccttactcttctcctccctccccgccatcatcgcacagcacacgagagggcaagagtcaggtgatcagaaatctgccccaccttcttcaccaccgctcggtctcaccagttggccgggcggcattaacgacgccgacgaggccccttggctggcctcctccatcacctcccccttccccaagctgacggtggcgaggtcctcccaccccgcctgcttccctgtcttcggtgcctccctaccgtcggatccgccaccgctagcccctgtcttctaaccagaaccttcgctttgcccttaccggcccaccactctcctccatccccgtggcttccatgccaccgctgacacctcgttgctcacctgtgtccaccacataccaccgggccgccatttcccacagtcctctgtcaatgcatcacgatttatgcacctaatgtggaaaagcaataatttctctcatacggtgggttccattgtatgaatacgatttaactttacataaatagagcccactctctctcttatccctccttcccggatccctatcacctcactctctctttctctccttccgtctttccccaaatcatatcccgcggacctcactcttgcagggggcgaggcatggtggccggaatttaggtggagctcggcgtgccttactacggcggtggcgaggtgtcacggtgcggatctgaagccagtgatacaaatccaatgccggcagtcgtgcggtcggtgcggagcttgccttgtgttgttatgtttttattggaaatattgttattttttgtgcacaaaagcacaaataaataaatttagaaatgttatgacatgtgtttttttatgaaaagtactttttttctcaaaaccgaacattatgtttataattgtgtaaaatataatgtttatgcaattgtgcaatatcatttttctcggaaattttgtagatataaatttctgtagaaactataaaatattaaatgtacaaatggaatattgtgtacggtgcatgtgtgtaaagagcggttaactcatcaaattttgaattggaactttgatggggaatgtgcaatgtctgaggtctagatgtctggtaatatggggtgtttgaccacactttaccacgccacaatcttaggtgccataatttattaggtatttcctccgtggtataatgtaagactttctagcattgtctacttttgtatagatgttaatgaaattagatatacatatgcctagattcattaacatctataatgttagaaagtcttacattataaaacgtatgtgtttagttcactacactttttttaatagcatatgccccgcatgtcgtacacttttttattttttttataactatttagatgacatgcaaataaccagagaatcttcactcgactactcgagagagtttagaatctacacccttattttctctcacctttgtttttattctttttctacactcatgcagttcacattgttttttccatcgctcgttttgtggctttaattagcacacaagtccaaagctacccataactatagatggccaagtgggccgctcggccaggcacgacccggcacggcccgccaaacggccatgcccgcccacggcctccacctatggcccaagcacagcctagttagagtctgaccgtgctgggccggcccgaaggcacatctatcgtgcttatctttgaaataagtctattttgtatctctcctttttgggtcctgtcttacctatggctggaataagtctattagcctccctgccctttgggttgtgtcttatactccccccgtttcaaaatgtttgacaccgttgactttttagtacgtgtttgaccattcgtcttattcaaaaaatttaagtaattatttatttttttcatatcatttgattcattattaaatatactttcatgtacatatatagttttacatatttcacaatttttttttgaataagatgaacggtccaacatatgctaaaaagtcaacggtgtcaaacattttgaaacagagggagtatatgcctagaataagtctatcatgcctccatcctctttgggtcgtgtcatatatatatatatatatatggtgaataagtctataacatctctggtgtttcgtgccgtaacgggccagcccaccgtccccaggcacaactatcgggccaggccggcatagaccattcagcactctagccgtgccatgcctgggccgggccaaaaggtcatgccgtgggctgggccatcgatcggcccccgaaccttttggcccatctatacccgtgactgtttggccgtcgggccctgcctaattccgaattcttaatcctaatctcagcttccggcttcgcaggcgagggcgagttgatcgacgagctccgtcggctatgcatgttaggcggcgagggagttgggctagacgaaaacatcatcaggaggagaagacggaggaggctgctggggtcgagcaccgctgactgacactgctataaggtggagattttcatctgcaccgccgcgatggaggacatatagcagcgatgttagcgccgatggtcgcgaggtcgtcgacaagctagctagtggtgtcagtggtcgccgtcgccggaggcggctgtcggcgacgtgtcccaccgtcaccacggagttgtccacttcaacgacaacgacgcacgccgagaatgccgcggcgaagtctccgtgatcgggacaggatcggccactcgggactcgggagtcgatcgggagccatcagcgagaggagcaagctggtcgacgtgcggccagtgctgccgcggcttctccggtgccggcctcttcccctggtcgacgccgagctttccttggtgctgctgcaaatcgatcgcgcgcaggaccgcaggttatgaacctgctgttctttttcttcttgttcttgccatagccgctaatcttaccttccgctcctactgcagctgcagccactggttgacttccgatcttgcagaagggggaataagctagacgagaattatttcatgattgcttaaaaatagcttcttgattttcattttattttatagctgaagaaatcttcatatcccacacgggcagggcatgcatgcatgtggtcatgcgggtccagcgtgcaagctgccagccaaccaatcagcgagcatgcatgcgagtaccaagtgcggccggccactttatccaggcggagtggatgacgcaactctgccctctgtcctctgttcggtgttcgctgactccgatcctctctctcgctctttgcttgtcggctttatgtaccctcactactgtgtatccatttctatagttcgtgcctgctctttgatactgcgaatgtgaaagattaaactagctgtagtttaatttgtttttttcattacaaatttatctgcgacgatgagaaaaatccatatatgttttaaatagggatggatattgggatacggatacgtcgatacaatactacggtattctcttaaaaaaaaaaagagcaaagcgtccggggtgcatgtgcatatagcgtgccttcagcacttatcaatcgtccaagccatccgacggctcacatagggcacgcacgtgatagctgacggaagcagcccatcgaagcccacgaaagccaagcgacacgtgcctgcctgcctgcctgccgcgcgccacgtgtcacgtgtcactggacgatggcgacgatagccacgtgacggcatcagtgaagcacctccggaacctctccatccgctccggcggcaaaccgacgcccacctcaatgccgccgccgcggccctccgccaccgagatcgccccggtcttcgccacggacacgacgtccaccttcgtcggcctcccgaacccaaagtccacgtcgtacacgcggaacctcggcgacccggccaccgctagcggcgggccgtcgctcgtgctcatccctctgacgtgctccctgcacctctcccagtagccgggatcgtatctcgttccttcgtcgatggcggcggcgatcgcggcgcaggtcgtgaagaggccgtcctccgcgtcggcggcggcgatctctttcttgggcgccgaggcgaagcatggcccgacgcagttgccgaggtacttgtcggggacgcggggttccatccgcgcccggtgatcggtggggaagacgaagtgggcacggccatggtttcgagggttgttctctgcttcgacgtcgcttgctagtgcggcgtggatgtggcactgccatatgacggcgaacgtcgcgacgatggacgtgcaccgagggggcggcgactatatccttgatgttctgaaggatctctcctgacagcgtgaaagtggcgaggagcttgttgtcggcgacgtcgggcgagctgaacttgtcagactcctccttcgttcgattgaccatgatgtcgtagaggtcctcacgttcgcggatgaacgtgcggtcgatgacgggcggcttcggcagcaccacagcgccggcgcaggcggcggcccaggtatggaggaagtgcgtggagctcgagccgtcgcaggcggcgtggtgcacggtgacgccgagggcgaggccgcggcgcgcggggggcagcacggtagcctgcacggccagcaccgcgccgccatccgggagctccggcgcgagcggggcgatcttggcgacctccctcgggtcgtccgcggccagctcgtcgacaccgacgccgtcgtcgtgctcggcgacggtgaaggcgacggcgtcgcctggctggtagaagagctcgtaccggttggtcttgccgggagtgaggcggaggcggccggcgagcgggtagaagacgtggagcacccgggacagcgagtcagccagccgggacaggacggcgtcgacgtcgtcgtcggcggcgccgaggcggtagaggaagacccggtcgacgggcggggtcgggagccacatcgcgtccaggaaggtgagcgggacggcacgctggcgcagcgaggggacaccgtcgggcgacgacggtgcgacgcgagcggtgcgcaggacgcggaagctgccgccgcgaggtggtggagctgccatttgtgtcgcgggcgccatgtctcccggctagcgagcgagctatccgcgcgcgtggctgatgtgagtagatggagtcctatacaggacgtagtgacgtactcctactatatagtccattttttctgtctcacggtataaatgctgcatgccccatgcttgcaaatcgcaatgcggccgcatgcaaggttctagaaagccattagtgtgtttcactagttgtcaagtttgtattggcggagagctcgagattgattggttgtagcgtcactggtgacgatggccttgcatgcactgtttgaggagaaaccaactggacttttgctgctgctttcggaattttgcggccgcgcggagctcatcgtcatacagatgcggagcagcttggtcgatccgaggataatacgactgctagaaaaagcattttcacagatgttcagagattttcttccaaacggatatgacctgcggagctaaatggccatgaaaatgtaaatcgggatggagctctcttttcgtctgcgaaaatcaatattttcaagcagaccacttaagagatccgcctaaaaaaacctttatttttgtatgcggacctcttaagtggtccatctggaaaatatgatttttgcaggtagaacatgtaaaaaatcatgccaacaaaaaatatcaaagttttatccctatcctttccccaccactcattttcctcccactcctctctctctctcatttgttcaccagcagcagcaaatccaccaccggctcagctcctcgccacctctgccgctggccacgacaaacggcgccgacgcttgtggatctgccgccggctcgcccgccttctcccggcgaggtgtgactcagctcggctcctccctttcacggtgacgcgcgacaacgacgacgatgacggtgctgcttatgggtagaggaggagacacacgacgacgacgacaacaacgcctgtgggagacgatggcgccgacgcaacgaggacgacgcctgtgggagcagcggcggacggaggagagccgttggaggagagccgttggctggaaggggaggcctacggcggcgcccgtgtgcggctttgttttttattcactgaatgtgtttttgtaggcggatgaatcactgcctacgaagatggagatgtcgcttgcaaaaatggccgcaggcccgcctacaaaaatcatctattttcgcaggagattgcacactagtagagaaacgattttcctagacgagaagctatttagtttatatacggaccgttttcacgtccgtatgcgaaaatcgattttcatatgcgggtctcttaagggtctgcacgtaaaaataagtcgatttttacgtgtgggcctcttacgcgaaaaccaattttcacgtacgaacctcttaaaaacatgcctacaaaaagtccatccatcctctctttcctttgtcaacacttcaaaatttcatctcatccacccatcccaatccttatcttttctatactctctctcacactctctcacctctctatcctctctcactctctcaactctctctcctctccagagcgcggctggcgcgggcacggccggcggcaccgcgccgctcggcgatggccccggcggcatgcgcgcaacggcgaccgggagcggcaggctcggcggctcgtgcgcgcggcggcgggcgaccgggagagacggcggcagtcgaccggacaagtacctcaggaactgcatcggcacgtgcttcgcgtcggcgcccagaacggacattgccgcagccggcgcggatggcctattatcgccgccgccgtcgacgaaggaacgcgatgtgatcaaggctactgggacaggtgcagggagcgcagcacagaggtgatgacctggccgttttcggtggcggggtcactacaccagatcctcacatctttgacggcatatctgtgacgggctttagtattggtcagtgatgagggtcacctttgacgggttctacgggacgccgtcatcggtgaggcatccttctgcaatccgtcacagataactagtcacctgtgacggtcccacagtagaaaccgtcaaaggtgaggtaaatctcacctatgatggcttccacatccggcccgtcacaggtaactagttacctgtgacgggttgcatccttataaactgtcaaaggtgaagttaactcacctcaaacggacccatcactggagcccgtcacaggtggggaggggggcggagtatactaatatgtactcccttatccactctgtccctcacacactctctcttatccacataaacaaaaaatctctctctcccttatccacactcacagaaacaagaggggaggctcttgcggggcggcggaggacccgacgaccctagagagaggcggcggcggcggcgcgcggcggtggttcggcggcgttgggcgacggctcagcggcgcgtggcagcggcggtggtgcggaggcgcagcgacaaggtggtgcggcggcgctgggtggcagcggtggtgcggaggcaaagcggcgaggtggtgcggcggcgctaggcggcgagcggtggcggcggtacccacatcctcctcccccttctttctcccctcctcccccttctcttatttccgatctagtgtgtggctcagcgatgcatggcagcggtgaggagggctcgacagcgtgcggaggcgaggaggaggtgggcggtggcgccgcggcctccatccccgactgccggcctccaggagctcggggtcaccgacgctaagctcgagcgacgacgacgatgaccaccgacgacaaccgccgagtctgcctccgggacacggatctggcctctgggacacggatctggccatcgacgcctcccccacctcccggccgccagcgcctccaccctttcttccccgccgatgtggtcggtcgccatggctgccatccctcgcccgccggtcgccagatctgtcgccggtgtgcggtgtgcccctctcgccccctatacttttgcattgatatgatattgttgtctgtgcattgagaaattcttgccatccactttgtgtgaatacttctatatgagatctatcggtttgaattttttgtgtgatgatgaatgtgagcaaagcagctctgagcctgtgacaacgagcaccaccacagcagtgtgcaccattttttttttgtttgtttttcacaccagtgacgggttgcatgctgcttcttttatttttttttgctgggttaaagacatcagtgacgggccacaaaataatgggtcgtttgagataacagtcacctgtgacgggttttatatgtggtccgtcacaggtagccttcaccactgacaggtctacacccgtcaaaggtgaggagagtcatcagtgaccactaatatctgaccagagctatatccgtcaaaggtgacactttggacccgtcacaggtagccctacccagcgtagtgggtcgccaaggttccgcgtgtacggcgtgggttcgggaggctggcgaaggtggacgtcatgtccgtggcgaagaccggcgcgatgtcggtggcggagggccgtggcggctgctccggtggcattgagattgaggtgggcatcgctttgtcgccggagcggatggtgaggttgcggaggtactttggcgatgatatcgcgtggctgtcgtcgtcggggcattgaatatcaattggtagagagtagctggtcagcgctataccagctatactagtgtaatttaactttgaatctgtaagttaaattgtatcaattttctgttgtttgtggtggacatatttgaaaaggattagtatcgtattgtaaccatttatgacgtgtttgttaacactaccacagaacacatgaatagtgctggttgggaaaccccttaaagtgttggttttcccaacctgcattatggaggcggcactaaagagtgatcgggcaccaattccgttttaaaaactagcatctttaaaaccatttgcgagccaaaaaaataggctcgatgcatcgagctcatccaccccgcatcatagaactccaaatcaattacaatcctcaattcccaatcaaacaacatcacagaacaagaaacattgaagaacatcacataaatctttcatagaaatcattcactaacattgaagaacatcacagaaaatcatcacagaaagagaggagggagggcgccgctgcatgccgcctcccgccgtggccgccgctgggacgcccctccccggatctggtggaggggagggcgcggccactgccgaccagccaccgcctctcatccctgcaagagagaggacagcgagagagagtcgagaagggagggcgccgccgccaggctgccaccgcctctcatcccgccgccgcatcccccctcccctctgccgccgcatgccgcctcccaccgcggccgccgctgggccgcccctccctagatctggcggaggggagggcatggccgccgccggccgcgggcagtgagagagaggacagcaagtgagagacgagccaccgcacgccgctcctccaccgccgcctccaccgtcgagagagagagggtgctcgagagagaggggagagagagcggagagaacgagagaaatcgagagagttcgactgtgcgagtggacgctgcggaccttatctcctcgtcctcgacgcgtcgtggtggggcctaccggctcggctaaattcgtaggtgccggtttgcacctataatttattataggtgtcggtttttaatattataggttctggtttttttaaaaaccgacacaaaatagaataggtgtcggtttttatttagaatcgacacctataattacttaaaggtgtcggtgttttgtgatttcaacctacggaggtgggaaaaggcctataggtgccagttttagcactaccggcttttccaggatttaatggtattgtactttcagtggtaggcgacgtatccgtcaacagcgaggcgcctgtggtgacttcgtcaatctccaggatttaccaaccctgtcttcgaagatgctcataggggtagggtttgcctgcgtgtgttcataggggtaagtgtgcgtgcgttgtgagtatctgcgttgtagcgtgtaattctaaaaaaaagaatatatacatgggactatttatttgacatttgatagaaaacactcttctaattctagcaaattttagactgttggttggatgtgtattttcattcctcgaggggatattctctcgttgtttgcatgtcatctaaatagttattacaaaatttgaaaaaaataacaatatagattaatatgaaatatatcactccacaaacatccaagaccaaattcaacttctataagttgtagcaaaagaacaaaataaactgaaatagttatcgtacattctcaactatatttgttgtttttttacgacttgtagaagtttaatttaaacgtgcatgtttctgaagtgatatatttcatattaatctatgttgccaatttttttcaaactttttgatgactatttagatggcatgcacaaaataagaggatatccctttgagggatgaaatcacttttccactgttgggttagcattacttccaactctaaccccttactcttctcctccctccctaccatcatcgcgcagcacacgagagggcaagagtcaggcgaccagaaatctgccccaccttgttaaaatcacttgagtttgacatttgatttcataagtcattttgttgtaaatacttgaccaatttggttttgttataaaaaccgcatagcgtacgtgcttaaccggatcaccccattatcgctgatatagaccaccacaggttaagctagccgcttcaatctttttctaatgtttgcattatatttatttttcatttgtcattgaaatcttctacaaatagagaacctcggtgtaacaatgtttgaactctcataagcaattctatttgtcaaattaaaataagtgttaaggctatacttttaaagctatttaattttggtaaaaccatattgacggttcacaattatgaaaacatattgatttggttaagcacgtgtgcacttaggtggtttttcaacaaaaccaagtccgaatgattatttgcaacaaataatttgtgataaaatatcaaacttgaagcgacttttacttggtttttgctattttccctataaattatactctctctctattttaatgtacgacgccgttgacttttagactaatgtttgaccattcgtcttattcaaaatttttgtgcaaatataaatatgtgatgtgcttctatgctcttcaatgtattaaaaactgcacaatttttaaagaagatgaccagattagaaggatagtgtaaacttcatttagggagggtaatttcatccttgagggagttatctccgatcctataagtccggagcccacaccaacactgatcaccggcaacttttcacaaactgaaaaccactaattaacaacagcgatctctattgcatttgcatcgcagcacaacaagatctctattgcatttgcatcgcatcacaaaaacaaatcgatcatcacctgatagtctgaaacaaactaaaaacgaaatatgcatgcattccaagctgcaatcattatcgtgtacgaaatgcatcgaaaagttaagcaacggcaattgttggcacagcaccatgggtcgagcaagcaagaatcaatgtgttcgttcacttaccctgatattttattttctcctctatctctctccacttaaactgccatccaagcttcttccaattcatggcgatgctggtccagaatcgataactgaccggattactcaaccgtactgccattgaagcaaccgaatcaaggtatttcaaagcaaatatcgtagatgagacgacagtgaaggaaaagtaatagggcttaattttgtgggcgtcttgagtacgaactcccagtccagatacatcttgtgctagccaaaggattgatctgttgattgttgggatcaatctgcggttctaaccacgacaacgggatccatgtagacactagcgactacaacagttttgttcgtgggtagtgctgtcagtggcgtatctaaaatttaaggtatgggtggtccgacttataaaaaatttaaaacatctcgaatataataatgttaatatataaaatataaatataggtaatagatccgcttcttccgtatcttgtttagagtatactcttctgtcataactgggaaaggatattcagaagcttctttttttttttgcatgtttctaaaaatgagatgaaatatctacatctgttgttatgttttaagaatctacatctacatctacaatacaatagtagaattttagatgtatgagttgggtcaaaactgaaaattgaatgcctaatatggttctaatctgctaatcagtaggagtaattaattatcacctgccctagtgctctttgttggttccttcccttgcagctcgcgcagatcccagttggccaatgccctagatgcaggcgctgatcactgcacgtcgtcgtcggctgccgcagccgcaccagcactccggcgccctcttgcttctttgcttgtacgttgttggcccatcgtcacttgatccccaggaagtagggaagagaaggagcagccagcaacaaaccgccgcgctatgcacgcgtgatggcgccgctgctacaatcgcgcgacgagaaggagatggagtcgcggtagcgaagagggagcggaaacggcgtcgcttaattcgtttggaagcttcagcctcacgggatttttttttttcttttttacccaaaaaaacgtgttgggtcgctaatttttttgggtggtcagggaccacccggaccacccattagagccgccggtgggtgccgccatggtgactttgacaagatggtcgagcgatggcgccggatatggagaagaacgacgagaggggaggggccgagatgctgcataattttctctaaagacaaaattgccctttgataaaaacgtttaggctgttaattaaggacctcctaatctatgcctctcatccgttttaaaatatctgcaggtttttctatgaatagtaagaagcagtacacatctcgtgatggggcagtcaatatgtgcactaaattcaacttgcaggaatactggctaatatttaatgataaatcaattcacaattaaataaataataattatataaatttttcaaataatataaatggtcgaacggtcaaaaataaaatcaatgatgttggcgtgtttagttcgcgtgccaactttttttttaaagtatacggatacatatttgaattattaaatgtagactaataacaaaacaaattacagatttcacatgtaaacagcgagacaaattttttaagcctaattaattcgtcattagtaaatatttaatgtagcatcacattgtcaaatcatgacataattaggctcagaggattcatctcgcaatttacatgtaaagtgtacaattggtttttttcatccatatttaatgttttatgcatgtgtcgatgtgacggaatttttgaaattttgaagagaactaaacactgtcattatacattaaaattgggagggagggactaatacagtactacacattacgtcgctagccatctagaatccagggagctcgatccgcggtccgccgacccacgtactgcaatgacatcgccagctcacggcggcagcttccgcgtcctgcgaaccgctcatgtcgcgccgtcgtcgtcggccggtgccggctgcaacccactgccggaggccactcagccgctcaccttcctcgacgcgatatggctcatccgcccacccgtcgagcggggcttcttctaccgcctcggcgacggcggcggtgcgacgtgtgacgtcgacgtcgcgctgtccaggttggtcgactccctagcccgcgcgctccacgtcttctacccgctcgccggccgcctccgcctcacgcccggcaaggccaaccggtacgagctcttctaccagcccggcgatgccgtcgccttcaccgtcgccgagcacgacgtcgtcggtctcgatgagctggccacggacgttcgcagggaggtttccaagattgcgccgctcgtgccggagctcccggatggcggcgcggtgctggccgtgcaggccaccgtgctgctacccgcgtgccgcgccctcgcccccggcgtcaccgtgcaccacgccgcctgcgacggcgcgagctccacgcacttcctccacacctgggccgccatctgcgcaggcgccgcagcgacgccgccgccgcccgtcatcgaccgcacgtccatccgtgaacgtgaagacatccacgacgtcatgaccgctcgactgcacgaccacgtaaagactacgacgatcaactcgcccgacgtcgtcgacaacaagctccttgccactttcacgctgtcgagggaaaacctgcagagcatcaaggaaaggatcgccgacgtggcgacgcgccgcggcgtgccgcctccgtggtgcacgtccgtcgtcgcgacgttcgccgtcatatggcggtgccacgtccgggccgcactaggcgcgggctgcgacgtcgaagaagagcctcggaaccatggccgccgtgcccacctcctcttcgtcaccgatctccggtcacggatggaaccccgcgtccccgacaagtacctcggaaactgcgtcggcccgtgcttcgcgtcggcgcccagaacggacatcgctgctgccggcgcggatggcctattcgcggcctgctccgcgatcgccgccgccgtggacgaaggaacgagatatgatcccggctactgggacaggtacagggagcagagcttagaggtgagcaccagtggtgctccgccgctttcggtggctgggtcgccgaggttccgcgtgtacgacgtggactttgggttcgggaggccggcgaaggtggacgtcgtgtccgtggcaaagaccggggcgatgtcggtggcggcggcattgaggtgggcatcgctttgccgccggagcggatggagaggttccggaggtgcttcggcgaagacgtcgccgtcgcgtggccgtcgtcgtgatccagtgataagtggcattgaatatatgtcaatagcggggccgcctaatgggcgactggtcgcgcaggggcgtgggcgcgcgccccgcgccgcttctgctctactagactactagctactacgtgcagtacaactagtctactctgttgctgtatgatactactactgctatgtagtttgcactactccatccgtcccctaatacttacactatttgaccattcatcttaataaaaaaaagtttagatttattatttattttatttatgacttactttattttataatttttcgtctttttatatatatttgcacaaattttctgaataagacgagtggtcaaataatataaacaaaatgtcaaaatccttttatattaggagatgaaggtagtaatattcttatatatgtatacatatgcataaaatttaaatacttacctatatatactttgattataaaaaattatatacacgtatgcaaactttagaacgtgcgtatacaaactttgtatacatatgtacacaaatttgtatacatacatataaaaaagaaaaaaaagtttatatacgtacgtatataaagttttcatacaacatatacaaagtttgtatacttatatataaagtttgtatatgtatgtatacaaaatatatcaactttatatatgtaaatacacacagtttatgtacatacatatagaaaaaaaatacatgcatacaaacgtatacaaacttaaactttatatatgtacatattaaaatattaaaaaaaagccagaaaaacatatggcatatacaaactttgtatacgtacgtatacaaagtttatattcatgtatacaaactttgttgtatatgtaagtatagaaagtttgtaaacatatacattaaaaaccaaaaaactgagccagaaagaaaaccaaagaaaaaaaacgtgcatatatggtttgttggtttttaatgtatacatattatatatatattttatatatgtttacaaagtttgtatacgcatgtattaaaaaacggaagaaaaaaaagaaaaggaagaaaaaactgaaaagaaacggaaaaaacccaaaatgaaacgggaaaggaaaaaaaaaagaggagagcgaaagaaacggaaaaaaacaaaaaagaacgagagaacgcaccgtccccccccccccactccacgcgcgccacgtgtccggtcgcgcggaggggaccgcgcttgactagccgctaaatagtcacttcggtcaatagctggtcagcgctataccaattagtacatactatgagtgtaatttaaattcgaatctattagactgtaaaattcagttttcaattgtatcaactttattgtttatggtcgatatatttgaaatggattaatatcgtattgtgaccatttatgacgtgtttgttaaatatacgggactgtttatttgacattcgatagaaaacactcctgtaaatttggcaaatttttggcaaattttagactgttggattagcgttactcccaactctaaccccttactcttatcctgcaatcatcgcgtatcacacgagagggcacgagttaggtgaccagaaatccgccccaccttcttcaccaccactgcttggtcccttggctgcctcctcctcctcctccacctcccccttctccaagctaacggtggcgaggtcctcccaccctacctccttccccgactcccttgcctccttaccgccagattcaacaccacctaccattgtctcctaaccagaagcttcactttgcccttatcggcccatcactctcctccatccccgtggcttccatgctgccgccgacacctcactactcgcctgtgtccactttctaccattgggccaccatctcccacagccgtccgtcaatgcatcttgatttatgcacccaatgtggaaaagcaagaatttctctatatggtgggtcccattgtatgaatacggtttaactttacataaatagatccctctccctctctctcttatccctcctttcccatatccctctctctctctcgtacgccttttgcttttcatttggcaacaagggggttgtaactgacttgcaattatccatcttaaatttctttagaattattttctacttattttctttgagatataaatatcgcttcagtactctgatgcacttccattaccaagaaattgtgcaacaagccaagatcactcatcccatatatattcatcatgtcttttttaaaaatcttacatcagcttctcactattgccggtatatatcaagtcatcaacatatagtgagaaaattaaaatgttcatacatgtcctcttgatatatagggtaggctcacttttgctcttggcaaatcctttttgaataaagtacttgtcaatttgactgtaccatgctctaggagcttgctttaattcatataatgccttcttgattaattgattaatagggacttatggaaccttccagttccatctagcgttctcatcaaaaatcacatctctgctataatgattttctttttctctagattataaagctgatatcctttaataccatcagcatagcccacaaatatgcagcgatcacttctattatcaaatgttactctcttttgtgctgacacttgagcatacaaatgcaaccaaatactctctcatatgaccacaaatgacaggcttttaactataccaagcttcaaaaggtgtatagtttggtactgccttgtaggacttctatttaaaatactaggtgattccccgcgctttgctgcggaaattgctaagtaacttttaacattcttttaataatcaagctaaaagtaagaattatattacttattaacaataaataaaactggtttgtcaaataatgtttagagagaaaaaaatttagtagactctgtatgagattgtagatgaatatgatatcccacacttttattatatggatgaatatatgttaagtattataataactatatatatatatagtattgcgaaaaatagtgtgaaggaagatgattggatgttgatttgtagaattcaatgaattatacatgatgctgcatgattgcatattattgccagtggatgatgaggtggcatttttgcatgttgagctttaggattagtggattatgactttatagtaagatatgataaattgcagtgttaactgctttagcccagaaagatttaggcgtacctatgtcttggactatagagtttgccatgtcattaatcgtccgatttttttttgcaactccattttgttgagcactatagccagccgttaactgtcgtctttggatgcaagcattttcacaatatttctcaaattttattgagatatattctcctccttgatcgctgcataatactttaatttttcgattactctgaatttccaccatagacttgaattttttgaatgtattgagggccgctgatttttcttttagaaaatatacccagatcattcttgtataatcatcgataaatgtgataaaatatcaattttctccttgtgacattgttggcactttaccaactatatcagtgtgtactagttccaatggtgcatttgctctccaagctccactatgtggaaaggcagttctaatttgttttccaattacacaaccttcacatgggtcaaacttcagtgtaataaatagaaggtcttgtaccatacctttagtcttgagtagctttagtgctctgtaactaagatgacccatcctcttgtgccatagattagaaatatcaacttcacttctgagagccatttgagtaggatgattcatcttcaacaaaaaatttatgtttgtccccatatttattttgcaaccagacggttatttttacgatccaatattttgcaagaaaattcctcaaaataaaccgcatacctgtgttctagaagctgccaaatacttagcaaattttgcttaaaatcgggtaccggcaagacatcctttataaattttggacggactgctgtttggacagcaaccgtacctttcttttcactttgggatatagattcaatacccatgtgaatctttgcatgatatgatgaatctatttcttgaaataaatttggatcagcagccatgtggtttgtacaaccactgtcaataacccaaacattatccttttcttcttaagcagtacgacaagagaaaatcatttcttcatatttttccttttcttgggaaaaattagcccgattaatttctcgagttctgcaatattttgcaatatgaccctttcctttgcacttgttgcaggtcattttcttccaggacatatctgtaatatgactagattttgggaaatgtcacaccacaaatttgaactggatgtaactttttctattctttcttgattgtcttccttctgcatcatgttctacttggaaaatcctttttttttctgaaaacaaccacggtcttgcattggaaatccatttttctgaaaattcccgcaaaaccttaagttttgaggcctgaagctcaactttgattgaaatgcattttcaacgaagttcccttctcgttgaagctttctttcttcatgagattccaacgagctcattagttgctaagttgtgagagtcgacaagtctttcgactcctcaatagcagcaacaatgtactcgtattttttaggctgactgattaaaatttttatccatgaccttttgatccttaatatcctcaccatagaggcgcatctgattaacgatcttaataagtcttgagaaatagtcttttaccttttctgacgccttcatttgtaaattctgaaattgcattctcaaagtttgaagcttcactgcaagtaacttctgagatccttaaaactcctctttcaacttatcctatgcttccttggattttttggtgccaataatacgtggaaatagactttccacaactccttattggatcaagaacaaggctttggcgtccgtcattcgattctccgtcagagacttattatgttccgctataagagtgatgagggtgttaggtcccgatctttcaataggtattgataaacagtcgatttgggcagagtcgtgacacaactcgatccggcttctgaacgaacacgctactgagccccgcaatcgcagcaccacgtctcctctggttaccaactgtgccgaaacccagttgacctcgccgagaaagctaatccctacatgcaaaatcgaagaacacaagtaagaacaagatagattgcaacacaattgcatatgaatgattaagcactcaaatttggtgttctacaaaccgatctagcggcgaaactattcttggcaaaataatctaagcaaaacccgactctaaacgatgacggctactgattaagtatgattagggacgtcctagggttgccctagggcgcacaccctcatgggctaagcccacgacacaattacaaggcccaaaaacccaaatcagatttggactggatgagatatgtggtttgttttgcagattcccgacagctcagtattaattttgacgtgggaccaaaaccatctgaaagtagattccataagctttctaacaagtactcatgggccctgaaattccttctagatcagtggctaggtccatttgaagttgatgctatcaggaggcccgaatctgaatacaaaacatgtagaactttatctcttgtcttctatagaccaaaagtgacgtggtgatataaaagaagacttggagaaggtcttggtttggtcccccaatcaacttcttcaatcatccatgcattccttacgctcggtctcttttctttcgcccaagcaaatacctctgcaaacgaaaacacacaaaactcattgtgtagcaacgtttgttcaaatatataacaagtaaatctaatataaaacatatacacctttggttgattaatacataaggtaatcatggttatatccgagttagttgtgtcctcatcatcaaagagtactttccaatatcccataatccttgatagtagcagtgtccacatcttgatgcaccatatatcataactttctcttgtaaatacaggaaccatagaccgcgtcattgtggcgctcgaacttgaagccatacctatagcttcaatatacaatgccgatacgtcgagctacttcgtcacgccctactcgaacttgggcgctctaatttgttgttggtgtatatttgtaagcaagggaacagaggggagtgctggatgaagtggagctagccaagggaacagaggggagtactcgatgcagtggagcttgccttgaatatgtgggctgcttgttgtaacttgtttgcttgtattagggcgttcacagcgcgccacaaatttttgctattcctcatgtgccacgtagacgaagaacctgataagcttcatacaacagtgcaagtattgtgggagggctggcggccgccgcgtgaagccacgcaacgctaaggccacgagctccacaatgcagcgcccagccattctccatgcgccgtgctccctcacctgccgtggagaacgcgtgccctcttttggctccgcgaactcgcgcaggcaacgcactttggcgacgtgacgtcgaatctttcctggatgaaacatcagcaatctacacatacactagttgcctatatttataggctgaacaaccaaccaaacttgaagcttcatgaatatagccccttttcagatcccacctcaaaatttttcaccctgtcacatcgaacgtttgaacacctgcataaaatattaaatatagacaaaaaataactaattacacagactgcgactaatttgcgagacaaatcttttaagcctaattgctccatgatttgacaatgtggtggtacagtaaatatttgctaataacggtataattaggcttaataaattcgtctcgcggtttactgacggactctgtaattagttcttttattagtgcccgaacactccatgcgacacccaatagaatatccgatgtgacacgccaaaactttacaccctgaatctaaacaccccattagtagaaagtagtactaccgctggctgcctattgctactactacacatcggccgtgtttagttggtgtgccaaaatatttttttttatatacggatacacatttgaagtactaaacatagactagtaacaaaacaaattacagattccgcttgtaaactacgagatgaatttattaagcctgattaatctatcattagcaaatatttactgtagcatcacattgtcaaatcatggcgtaattaggctcaaaagatccgtctcgcaatttacatgcaaactgtgcaattgtttatttttccgacatttaatactctatatatgtgtccaaacatttgatgtgacggaatttttggaagtttaaagggaataaacactgccattgatgcatagaagtacactagtctagaaacttttacagagtagtagtagtactggtcttttgaccattggttctagagaagttgacaagaataagatgtctatagagaattcaggaaatggattaactacaacagcaggaacatatcgctgctgatggattaccataagatttaactttgagacacctgaaacattattccattatttttagacaacaaaaataagaaacaaattgtaaaaatatataattaccctctgtcatatctaaccctcacttggccttcccatgaaactcacatctcacactccttttgtcgtcgtcagtcaaacttgggcgcgcggcaaccgttgttctgctgcatgcaccccgcgccaaaagtgttggaattaattccagtcgcctgatgcaccaaaaatagcagctctccccagcaaatcaacgaccattacgtacgcgggaagcgggacacgtttgaaccgagctatcacacgagttatacgtgcgacaaccgggctatcacacgagttatacgtgcgcaccagcgcatggcacttggcaccacaagccgcgtatcactgccgtatcgtgtactcggatcgaccatgcaagctgcactgcatgacgatgagctccgcgcgcgcgcggccgcaaaattcacccaagctgcagcagcaaaagaccagttggcttctcctgaaacaatgcatggccatcgtcaccagtgacgctacaaccaaatcattctcgagctctcgaccaatagtaccaacttggcaaccactagctcaaacacactaatggtacactaatgttcttctagaaccggcggccccacccgcattgcaatctgcgagcatggccacgcagcatttataaccgtgaaaatttggtaagactgaaagtcttacgccccctgcgaaagacttcatcttctgtgcgacacgtgtcccgtggtaatttcaaagcagataactccctcaaaccctcctaacgatacaacctaacgtcctgacgtcgttagcagagaagacgaaccggcgcggcacggcgcggctgcagggagatggagtgttggcgacccgggcgcgccggtgattcctgatgaagtggtggcggcggcgaaagccccggctgcggcagcagcggccttgcggtagctagggcaggaacgtgaggctgaaactcccacgccagcgatgcgtgagggacggcgagtttgtggcgttgccgcggctgcgccggcggcatgagatgatacggccatgactcctgatagtggcatcttcagcatcatacatatagtgagctcgtatggtgattagataaattaattacagagctctgctattgaagctccggtaacaaacttgactattggcgattatataaattgggaattaagataacaagctccaacagtgaagcagcacagaatttcatcagattagaagatgtcttaatatccatatgcaaaaacccaaaataacaagacaacagaacttgaaaagttgattttgatactcgtgtctctgacaaagtggaaagattttgatgctcgtgtctctgacaaagtcaaaatgattctaacatcagtcataagatgtcgatgaattggggtcttgattttcaaactctaaacgccaagaagctgatgctgctgcagtagtttcatgatgagcttgaaataatagatttgtgaattctcctcgaattggcggaacgaacatcctcgaaatgtcaccaaatggcatcacaatatttgagtcaagtggttcctgaacctattcatattgtaggaaaacaagaaaatttttaaagtacgctcgcattatgatggagatttaattcttattgatcttacagttggctgcgaagctccagctatatttatgtttgatggctgtgtggtttcttctcctgcaatgttcataaggcaaaaattggtacttaatgaagtcgatgaaaatgaaaaaaaataaaagacaagcaagttaaaatagaatacctttgtttgttgttttctttcctctgtcaagcaaacttctagatcttttttgcaatggaccttttttgtgaggaggagctctaattgatatgcgctcttttgcaacttcttctgtgcactcaagaaaacattgtggagcttcattttcatctagattgaccttgcttagtaaattttctacttctatggtcagtttatcaaaaccatgatccaagtgttggaggacttcattggaaactccacattttagtgtaacagatatcatttttcggcaaagatatgtactttgtgatgctaagctgtcgctttggccttttctcttgcatgtaaagattcctctttttgcatattttgtccatctactcaatatatactgaggaggtaaaacaataatactgttgtggttgaagatccgtagtacatgcttgcataaaatacctacatgattcagaatatgttagaggtgaaatattaatcccaactagaatggggaatatgtcaggaaaatacacttaccaagacaggtatacttcctgcaagaacatgatatattcatatcaactgaattaaaggtgactcttgtttcgtccttactgtgatccacagttactaccttctgtattgtggcccacttctcacgcaaatcatacaagttctgtatccaagaattgtcttcaaggtggtaatcagatatcaacttttgccaattgaagttaaagtgtgccactgacctttcttcatacacacatcttttaaagtcatgaagaaaattaggattattggagattacatggcttagatgctttgcagcattttggtatatatgccataggcaaagacagtgacttgagtttaggaatacaatcataatcgcctttgccattgcagcacactgatctgtgaaaattgtttcaggttgcttccccgacattgccttcaaaaagtttctaaatagccaaacaaatgaatcagcactttcatcgaataataatgcagctccaaaaataatagtttgcctatgatgatttgctccaataataggagtaaatggcatttcagacttgtttgtttgaaatgttgtgtcaatggagagaacatccccaaaacaagcataatctgcaatggcctgaccatctgtccagaagaaattacaaattcgaccatcctctttgtccaactgcacagaataaaagaaagaagggtcttctgcttgtttgttatccaagtactccaataatgtttgtgcatcttgtgtttctaaatactttttgcgctctcgaccaataaagttattgcaatccatttgtaagaatggcacattttcatctccacctaaccaccgttgaaaaaaatcaaatatctcagctagcttaactcctgcttgttgcatcatgctaattatatgctcatcggcatttgacatacgccgttgtgatctaagcatgtgtgacttgtcaggacttacaaaagggtaattgtgtgccaattcgattttctgcagcttccaaataccttcctaggaaataaagaactgaacacgagccttgcaatctgtttttgtacaagcacgttatttctttggctggtgtgttggattactgttcttgtgaccttcattactgcaaaccatgtacttggatgataaagtgccatctgctctgtagttaacgtggcactttcgtacactaaatcccactcttctagcatatgaattgtagaaattgtatgcatcatcctcagattgaaaggtcatgccaaccttcggcacttgctcgcaaggagcattctgattggtagcctataggtacaatagaagcatatattaaattggattttttcttggatattagtttatagatgacttctacacggatatacgctaacaacctgcagtcactttattacaaaaagaatgccttacctttatatttgattgagtaacttgttcagatttctcacgatctgatctgaacactacattatgaccctcaagattgcaatttgagctttcacccatagcatgatgaccaacagagttgaacgtaaaaccggttcctaccaacagcaaatggaatcaaatcgaatgaaaaatcgagtttaagtcatcaatctatcggccatatggaagaatcaacaacagatggatagtaaaacaagcatcttctcactttggctggcttcgctgagtgtggggtttgattcacccacttgctgcacctcacccatgagcaccggttcatctcccacgccgcgttcgtccatctccccgcagccgcaccgcgtccgttcgtcttctccgctaacgacgtcaggacgttaggttgtatcgttaggagggtttgagggagttatctgctttgagattaccacgggacacgtattgcacaggagatgaagtctttcgcaggggagtcttaccaaattttctgtttcacggtataaatgctgcatggccatgctcgcaaattgcaatgcgggtggggccgccggttctagaagaacattagtgtgccattagtgtgtttgagctagtggttgccaagttggtattttgattcttcgaggagatgtctcctcgttatttacaatgtcactcgtatatacgactcctatatcctggtagaagtaggactccattccccagccacccgcgcggatcggtcgctaagccgccgagagacatggcgcccgcgacacaaatggcagctccaccaccacgcgctcgcggcggcagcttccgcgtcctgcgcaccgcccgcgtcgcgccgtcgtcgcccgacggtgtccccatgttggtcgagcgcgccgtcccgcttaccttcctggacgcgatctggctcccgaccccgcccgtcgaccgggtcttcttctatcgcctcggcgccgacgacgacggcgtcgacgccgtcctgtcccggctggctgactcgctgtcccgggcgctccacgtcgtctacccgctcgccggccgcctccgcctcacgccgggcaagaccaaccggtacgagctcttctaccagccaggcgacgccgtcgccttcaccttcgccgagcacgacgacggcgtcggtgtcgacgagctggccgcggacgacccgagggaggtcgccaagatcgccccgctcgtgccggagctcccggatggcggcgcggtgctggccgtgcaggctaccgtgctgccccccgcgcgccgcggcctcgccctcggcgtcaccgtgcaccacgccgcctgcgacggctcgagctccacgcacttcctccacacctgggccgccgcctgcgccggcgccgcggtgctgccgaagccgcccgtcatcgaccgcacgttcatccgcgaacgtgaagacctctatgactacatggtcagtcgaacggaggagtctgacaagttcaggtcgcccgacgtcgccgacagcaagctcctcgccactttcacgctgtcaggagagatccttcagagcatcaaggacagagtcgccggcgtggcggcgcggcgcggcaagtcgccgcctcctcggtgcacgtccgtcgttgcgacgttcgccatcgtatggcaatgccacatccgagccgcactaggcgacgtcgaagcagataataagcaccatggccgtgcccacttcatcttccccaccgatcaccgggcgcggatggaaccccgcgtccccgacaagtacctcggcaactgcgtcgggccatgcttcgcctcggcgcccaaggaggagatcgccgccgccgacgcggaggacggcctctacacgacctgcgccgcgatcgccgccgccgtggacgaaggaacgagatacgatccggactactggaagaggtgcatggaacacgttggagggatgagcgcgagcgacggtccgccgttagcggtggccgggtcgccgaggttccgcgtgtacgacgtggacttcgggttcgggaggccggcgaaggtggacgtcgtgtccgtggcgaagaccggggcgatctcggtggcggagggccgccgcggcggcattgaggtgggcgtcggtttgccgccggagcggatggagaggttccggaggtgcttcgctgatgccgtcgcgtggctatcgtcgccgtctcgtccagtgacacgtgacatggatcgatcagctccgggccactccccggcgtaggcggcggcggcaggcaggcaggcaggcaggcacgtgtcgcttggcttccactcgctgggcttccgtgggattcgatgggctggttccccgtacccttattttttttcttggaaaataccgtagcattgtaccgacagggtgtgttcgctaagttgccagcgtggaacagtctgcatggtatgcatggtaaacagaggtattagcgtgtgattaattaagtattatttttttaaaaaatagattaatttgatttttttaaacaactttcgtataaaaacttttttaaaaaacacaccgtttagcagtttgaaaaacgtgcgcacggaaaacgagaaagaggggttgggaaaggaggtgccgaacacacccttatccgtaccgcaatatctatccctatttaaaggacgtgacgatcgggcatccgatgggagaaggttaaaatcgggcgctgatgtcagcatgacgtcagcacccgatttacgtgtaaaactgctctaaactgaattttctcctaaattatttatccaaatcatgatctgattgcaccattaatttcattgcaattaaatgttcgaaacaagaccacacatggatatattccgacgaaaaaaaatcttattattgaattatttttaaatgttgtacgatgttccaccagatatatcggaaatgtttcattaagtagatcaaaaatgtttccctcgtttaaatcggatgttatttcacattatataaaaacaatatttcagcaaatagtgaaagaatgtttcagttcactgcaatattagatctatatatagtgaaacattatgagtacactaggtgaaacattttttcggtagaaaaaaataaaccaaattcccttaataggagtttctaaaatatgtgggttttttttaatggaatgtttcgttcactgcaacattagatatatacatagtgaaacattgtgagcacactaggtgaaacattttttatgaaaaaaaataaaacgaattcctttaatagggagtttctaaaatatgtgggtttttttcaatggtaggtgggagcagacaacgcggtgggaccagggcctgcatgcacgcacgtggggggaggggtg

SEQ ID NO: 75207 - DNA, 21205 bp, Oryza sativa
gaaggaatttaagcacgcatctacagactgcagagtagagatgctaaattatcgaagcgctacagctcttacttctatagcgcatcagtgagcaggattcttggcacaatctctctaaaacccaacctaattcaaacatccaaaaatatatatataacgcacgaagcctcaatgcaaagatatttgccgcccgcatgccaagttcccctacccccgcccgcactaacacatcatcggaaggcagtgcggatctagggtttggtaccggtggcggtggtgctcggcgtcttcggctgggaacaacgggacgccgccgggatgaggcgaagatgccagcggcgcggtggcgtccggaggaggaagagaggatgggggagggaggtcgtgcgtacctggggatggagggagtggggacttggcgaagctgcgaggccgctcgccgccgccgccggggaaccgggggagagaggatgatgctgcggggaggaagaggcgaggcgaggcggccggcggcgaagaagaagtggggtttcgcggcggcgcgacctcgcgacgcgttgtgtcctttaattgctccgcgagaaggagagtgggggaatcgcgagggagcgagaggggtcccgaactcgcgacggtgagatttggactttggagacgaaggcccgattcctttactttttcctttctcggagctttgattgctactactatcctatcttcgttgatttttatcacatgtttagggctcctttaattcagaggaaattcataggaattttagaggattttattcctataggaatttttcctacaaaaccctttgaatcaaaggaataaaccctatgaaatcctatgaaattactatgaaatgcctcttcccatataagttttggaggaattttaacaagaggtagaacctcatggaagaaatcctttgagtctttatctcttctcaaattcctatgtttttcctgtggtccaatcaaacggtcatttctacgtttttcctgtgttttgcaatcctctattttatactttcagggcccctttgattcgtaggaaaagtgtaggaaatttgaaggatttcaatcctatgaaaaaaattcctatgaaagcctttgaaacaaaggattgaatcctatactatcctttaaaattcccatgtaatggctaatcctatagagattttggaggaaagttagcaagaggtccaacctcttagaaaaattcctttgagtctatctctctcatccgattcatgcgtttttcctgtggtccaatcaaacggttattcctgtgttttttctgtattttccaatcctctgttttacacctgcattcctgtcagaatcctacgtttttcctatttctccgttttatcattcctgcgattcaaaggggccctcattcatgtcagaatcctatgtttttcctattcctccgttttttcattcctgtgattcaaaggggcccttaaccattcgtcttattaaaaaaaattacgtaattataatttattttattgtgagttgttttatcgctcaaaatactttaagcatgatttatatctatacatttatataaattttttttgaataaaacgaatagtcaaacatatgttcaaaagtcaacggcgtcatctattaaaaaacggagggagtatattctaatgtaccaaaacagtttattagggagtaaaaattaatttttagataaaatttttatttatttgttcttatcgacttaaaagtcaatgtaaattatagcttttgctttgacttattaggccaaccgatgggactctcgaacaactgtccttttgtttttttttatataggccatcgttttgttctatttcttgtaaaaattgctaaatcttgtttacatttgtgttataacgttaagacagcaattttcagatttgttttgcaacctcattttaagatatagtgatttttatctatatatttggaccgacgggtttactacggtaagatttctttgattccaattacgaagactgcgaaataaccccacctccagattttcagatccaaactggtccatttctctagtttttaccagctcttatttggtaagggataggttgtcatgctgtaacctacggagaagaaaaacatcaatgattaatgagcaaacgagcatgcattggcatgaaacttgaacaaacaagtggcgtttcatctttcaaattataaacctaattcatcatcaatatgcctccatagggcaagaaaaatctacagaatgcggaatccaggactgcgaaagccagttgttccagtagctgaaagtgacctgaagcaatctactatacttccagaaataaataaataaaaacaaggaacagaactagacaagagtgatcttcatcactcttaagtgcaacaaggtaggaactgcacacttgtcagatgcacatgaagagataaaaagcaggcgattacagggacgtttgagaataaatcacagggtaagttgttggtgccagcaaattataagttgctagtaatcatggcaatcatatcagctgaattcacacgaccccaagcaaaagagtacagaacaattctgaattagttacgactttcatgattttcctcgaggtacagagcgcacgccatcttctctgatagtaatctcaaaccacagtagtacagtaatgcatacaccaattttcataggcaaaattttcttcccattagtgggagcaagaggaatacggtacacagtgaaagagaatcctaaacactcgtatgatactacttcagaggatggatgatgctcttgccaacaacatggtatctttcacatagctttttcagggtaccaaccgagtgttgcatcgtgttcagcttgatatccatgaacatggcctgcaaacataatatcttttcagttcacattttcaaaattcaagtatccattgattatgaactccattgagaagtaaaattgaacatagcacccaatgtaatttgaatactttcatataccttgtagtcatcaccatgcttctctattaatctgccaatataaatccgttgaacttttgtcagtggttccaaaggtgcagatttcccatcccgcctctgctttccaagtgcagatttcagatctacagtccaaagaaacttatgcatgagtttacaaagcgttgacgttctgctagtaagatcacaagcatattcttatgcaaaattctgtgtcataactaagtaacaaattaatgaatgataatagcataccttgaccactatgacaagcatgatcacatgaactgctaatcaaagaacatgcaaaactataccaattgaacttctaacatgttctactgccatatatcaacatgcccaaagaaagcataaaagaactataatgtgatcgcacagctggggtgagtatttcagtttaatactgcagatataaattagcaacagaaaagagaaaaagattatttaaaacaatgtctccaataattttcaggtctacatgaaaataaaacaggccactgacacttttgaaatggaaaggtggggaaaaactataatatcgtaacattgaaagaaaatgttaaaagcatctgttttccaatacattgcatgtttacacatataaagcaaattccgcccatgggacttgtattattatcttcagtggcgaccagtgtattattcacattctatttacagagtattatctttggtcaacatatcatcttaaacatttcttaagcaaatgctcataattcataaatacatgatactggcctgcttactctgggtaaacaatcaatagatatatttcagatcgaatgtgcatataatcagaaatcaatatggttcgattccaatcagcatactatggtgcttctttgattttcacaggtatggttttcttgtccacagactactggctgaattcaagatgatcccaacctgacatgacctgtaatttatccaaacattacatacatacactgccaataattttgcataccaattggtctatctctttttgatgctatgtcgatgtttaaagttgatcaagcattgctgtattgaagcatcacatcagccacagtgattatgcttgcccaaagctcagaactaatcagattagtaccaatttcttgccaaaatgctcaaaatcaaggatcccagagcatattagattcaaatgagcatgttttcgtaatggcctcatcatactgcgcgttttagccacttaaaaacaatcgttcaaagttcaaccgaaatcgaatatactccagcatcatatcccacaaaccatacccaaccacaaatatgatttaaacatgaagctatcagctttcacaaggcaggaacgagcgagtggaaaggggaaccgggggaggactgaccgtcggactcgaggtcgctgccggagtcgacgggctcgaactcgtcaacgggggcgcgcgccgcgtcgatgtcgggcgcctggagcggcgcgctctggacgaggcgcggcgtgccgcgggcgtgcgcgccgaggaggttcgggttcgcgacgaccccgaacgcggcgtagttcttcaccacgcttccctccgcgtcccagctcggcgcgtggccgccgccctcggccgcggcggcggcggcgagcgcctcgggcaggtcgaaggccggcttgaactcccgcggcttcttgcgcggcaggcccaccttcacctgggcgcgggagcgcttgagcttgcggcgcgatccccccatgctcctcctcctcctcctcgatagctagctagggtttggacgcgcgagccgagcggctagggttttgggtggagggagacgaaagaggaagaagaagaagaggagatctttaatgggcctccacgagaaaattatgaggcctggaggcccattaggttgtcttaggctttgggttaattggatccttgaaacttgacggggtattttaatttggacatcttttaaaatcatttttttcattcaaaaaagttgaaaggaatttaccattgcaaagacacaacttgtctctatccttcgaaaacgttacctattaagcccccaatgaataagaaaatatcgtgctctttccaaccactcattccgcgtatctcgtgtcccctctctctctctctccctcccgtctctctcccacgtaggtcctcagcagtcaacagcggagatagaggaccggcgtggcggttaacggtggtggaggggaggcagcaccggggaagatggacatagggagtcatctccctagtgtcggtggccctggcaaaaggacggcggagaagcggtgaagaggaggtccatctcctggtcgatggcagagctaatggcgatgcagaggggatggggccggcaggggtcgatgacggccgtggggtgggagggggcgtccttcctatgcagctccccagcaagaacttgcagatatcggcacgagtggaagctgcaggaagacaatgacccttacatagatccgtatgtggcatggctcctattcgtcggcgatgatggggtgacgaaagcttaggcaatagcagctacccgccttgggggagtagaaggcattgcaggatcctggtgtgaaagagaatagacaaattgtaaaactccaattgcacggctacaaatagactaataattgtaatgacatttatctgaataggcacatttgcaatgatacggtgttgcattttgctaataagtatattattccagaggaaacacctgtaatacgatgatgtagtcatgggatgtgcacaactttacataccaggatttaaatcctagtacttacgaatattacaaacatgtaactggacttttaacaagtttttagtgaggtccgggaaaagcctctgattttcgtctctttgagcgtatattaggagactcgtttgcatgtgtgtctacggtgtaagcgaaaaaaaatattataccaaaataatatggagttattttaagaccaaatcaaaacagtggctttgtgagcgcacagacttgtgtgcctataaattttctcaaggaaaaaacagcactaacttttgaaagcacaaataacttataccaaactagccaagcgcccgtaagttgcaacggaacagaactgctacgaatgcataaagacaaaattctccaaatttgcttataatcacattccatgacttcatctaaacaaacttgatcgaagctacgctttggcagttggcacacgtctttctcaccactcccatccaccaaatatgcttatatgcccgtcagctctagctctgcaccctgtttatgctccattgtgccttgtcctattctgtttttgcaactggtcatcataaaggcaacaaaaaaaagtcatggaaaatattagagttataaaatgtggaaattgctcaaatttattatttgatatttgggatgctttgaaagtgaggtgcaaaattatttgtgagggagaaagactaaggaaaatctccataggattttattcctacaaaattcctccattttaagtttattccaaatgagcccttaacaaaaggaaccgactataaagcttataattttagggcaataaaattataatactacctgcactttaatcttagaagggagaagacaccattaccacaactagaaaggtagcccgcgcattcgcacaggcatgcgtcatacgttaagtttgagacacttataagagcgaaatattaaacggagaatatctgtcacgatttctccataaattattttcgtcggcattaattgcttttataattttctaacctattagctttatattatatcatatttaagtaatatctataagcaattatatataatctactttatcatttgaaaagaaggtagacttattttctttagaaaacatgtcaacgaaagtaaaagtaagtgtaaagcaaaagtaaggcgtttttcgttttttagttgcatatatattatcatatttgacctacttttttctttctgtgtagaatgtctgatttagttatgaatgtttgcaaaacaatatatgatggtgcaatgtatgttgttgaattatttttatagtttcttatggtaatgtgaatgacatgtaaaatggaagggatggtgtccatcggtaaaaacataaacatgaatttatcatttttgtttggatactattgatttaatttagttatacatatttctatattgatgtataatgacgaaatatacgttgatattatcttaagtatttcatggctatttggttgacgtgcaaagtacacggtcgagtatgcccagatgccatatatttatatagtaaaatgttagcatatagatcttcagttgttcgtttaattagaaataaagtaataatcagattagaaattatacgtgtagcttaaaatcatagtccttttaatatctacaattattgattgtttttatttttagtttaatagctgaaaataaaaaaagaagacttgagaggaatgaaaagcatagagctttaagacagagatgggaggaggtgggcagtgtcgtagtgttgtgtgaatgtgatgtgggtctgaggtggaggggacattatttttctaatctttctgaatgatccaagtgaaaaaaatatttttttctcatatttctaagtttttctttgatatttatgacatgtcatgttgcggcttatattttctcaaagagaaagaagatctaatgtttaaaaataattggtcatcgatttatattgaaactaatggatagatgttttttctttgaatttctatttttttccaacttttaaaatgtgacacgtgatgacttacaaaacgctatagaggaagtttaattgatctttatattgtaaaacgatctagatgacatagtatatattgacttttttaattgagtgtggctatgtaagtacattacgtgcttactccaggataagaggtggggttttacatgaggatgatgtgtgtctaattaatctaatataacggtttataaggttggactcaccgatttaattgaaaatcgagggatggatgttttgctttttctcaaattttgtacaattttctttagtttattagatctaatccaatggtgtaaaataacgggttcaccaatttaagtgaaaatcgacgatgagattaaatattgccacatggtggtctaggagcgtttgtatgagtgccacgtggcggcttaagagcgtttctaggaagtttaatggacttttaatatataatataatagaaagaatagaatagatagatagataatcaatcacattgcgagctttccattgaactacaagtctaaaattatcttgacaacacaggaatatatagcttcttcactcttcagtccttccactgtctatgaaaatttccaaccaaaggccgagacgtttgatcaaaatcttcacttttccatgtgccgcagaaccagaacagagaagcaagaagggcttaactctaaagatgacaaattattgctacacagaaaacaaatggattctaagtagtatagtagtacatatttgcacacaatagctaaaattcatatccgcattgtcatcaacagcataaaaaaatgtcaactactggagagaaaaccagagtaaaactaaataattcattacagaagacaagcaaagtgtgtataaatatagcatcagttacgcaaaccatttgatacaccatggtcctgaataaagtgaagatgtgagcaagcatcagttcatctgctggtaagagaagtagagaactcatacatgtatgcacgttgaaccatcactctatttaaaaaccaatcaggaaagtactggtgaattgtgaagtcagcattaaaaattaacacatcatgctgtcaatgggtaccgtcgaagaacgagcagaaactaaaaggctaaatatgaacatagggatactgaaaaaactgtttcactaaaaggataacatacttgccattggttcatcatacactcggtatcataacttcaatttgactaccaacatgcttgtagggcttactgaagtcatcttaaagtaatatcagcagtattttgttccaaaattatggtaaacaatgtgaaatagaagataatttgactaccaaggcggcaacaatatgcacttttgtgatacacaaatactaatatacgcctcaaagccacctgtgtagtagacttcttctgtatcactctttcagctcacctaagaagcagaaagacaaaaacacaaaactgagtaatggtcgaggagttgccacgaaattagtgcaattgaaaatcaaaagaagaacagcagctctgagcatttcatagaatcgagatgtaatatgtaaacaagttagaggttgcattacttcatagataggataagtcaaggtgacggaaccagagtaccagactgccagagctctgtacatactatactggcagtcagtgagctgagctacaccctacaacagatactatcagcccatctcatctcagagtactactagagatgagatcaaaagaaactaccctaacttaatgcggttcaggcattgttcctttgttactgtctgctggttttcctggctctttggtagctccagaatctctccatccactgccttcaaccatcttggccaaccgctgctccatggagtcgacaacttgagagatcagggagtggaactcaggcccctgcgagcggacaaactgacgggtatccatacccgacggctcgcgcaggccctcaatgcccctttctcgacacagcaatgccgcaatcccaaccgtcaggctgctcctggctagactcaagctatggctgtgagacacagggccgaggagagacacgagggctgtcatctgcttaatgctcttctccagagagtcagccgcattgggtggggggtccagtattgtgcccagcctagcgaatgaagctcccatgcgcatggcaaggctgttcatggcagtaatggcggtcgctcggtctgattgtgcctctagcatggcagcctgggtctctttcaacattgcattggtcacctcaagctcatcctcagtgctacacagcttcttggacagctcctccacctgctgctcaagccctgagatttgggtcaccaaagcagcagtttgtccacgtatttgtagagggacttcatcatggaggccggcagctatagaggtggcctgcacaagaaggataattgcatgtgacttgcttcctaggataggcaagccagaaggattcttaggaagatcacctgaacaaggaatgaggtgattttagacaaacgactctgcaggactcctggctctgagacaccttccattagctctttgactttctcattgacaaaagttctcgcaagttgtattgcatccttgtcttgaacaaggggaattgactggagaggcttgccagggccttcactatccacagtgatcacttcattatccctcaaatcttcaacaggcaggtcctgtacatcagctactgccatcttcaccacagaatctccctcataaaaaggagaattttcaaaactcagcaaggaaactaaatatgattaacacaaaagcaacagaaccggcaaacctaaacataccagtcttagatagaaccacacccggagagtactcccctttcccataatcatcctgctgaagcgtagctttcgtgctgtcaggggtcaagcagccaagaccatctgaatctgcaggctccacatatcatgaaggtcatttcacaaaaaaagaatgcccatctgacaaagatacagcttttcaactcaacaagtgacaaaggcatattttgacctgagctggtaacagcaaggttaatccccatccaacaaagatgcaacttttcaacttagcaagtgacacaacacaaaagcatatttgaacccgagcttctaacagcaagattaatcgatccgcctcatttattatcctctcatttcactcaaattttgaagaaaaatgatatcagcacaggaaaatgctataaatgttagttacccgattgatagcaataaaaaataatgagctactggaacaaataatctgtatgtgcattgtagattgaggttgaagcaaaaggtcaccactactatagtttaggtttccaagcaagggctctgtacagtaatctgcatacatctctaggcatttcgagcaatttctcagtactgatctcagtagctcagggtccttaccatcagagtcaaggtcgctgccagggccacagccgcatgaaccatggaggccaggattaccagacacgaaaagaggagttccctgcggcacatctcacattttcacacctcagctcagaggtgggggcgggggcaagtggaagcaccagacggtcagagtcctttggagttttgggcagcagccccacatccaacttgttgtgcgagcactcgtgcttgtgccccagctgccctattcgcactaggttttgggggcagggagacgacgagaaggacatttctttgctttagtaaatttcactttgagccacctttactgacttgtgaaactttggttaataaaggtgagcaatgtgaaatttactgtcttttttttttgcctgatagaattggttctaaacttacagtgttaaatggaccatggacctgactagaagtaaaaactagcttttctagtggttgaaaatattggtagtagttgaaacatactacctccgttttttttaatagatgacgccgctgattttaaggcacatgtttgaccattcatcttattcaaaaaatttacgtaattactacctctgatttttaatagatgagttgactttttatcacacgtttgaccattcgttttattaaaaaaaagtacgtaattactacctccgtttttactagatgacaacgttgactttttatcatacgtttgacaaacttttgaataagacgaatggtcaaacatgtgttcaaaaatcaacaacgtcatctattaaaaaaggatagaatataatttattttgttgtgagttgttttatcacgcaaagtactttaagcatgatttatatcttataaatttgcaaaaaacttttgaataggacgaatggtcaaatgtgtgttaaaaaacaacgtcatctattaaaaaaggatggaatataatttattttgttgtgagttgttttatcattaaaagtactttaagcatgatctatatgttatgcatttgcaaataattttttaataagatgactgattgtgtccgaaatcaatggcgtcatctattaaaaactggagggggtataatgtactagctctcttttttcctaatctttctttttttttgcaaagtttttttttctaatctgaaatctccttttcttgctgtctatccagattaaccacgtcataccaataacaccacagtatcaaaagcgttgccgctcgatctttatacagcaaccatacattaaaaaaaaaagtgaggaatcggcatacatcgaagcaaaggggggagacggcgtgaggggcctataaccttccgtctcgaggtcgctgccgggggcgacggggccgcgatcgctcgaagccgaggatttcctcgccgcgggtctcaccacgtcacgccttggcttggcggtcgtcgtggcggcggcgagcggtgccaatggccgctcggtgctcctcggcttcttcggcggcggcgcgtccaccttgccgtgcgagccctcgtgcttgcgcacctgccgccccattcgcgctctagggttttgtggcggggggaaaggccgaggaggactggaggaggacactactccatttttgtgttcttttaacttttttttcgagtttggggagactttggagacgaggacgagccggcctgtcggggaaatcgaggcaagccgccgggcccacctgtaagtgataggaggctcgctaaggccatcagcaatgggtaaccccaggtcttgccactagcgacggccgttcgcttttccgtccgccctgttcccccgtgatggagcgcgtccctctgctgggggtgctagggggcgcggctctctacacgtctcgccggtttttcgtggggagtcgtaggcaggcgacacgttgggggcttggggcgctcgtggacacgactaccgcacctgcgatttcccattctaccctcgatctcgttgctaggaggagggcgacggcggtggggaggaacccgaggcggcggcgcgagagagagacgccgacaagagagacaggaggcgtcaccagagctgcgagaagggaggcggcgtcaagagagagaggagagagaggcgatggcgacgacaaccggatctggcggagaagcaaccgcaccgcaccgccgccgccatcgccactgcttgaggcgcccgtgctcgccaccgaggagcacgcggacaacttcgtggtggtggtcgctgccgtcggccaccgggcagagacgggcagcggcgagcgtccgtcgcgaccttctccacctctatcttggactcctccgcacggagagagaggcgagcagcggcaggagagagaggagaaagtggcggcggcggcggctgggaagggcgaggagggaggtggcactggtgctcgcgagatagagagggagagggagggggaggacgacgacggcgccgagcggagggagtgaaacccggcgaagaaaaaagaagaggaggggaaagaggcggagaaaaaagaggagagggaaagagagatagggagaagagaggggtagtataggaaaacacacactgtgggttttttggttgagacacccattgtgggcttgagtactttcatccagttgcctcatggggagcccatctagggtgtcctccattgcgaagggagtttcccagagagtaccctcagtagagtgtccctgattgtagatgtcctaaccgatgctgacacatcctatactatgaatgtagactgaggccttgtttagttcgcgaaaagaaaatttttgggtgtcacatagggtgtttgaccagatgtcggaatgtgtttttggacaggaatgacaaaactaatttcataactcgccaagaaacgtgagatgaatttattaagcttaattaatccatcattaacacatgtgggttactgtagcactttatggctaatcatggactaattagactcaaaagattcgtctcgtgattttcatgcaaactgttgaattagttttttattttatctatatttaatgcttcatgcatgtaactaaagatttgatgtgacgtatttgggaaaaaaaattgagaactaaacaaggcctgagtacaaatatccaaattattagtactaggatgtgtcctatccacccaatcaacccaaaatcccttatattttgggacggagggtgcatactttaggcctggtttagttccccaaaattttttcccaaaaacatcatatcgaatcgttggacacaggcatggagcattaaatatagattaaaaaaacaaattgcatagttagggggaaatagcgagacgaatcttttgagcctaattagttcatgattagccataagtgctacattaacccacatgtgctaatgatggattaattaagctcaaaagattcgtctcgcggtttccaagcgagttatgaaattagtctttttattcgtgtccgaaaaccccttccaacatccgatcaaatatactatataacataccaaaaattttcttttcgcgaactaaacaggctcttagtattgatggtgtccattcccacatcactcactgacatgtcacatgtgggccgcataacctgtgctagtattacatcatctttcaatgaatcatctcactgtttcaccattggttctccccaaattttaaaatcaactacttgttcaataaataaaataatagtattatttcaactaaataagtgtttattaattgatttaataagataaaaacttaatttgttttctgttgcaactcatgggcactaggctagttaaaacaaagcacgtgatagtgtgtcgtttcgtattggtagattagtaaaaaagattataagtctacagtcttgaaaaaccataccaaagaaaatgaaaaaaaaacagccacatcatacgtctatgaccaaatcccgcatttcaagattaagtcatgtttgtttcagcttaatattattgtaatctagattattaaatcagattactctaagctggattataataagctgacataaaataagctatgagttgtttatttctctggattattagaggcatccaaatgtagtgggtctttagccactcaataatctggaaaaagctcctctagaggagattattggattatagtaatctggcttatagattataataatctatttgtttgtttcagcttactcctaataatccagattataataatcctaagctgaatcaaacagcgcctaaattagatcgcatccctaagggatgagagtgtctctgcacacccgccctaacgtgctaggatgtaattttcatctaaagatacctatcggagagaacaaaaaagttcacgcaacaatgccctaagaggaaagtaggggtcgtaggcatcgccgttgccaaccgcccaacccaaagggctaggctttcacctataatctttttgccatcccgtatcaaggtcacctactagaaacagtggccaccaccgacagtataccttcaatgcgctttcaccactccagtgtctcgccgtcgaccggcccaagcaagagctcaacatttggtgcgctccaaattcatccacacagttgggttgcagaggaagagaatgagagagaaggatagaacctctcgcttgcactagcccacaaacttggctatcttgtgccggcaaggtgccgctgcaagaggactaatgactagatcggaggccgccgcaggcaaccgatgctgcttctgtatgttttctttagctgcaaaagtacgtattctatcaaaggaagcgtaaagtgcaagctgaaactaatgcacacttccgaagcccataaacggattatcacaaaataaaataatccattcagctgaaaagaagtaggcgattgaatcgacgtcacaaaaagacaaattaaactataacaaaaaaataatcttgctggaataagtgaatgttcctactaactgaaatccatgttatagcagaacaaccataactgatactaaccattaacagggccaatctttacttcgtctcactcttaccatgcgttgccagtgtagaatttcctgagtacaaaaccacaaatgaacgaaaatttgaacttgtgttgtcagtgtagaatttcctgaatacaaaaccacaaataagcgaaaatatggagtttgcttaacaaatacaactggttctttacattacaggtaatttggtgacatgtttacaaaaaaaaaaaattgtgcaattacagtgcaaggtatatatttagagacgtgccaagtcctctaagttacatattaacatttcaccaggtttagccacatcagatgccatgtatgttttcactcttctactaagggtagaactcaacgacgtaaaatagatgagacaaaattggaactatgatacaattgtgttacgtatttcaagagtggtgccggagcgatattgtccaaatcaggtcagaatctgaagtgatcgtaacaacagtactctcctctctcacaatgtttgatgtgctaataagtccaccaaagctcatgctggtattatctggagatgaaatttacagatttttaggcaccaattatttgtcgatgtcgaattgatgaagtgggaggcttacctaaattccattgaagcccagtggttgtggtggtggccgaaggcgcgccgatgggaatcaatccacagtggggcccctcaatagaccgttcaatatggatgttatgagtgtgtgttcttggcagcagaaagatcaagcaatcatccgataggagtatgatcctgttgtttgggaagagatgaagtacgttgatgtttcccatctcgtggtcaaaccttcccccaagggccccaagagcaaagatacacagctgcagttaaaagacaaatatggcagtaaattttgtgaagatggtgggtaatgacaccacgttatcgagcttaagaagtttacattagatttgttggggatggccgaattctcagtgataaaagctacacatttgtgtaaatcggtggtgtcctgatcatgtgactcatcgactatttgagtaccctgcaattttcacaagaaaaacaattgtttcatcagataagcatgagaaaggaatatttttgtttgaagtcctataccaagatacttcatgccatctgatgaccgaagcatgaaacatatcaatatgaatatttgcaaaaatagatactaccgtggcaatgtgagctatatcctatagaagataccagcagctgtctatattagacataagaatgaaactaaatgttcttaagtaatctaagacaactcttaacactgttcttttgttcctaccagaaaaactattctgagacagagaatataccagcttgaatgctcatacggcatgtaattactttatcactttctgtaaaaacgcaaaatgccatgatgtgcccattaaaaataatctggaatatgacttccatttagttcagttgtgtcagtcattggttttaaataagctgtcatagtcatttggtttttctttctcattgctacaatagatactctgtttgttaggcttctgactgggcaatactaaccattctagtgcacgccatggtttgaaactgtcttattttgttctgattaaaaacaaaacatgtgccaagaagaagcagtagcaccatagtagtgaggctcatgaaattccaagagaacataaaaattaactagcaagaatagttgaaaataatattactagataatatggctgaaataatcatactgttttgactaacgaaaactggatggaacatattaaagaagtttatgaattagagtaatatcctgttattgctggttatacttgagtccatatcccaaactagttacatctggttttaattaaccgtgactaaatggaaaatattgaattactttaccatattggaataatattccttcacttctggtcgaactgagtccagatctcctttgattacatctggtttgtatctgcaccaaaacacttgtgaattttacatgagaaatctttttgtaaaaaaaggcaaacccaaaatacttcgatatttgtttccgattatcagccattaagatcatctgaaatatgtgaccatctctcaaactctgattccgcataagcaatttggaacataagacggattcttgttcaacctttgtctgtgcggatataataaacttgagaaaattcgatccatagcacaagaaagaaagcggtaccaaaaaatagcacaaaaagtttccacttttgatccatagcataggtcaccgatttttcttcgccccgtagcacttccgtcacattttgaagtaacggcgttagatcggagtggagaaaattttcgtcggactcatttgcccttcgttccccatcaggtctcctctttcgctccctcatggacggcggcgcggcagccatcgggcgaccgcctcgtctccccgccgccgctgagcgagctgctgcgcatgctcttcaacggcgtggacgcgtagctcgccgtcaccgctgacggagaggtggacaccgacagctgcgccacaccagccgagcctcgcgggcccctcgaacagccgcctcagcgccgccgtctgcagcatgcccagctctgccatgcacgtgcggatgtggtcgtcgctgccgtagagcgccgggtactggtcgatttcacccgtcctgccgtagaactcgtacaccggcttgtccagccacaggaacccgcgcatcagcgccggccaccaccatgttctgatgtactccctccggctcttccagagctccgacgaggcaccaatgccgaacacaatatggcccagcccgatcgacgcggcatcatcagctggcatcggtttcagccgtgccaccggcagcgacgaggcgttgcgcctgttgccagcatggccggcggccgtgagatgtgcaacggcaccactgccaaggctctcctccaggcatgagctacccgagtagaaaggggacacggcgagggcaacgacgtacagggcgagcaccaggaggagcaagtagaggaggctgcagaggaagaaggaagccttgcacttgggcgccatgctaggggcaaattagtattttgaactccttagtcacggctaaacactccatcacaactccaaacctgacggaagtgctacggggcaaagaaaaaccggtggcctgtgctatagatcgaaagtgaaaattttttgtgctattttttggtaccgttgtttttcctgtgctatgattcgaattttctcaataaacttggtataaaagcttctcatagctcaaggatattcatacataatatgacaataaataataaatagggtaatgcatcaaccactagttctgaaaccactgcacctcaaccagtaagtggaagttctaacatactagaataaccacttgccggtaacagttgtattaggaaaaaaggcctttggtgtacccaatagccattaagatgggattaggctacctataaccccccaatctcagcaccagcataagcagtttaccgaataggccatccgatgggagccacaattagaaaggcagcttgatcctacgactgaattctcatttcttaagagcatattatctcaactagtgctacacctttatccacacgaatatactaccatatacctatactcgtgtcaagctctagcatgagggaagcacaaagaaggcattccatcgagcacatagtgggcatgcgaagcgcagcagggagcaaccaattaatgaattaaacagaggcatacatccaccgcccacaggaactgcatcgcaaagtcccccaagaagacaaaaactaaattatccgtcatgccatgtgcatagtaaccccctgcgcatctcccatctccaagaatccaactcctgaacttttgaccacgaatactggcgcctcaatgacatgaagaggctgttcgaatcgtagttaaaataaaataaaccttacaaaattttaacaagttagcaatattatcaaaattttggcagaatttcttatgtatttatcaaaatttgtaacaaactaaatgtaggtttttttatacaactttgctaaaaaataatataaagtagtacgattgaaaatggcatcaatctaataagccccgaacaagatggagaggatcatcggttgctgaaccgagactccattttggcgccgggggggggtcgcacagataggcaagaagctaaaattactgcagtagagttacttgcgtgccatctcgaccaatccaaaacgcctcgctgcacggccgccgccgtcgaggagcacgaacacgaacacgaggaaaaaaaacactggaacacgcgcgcgcgggcgcgccgcgcacgatccatccaagaaaccgaagcggggcgggaaatccccccccccccccccccaaaaaaaatccgggatcagatcgcgttacctgcggcgaacctcgtcggggtcctgtccaggaaacagctccggcatgccgtcgaacacccggttggcgccgccgtccgcgcacacccgcacctgcgctgcagagagagagagagagaacgagaacggaggcaggcgcccacgtcagtcagtcagcatcgagaagaagagaacagaagagagaagagccacgcgcgaagcccggcgagcgagggcattctactaccgcggtcccagaggcggggcgcgaagcggggcaggcgctggttgagcacgaggagcgagtaggcggcgcagtcggcgtcggcgcccgccgccgccgcggacggcgagggcagcaggaaggcggaggagtggacatggccggcctcggggccatggcggcggcggcggcggcgcggcgacggcgagggctggaagtgggtggcttcgcgccgatcggggtcggggagggtgccacttgcgagtcgtgggctcgtcgcggtcgtgcgagctggcgtgttgaatgggcagcgcgtgtttgaaaatttgggg

SEQ ID NO: 75208 - DNA, 19435 bp, Oryza sativa
catcggcgtcagcctccttgttcttcttcttcctcctcgggctcctccttcgcgtcaggcgcaatgagggcgcggtggagagcgatgggcggccagtgacgatggtgggcgctggcgcggcgttttttcgcggtagggagaggcgcgcggcacgatggtggtgcggactgcggaggaggagcgcgtcgattctgtgaaaaatccggcgcacgagtgcacgacggtgagggggcgagagagcgcgaggaggaaatgcgtgggagatgcgggagaaagaggagggaagagcgagacacaggacggtggatgcggcgtgatttcaccatttcaggtgcggggaggagaggagggggagaggtggggtaatctgaggcgttggattggatgattttagaccattggatatgtgatatgatgaatgatgaatgagtaaaaggatttgttgaactatagggtagatccatgatggcatgatggcatatgtgtataacatgacatatgtgtgggtgcacatgacaatcaaattctcaaattggcatagaaggttctccactataagttattttatgagacaactacaaatgataaaaaaaatactgaacgtacataaaaatgatatgatgataatgaggtttattttaatcaccgatatcttcttatatagttttaataatctactgaaatgctcacatttgctgaaaaaagggaattactaatgaaaaataaattaaaaatatattaaagagcttttacaaacacatggtcggtgggttgtaaatattccatccagatcaagcattttaagtgaaatatggtttgtgattttaaaaaaatgtaacatgcatctatactacacaacagacttaaatcatagtatacattaagtgttatctccaaacaagatggttagcggtctcagtggcagagtaagatgcagagcaaggttatagctccttcaaaaagactatctatacaaaaaagaatcacaaatttcagatgtgcatattcatattgtccactaaattttttgcttacaactatgattcttccgtcaccatcgcattggagcagaaaagaaagtgcagcatatgcctaaaaccttgttgtactacttcatcaaaagttattgttggtgacttcgataattcagagttcccatcttctccccttcttgtattgcattgcataatctcgcatatactatagtagatatgttccgtcttcttccattcttgtgccaactcctaaattttcaacaaaccttgctgtaacactttgctctagaagtccttctaaagactcatcttttttgtcactgggaacccacaacagctctttgattggcacacttttctattatcactttctacctgcatacttacaacacccaactaagtaccacttatcagaacagctggtaatagcagtgtactgttagtttattaaccaattatttttctgcaaatggtagcacagtgcttaaaatactgaaaatttagcatattgtgtatataggattaattagaagcacattagatttaatagacaatactgaaacctgtagcaaaaaggagttaatttgacaaacccttttctttttatgtgcataaaagatatctgtgaaagacaatttgttctggtttgtcctcttactttatatcagattattactaatttgtctctgcaataatatagtagccagattttagagatatacaggcagggtgctgaaatggcacaaatctctaaatagagcaatcatattgtatacacctgataaatttgtcctcaatattctttacataaattttattcagtttcagggacatgttcaagttcagagaatcattaagagcttgttttcagccgtaaattcagatttcagacacatccaaaatgatctgattttattcttttacttaaaaattcactttggaagcatattttgtgctataaaaatcaattaaaaggttgaaggacaacgagcgaggacagctagcaaacctcagctcaattgaccctacttcatgcatcaacggccaagcaattaactctgtacatgaacctgcttgttctgatgaggagtaggctccatgaaagctgaacttgatgcccacctatctgagacctatccagcacatggatggtatcttgatcttcaccagatgacctgaaaaaacaataatacaaccaaagcaacaaaagatcaggacaaatatgtattaggtaaagatggttagcaaagaaaccatgaaggatttattaaccagctgttcaagcacaacttcatacaaaattgtaatataaaaagcatgaacttcctaaatactcttctttgtaccaagcagtcctgaaagttccaaattgactggtctctatctaagagatggaagggcagagcttttttatggttttcatcttttcataagatcagctaaaaaagctcagtgttgcatagatatataaagataacctaaagagatacaaataattcttggtcatgagggcacgagtctaccatcataggcagtagtccatagagatgatcatttagataaataattcattggaataaataaaaatacaaaatcataaatcaagcctgctctccagggacaaataatctggtaaatttataagacgtaaagaagcatgtgcattgcacaaacttattgtgccatgcaaaccatatacttcctccgtcccaaaatgtagctacctagtacaggatgtgacattatctagtactacgaatctagacagcccccaaaaataggaagtgcatttcatatcaaccaagaaaatagttcgcctataataatgactcaactcatatattctatttatatacaaatcaaaaagagaatttaaagaaaaagtatatatacaactcatgtactctctaaatttctacatctcttctatgacaggacctgataggttaggggaaaaatgcaacatgctggataaataattacatgctggattgaaaccatttaaaatcaagcaacttgttgatttttatcttattgcagcagctacattttacaactcgcgaatggaaaacctcgaaatcattagaaaaactatttttattgagaaaatgattacctaaacaaccaacagaaatcaggaaatggacctaataaagtggatacccaggcagaatgtttccattcaaataaaaaaagaaatatcttgtacttatagagcataaaaaaacccaactattaccgagcaagcacctgaacagctccccttccatcagtcccagcacctcctttgctcccctcctagcttctgtaaaaaacaattttgccaatcagaactgatgttagaacagcaaaagaaaaaaaaactgagagaaggtcatggacccatccaaaaataataataatatatgatttgatgcttccaaatggttagccttggatcaatcataaggttgaaaccgtaatggtatggttgaaagcacaacaataggatcaaattattttaccgtatccctacgaaatctggaagggaacgcaaattagctggtggactaacagaggtagatcaggctcgctaacatctaatagtttgctcttgcatcgtagtcaaaatcaaataggcacaagaaaaataatgaactgggatggagaagaatcaaacttgccgtagagctctagacaccggacgtcagggcccggagaggatcggtgttggcgtgaaggcgagttgacgtgatggagaccgagcgcgctacagagactggcggggatagttgtcaggcggcacggcggcgatttgatgaagtcccgatggagagcggtcggcgatgggatcggcgaccacttgatgcggtgcaccggcgaccggcagagatggcgcgaggcggcgagacggcgctagggcgagttggcgcgatgggcagaggggccagatagggtggcgatgaatgcgcgagggcgagcatcgggtcggcggcggtgtcgatctgtgcaacggcgagggcgagcgtggactggcggctgctggggataggcggcgacctggcggaggtgaatcggcgacggcgcgacggcaggggagagatgagggcgtcctgtgtcggggcgatggagagcgtggcgagccggcgcccttgacgatggaggattgaaggcctcggtggcggcggcggcgcacttgacgacggagcgggaggggagagagaggcgcggatgcggtatgggagggaggtgcgggggagtcgcggcgaatgcggaagagagggagatgcgggagaggatgcgcggtcgcgccgatgcggcgtcgattgcggcagagagagacgggggtgcgggagaggaggaggagcgacacgcgcgcatctgggacgtctgatctaactcatcagacgattttacaccattggatgtgtgatatgatgaatgatgaatgagtaaaaccatttgttcaactatagggtgtactcacaaactagaggtaaggaaattgtttttattctaaattccagcacatgcaaaaaaacaggaaaaataatatcttctaatatcaatcaatcaaggaaaataggaaaaaaagagagaagaaactgcttttaccttcaattgaggtatgaaccaaggatgtctactggaaacaacaggatatgggcacaggagagctctgatcggcggggttacgcatggcaatctgctaaacttgttcaaattagcgaaatttctgagaattgaaaagaagctaagacatctattttcagttatttacttagagggtagagaagggcaatgcaaataaaaaactatatgtgcctaaaacatttcatcccaaaatacaccactgaatcttgtctagtaatttgttttctcatccttctccaattcatggcattactaaatgaagtttatcttccaaaaaaaatattgatcagtggttaattgggttagcttgttaacatgaaatcaacaataaaatgatatgattgggccagccctactattgaaaccaagaataaaatgatatgattggtgaaatggtctatttcctatgacatttctcaataatactaatctacaatttggctgccattccatgaaagattggaagtgagaaagcacctggaaagagaaaaaccaaatcatgcgaactcttagttccaaaaatgcatggttgtacctttctgatagtgtttttattttctggcagggctcttaataggatttgaacaattgaaaatggccatgcgtgtgcaacaggaaatgtaaattcagtatgaaccccacaatagatacaaaggaagaatctgtacagcaacacttctgaacatttttgaagatacaaacaaaaatataaattcagtacgaacccaataatagatcataggttagctcttgcaaagtacaagtacaaagaaaatcaaaggaacaaagatccctcttggaattcagaagatctactccaatattcagaatgaccaataataattcaaacagtagatctcagaatcagcttttgtacaatacataatatcattaggtttcaataataaattatcagaagaacattttttttcaaactaaacagtagaccaccatatttttatcctaactgaacagtagaccacaatatttccatttcatctttccccgggacagcacatgctttctctgatacggcatgaaaagaagaggactaatggtaaaatctaaaatttgcactggaaaatagaagtgaatttgacaattggcatcacacggaaacactttattcaatcatccagatccatttcaccccaaatccaatcattttacttttctatcaaccaacaaaacggtcgcagtgcacggcttcatatggcacaactacattatctagaaacatcataactcaaggaaacgtctatcaccttgagaagaggttgacggtgctgcataaatcaaaatatacatgtcacatttcagttaaaaaaagtgttctttcagtccaagttgcataaacacaaagtcaggaattgtaggattttgtaggtacagtttaatgtttcttaaagatgaacttacattcatctactcaaatcgtaggtaaaatctgaccccgacgcaagcacaattcacatgctatcttgcgtgcaaaatggaaaccttggcatggtagtgctcacatgctgttgacatcaataggaggaatagagagcaggagatagagtaggtagtgttttacctgtttagtaaatagtcttagggaggtgagtgcgccatggacgaggttgccggtggtgtagtctgtgccacgtgaaggattatcccgtgccagggcaaggcacagagtatcttggcaacagatgcagtttcagagtcttgacggcaaatgcagttacaaatcgcggatcaacagatgcagtttatatagtcaccttgatatgccttaggagatctttcttcaaagcctaaatcccagtgacgctgacctatttttaacatttacctcatgaggaaaacaggaatccacaaatcaatgcatacataaagcgaaagtcaagaccaaggacaacactttaggttttacatcaacttattaactcgcaaataactacaaaaggtgcatgcatgcatgtagattttactctaatctagataccaaagtgttgcatctgcattttctgtcttaaaatgctttctttttcgctgaaatagtagccactgatgcaatacaaggatcatagtggctccctggttctcacttcctagtggggccctgcatttcaacaacgtcatgtcctaactcctgatcttaacaattgtctaaaccatcttatcttgactgctgggatcttacattgtgacacaaaagagagatatcattatattttctttaaatagcaaatatggggtaaataaatgaataaagttcagaagtgacactgccatggcacaacccacagcagacggtcgcccgctcgagggccgcctcgcactccatgacgaggaaccactactacggaaatcagtataggtgccggttaggaaccggctatagatgacggtttccccgccggcaccaattggtgggcacctatgccggttttagaatcggcacctacagagattatagatgccggttattacccccaaccggcatctatgggttagggattttttttttaaaaaaaagcgtctccaaggaatataggaactgaagcatcccggtgatctcaccacaatcagaagcaaaaacttactccaaggaagcagaaacttgtaccatctcacaacaatctcgaacccaaccatacatacgaagtagaaacataccactaatcatcaatctgatgagctgctgctcctcatgaacatcccgcgcttacgagacgaagccctcctcgcctaccagggaaccccacctccagatcgatcgacagggcgtctagacgtctgtcgctagcggcacgcaccctgaatgaaaagaaaccaaatcagagaaaaatgaatccgcacctccgccgctagcagcacaaaccatgaacgaacaaaaaccaaatcagaaaaaaaaaagaagaaatcccttgatcataagggtgcacgcaccttcgtccctggaagcacacctccaccaattcgcctcgcccatgcatcaatcgatcagcctcgccctgagcgaatcccacgagtcaagagatgcggcagaggagggattgctacgaggaaaataggagtaccttcgattcgactcgaactgagacggagggcagaggcgggaggggctcgtcgctggccgtgcgtgggcgtgcatgacgcgggaaatttaactatttgccactcttgtgacatggcaattaacgatttgcctcaccctgtcaatgacatgtgggccctcatgtgtctatgacatgtgggcctagtggcaaatcgttaagcaacatccgtaagagtggcaaatagttaaaagccccgcgtgacgcgaggaggccgcacagatgggaggagaggagtccgtcgaacacctcgcccgcgaagggagaagggaatggggccgcctcgccggcgacgagcgcgaggggaggaggccggaaggggaggggagccggagggggaggaggaggggagggcggtgacggaggaggcgagggggagggagccggaggggaggggagggtgcggcggaggagacgaggggcgaagcgaggaagagtggaggtgcggcctggcggtgatctgacgacgggaggagccagaatgggcggcgtggcttcggcggcggtggcgacctggcgacgggaggaacgagaatggcgagtttttttttccgggataatcgcgagatttagggcgaccgtggggacgggagttgcggggagaggagcgcatgggtgggtgcgggagggaggagagggatctggttcgttggattccgcgcgcgacgggaagacgacggaggacaggctcgcccttaacgggcgtttaccccatcgccagctaccggcgaggcgttcctcctcgcaggcggattattttcctcccgcaggcacagaccggcgacgtggaggcgagggattcgggtggagggcgcggtgggaggggaggcggcgctcgatcgtgacgcggaggggagggatgcggaggaggtgcggcgaatgcggaagagagggagatgcgggagaggatgcgcgatcgcgccgatgcggaggaggcgcggcgattgcgtcgattgcggcagagagagagagagaggggggtgtgcgggagaggatgaggagcgacacgcgcgcatctgggacgtccgatcttaactcatcagatgatttttgcaccgttagatgtgtgatatgatgaatgatgaatgagtaaaaccatttgttcaactatagggtagctttaaatggttttactcattcattatgctttaaatggttttactcattcatcattcatcattcatcatgtcacacatccaacgatccaaatccatcatatcctatagttgtcaaattaatgagtaatgagtaaaactaagatataatgagtaaaactaagatatataataaattaactataaattagatataatatgcccgtgctaacgctacgtgtatgtttagtaatagaaatcatgacacatggtttggtatcaagtatctaatatgataaatttaatatttaggaaaaaagaactacggagagagtttttatattgttgctaattatatagcctccaaaatataaaatcacaacttttgtatcttaggaatacaaacaaaacatattgcctacaaataatacaaaccaaacttcattttacaaggagaagtgttttgattattttataaattatattaatcaccgagacaaatttcacctaaatggaaggatataatcatacagaaatgaccttccaaagtttgaggagtcattgtctagctcaagtataatcataagtaacaagaaccctatctgaaccaatccacgtgccttcgcaaagcatgttagatagtgcaaaagcattttttgtcattctgcataataaattgaaatttgtcatttatgaattagtttatagaacatgctgtaaatttgaaccgcaaatgtatagagtataaggatataccaactatcctgaattctttcaagtgcatgcaatcctataataaaccagatattaagagagttagtatttcatcaagtatttgctactatgattatcttttaaaaaataaattgttataaaatggcagcaaacctttagcagtactacttcatgctttgtaaaattagaatatacttgaatcaattcagatgcttcaatggctgatgaatttttcatgcaaaattctacttactttcggttatgaagaatatagatagcacttaccatcaccaactggcttgccatcccatttgacaatgggcagaaaaggatctgactgctgcatcccagcacacttccttgctcgctggtcatattaaacacaccggcatccaccatcctgggcaccggtgctgcagccacttagccatttacctagtcacccacagcgttgaacgccagcaccaccagatcaccatcgcccgtgtcgaacaccacgttcatcatcggtccctcgtccatatccctggcctcgatgaaccacaccaacacgcacacaccgtggacctctaccaaatgtgattctacctgaccaaatcaagaacccacttcgagtctaaattcagtaccaacaagctcatgcagttgtatggcatccacaaatgattggctcccttccatcgatgtcaacacggttgttcccctcctagcttctgtaaaaaagataagaaccaatgttgaaattcaatcatcagaacaacaaaaaccatggagtacaatataacagtggaagtacagtaaatatatatatgcttaattctctgatcccatacttcccctgttgtcacatcaataaagtacacttgatgatttgaaattcaaatcgtcatatactgctatacatgtggcaaatgtgaaaaaatcactgaaagatcaaaaatctgtttttggagatcttaacaaatgtataatcacacataaatgttgaattgtctcaaataccctagaaagaaaaagatgctcccacaatcacaggcaacttgtccaatctgaaatctacttaaatcggtcaccaaaaagaacatggcaatatgttcagatcaacctaactttaaatgttccacttaatatgttcagatcgaacatcacagtcagtatgaaatgttctattgtgggagtgagaagattctgaaaccggacagcagaagaagcgagcttgccatagagctttggaaaccggcagaagaaaggtaatattacaaacttgccttcgccgtcaacctttccacaggcaccaagctccctgaacccaccatacacacctgtctccaatctgtttcagaacagagaagatggaaaacacataatcccgttctctctcatgagtgcatttaaattcttattagtgcaggaccaataggctcacaaaaaaagagggatcccacaattcgagctggattgcaagaaggaaggaagaggattgcgtcggatcggatcgaaccagaatttgaactccgggaggcgacggacgaaagggcggaactcgtcagatgtgctgatggggagcacgggccccccctcgccgagctcctcggcgacctcggggtcgtcctggggcgagaggaaggcgatgaggaggttgaggatgtagatgccgagggcgtaggtcacgatgtagcaccctcccgcgaaccaggcacgcagcacgtacgcggtcgccaagccagcgaaggccagccaccgtcgcgcccgcggaggagatggcggccagcacggcggcggcggaggaggaggggtccatcatggcgtcgggcggggcagaggcggcggcgtcgggtgagtgcgacagagatgcgggaagagcgagagagagagagagagagagagaggagggcggaggcggcggcgtctgcgcgtgaggggatggatgcggccgtgcagggagggaggggagggtgagggggagacatgggccgatcggaaccggcatattcaagggatttggaccgtcggatgtgtgacatgatgaatgatgaatgagtaaaaccatttgttcaactatagggtagataaccattattccatcgtgacagtgacataatcccaacggaacgggatcacggagtctaactggtctacatccgcaatgtttgtttggaggaaatgcaagtagtagttgtttcccatccttagtgctatatatttaacgtataatgtgtttatgtggttatgcaaatgtatgacaatattttgcgatatttaaaggtgcatgggaatggttttcgataccaatgacggttcaatgaggaggatcacacatttgtgtttaatgtgtaactttcatgtttgatggaatggttatagattggcttgagtatattttatatgcgacatgaattgaattataaatcatttggattgattatgcaaaaattacttttgctaagagcctatgatggaattttattactttataaatataatggcgctgtagcgttagcacgggcttattactagttataggtaggtagatagatattattgcaaaaggaaggtaaaattgttgctcctagatgcggcaaacctcttgtccacacaccatcttctcgtgcattccatttctcttcgagtaagtgttgaagtccttatgtagattcagcaaccatagcttctttaaggagcgaagaaactcgatgccttccgatacttttttcacaatgtgcaaaccttcaatgtgtggaagggcttcagcttcgacctccaccttgttgacatccgacatatgcatcagcacgagtgtcttcagcactggaaaacaccctgcagaaagaatcaatgtctttgcagtattcgccttgtttagttttagaaaagtgaggtatggcacatgttatgctagcagcaatagtagatcttcccaagccgacaccggcctagagctaaatatttgagatttctccgacaaccctttagaaaaattcaatgtcttcctacaatagagagaactgttcccatggaatatattatcgattagttgtctctgatatgctaaaaaggttttgaattgacagtatttcataaacaacatcgttagtcgacatgatttagaattttagggatgtatcggagtatgtgacaggaagagagttgatcatgtcgacattgcttcaaacatatacatggtttatccattttgagaaacaaaaagatagtaataaaccctctagaaagctaaacaatatgatgagatggtatgtcagtactgattcttatattgaaaggtacatgcatgtatggattatagcatgtagtttacagccttatacaattcaattggtagatccagcatattacatgaaaatattatatatcttccaatatactcccaagagggactttctcagaggagaaagccaatgtttcaggattatttaaaaaataaaaaaatagcatagcacattaccaaatactccacaaatctattgatagcacattagctaaggattaattgggcaggacaagatgcgttatttagtactgtgcagaggcatcttggcacgagtacgtgttatgcagaaggaagagtaaaatatgtcactcctagatgcggtagagctcctgtacatgcgccattttctcgtgcattccattgctctcccagtaagtgttgaagtccttatgtagatgcagcagccatagcttcttcaaggagcgaagaaactcgatgccttcaggtacctttttcacattgtacaaagacacaatgtgcaaaccttcaatccgtggaagggcacggtcttcgatctccaccttgttgacatccggcatgtgtttcaaaacgagtgtctttagctctggaaaacaccctgcagaaagaactaatgtctttgtagtatacaccctgtttagtcttagaaaggtgaggtatggcacatgtgatgctaacagtgacaggggatcttccccaagatgacaccagcttagagctaagtacttgagatttctcccacagtcctgaaatattgggcattgcagtgtcccattggcccagtgccctctgacaattagcttgtggagcctccctgaaataggctcgagggttttgaaacaaagcgtctcagttttactacttgcggaaagaagcagggttgaaagaagtggcatatttgatagtgtagaaaaaagaactgcacaatcaacatcagttatgttgtcaatccacacgcttcacagttgcgtaagtttcttcagctgctcggccaaatctttgctggcttccacagtttcgagtgtctgcaactcttctaagttggatagctctttcggaggttgaactccagtgaagtaccggaaatctgaatgcttctcatcagcacatttgtcagctaaaaggtgtcgtagcttcctgaccttgacaatccctcgtggtagcttctctatttttgtctgcttgatgtctagagtgtggagattatagagtttctcaattgtctctggaaatgacttgactttggtgcgccttaagccgatatatcttaggttaaacagattccctatacttgttggcacttcagtgatttcagaatcttgcagctcaaggacagtgaggtaggtggattcagagaaaattgaggacaacatgttagaggaggatgaaattgtttgaactgatattaatgttcgaaggcgaggaaatttagctttatagacacctttgtcctcccaacgacacattgacaagcggcggacttcattatccatcagcatcattgtgccagaatcatttgctgaaccaaatctctcatctttagccacaaaaagagctagatcacgcataatgtcatgcatcttacaggtactaaccctaccaagttcatctgtctctaccacttccagcatattccggttgatcagttcattgagatttccttcagccacgtcttctggcgtgttgttttcttttcttgcagcaaatccttcagcaacccaaagtcgtacaaggttgtctcgtggcatggggcaatcctcagggaacatgctgcaatacaaaaagcagttactgaggtctcctggtaagtcatagtagcttaggttcagaattgcttgtacatgatcactctttgctagctcgctctgtagctgattgtatgtttgcttccaagcatgctgtatcggctgctttgaggacaacaggctcccaatagatacgatagctagaggtaggccttgacacctatcgacgattgaattagccaactctagaagttctgaggggcaatcgtagtccttcctgctataaaaagcccttctgcagaagagactgaatgcatcgaccttgtccaaaggttggagtttaaggtgacgtgttggtagagctagtgctgccacatgcttactccgtgtagtgatgatgatgcggcttgcctggagattttggaaggcatcatgtatttggttgtatgcttctctatcccagacatcatccaacactatcaaacaccttctatcacttatgttttctttgaacttctcttttaagtcatgaacatccataccatccaagtgtgcttgatctgcatatccaatcttcctgagtaccttcctcagcaattcttctacgtcataggtctgtgacacgacaatccaagcatgagcatggaacctgatcttcccacgctcatacacattggcaacaatggtagtttttcctaatccacccatgccagatactattatcactgtgctatctagttcatttgagtacaaccatccagtcaataacatcctgttgccttcgatccccacaagatcttcatcctttacgagctctggcaagcagccttgtgaccgctttctttcaaaatcagaatgtttattacggataagctgggatggttgcagccatttatctttcagctttataactctttggatttcctgctcaatctggactatctcagcaacaattccatcgaaaacaatggcataatgtgatcctttgacaacgtactttttcaggaacccttcttcctccatttgaagagcatgatatgagtatttgtccattacatcctcaacatggtaggccagctttcgtacctccgcaatccaacccttgataactttgtcagtgagatgtgctgtatctagttgttctatgacattttccattgttgttagttccattcttatttcttcaaccttccccggtaactccgccaaactctttcctttctgatatagcttggatactgcagatttggcaatatttgtgggatccaatccaaaagtactattaatctttgatagagcaagaataattgcttctgccatttgtgctgaggaaaaaaaaagttcatgttacacagtgcaggaacaagattcaggactcagtaaaactccatccagccttcttgcgttacctaattattaatttcaataagtagaaaatcaaaccatcatatagcaaatcaaatatatatatatatatatatatatatatatatatatatatatatatatatatatattaaaggaaaatatccgatctaatgcgaattaaaaaaaatcaatttggtaatttgttgtgtttcagacaagaaacagaccaaatttgcagtttcggcgaatgaaagctaattaacaagccagataatatctttaatacaacatttagattacaaatatgaaataataattttggatttgaaatccaatagaacccaactgcaatgaaggtgtcagctttatgtttacaaaacaacaattttcccaccaatcaaagtaacataggagatcaatctttctccagtaccttttcttttgttataaagctttaaatctgtttggaaatttattattttcctgcatgttcgataaatcaattggacattggacttttgatactcctaaggacgttattagagatactgatagtatgcttccaaagttattttatttgccagatgacgtgcaggctatctattttgcatttctagcaggctgtggaaacaatggaataaatgatgcaaattagaaatgggttttcattttcttggatgtctcaacaactagagttgcattttttataaggaattgtataaagaagttgtacttgctatgggcctatgggtcttacgtctaagatcagctactgtagcactactagttatactcatccgccatactaagcaccagggaattagcctaagaaattaggtcagattggttaatgttatagtatcgtttgtttccatgatgttagggcatacattgttatactcactacaacaaaaacctcgtatagaggcacttttgtagaggcattttgtaaattgcttctacaatcagaagttttatagtgtagagacactttaaaaattgcctagaaaacttttactctagagacatttttatatcagtttgttagattttatcttgtagaggcattctttcggcactatgaaatgcgtctaatatgtaaaggcattttgttgagacattttaaactatgtagagacactttttagaatgataatgtgtactaaacgactaaatataagtaattaaaggaacaagtatacaagtaatgacatggagttgagttggttagtgtatcgaagattaaaatgatttaaccaaaagatcatgagttcaagacttatcaaaagcaaggaaactattttattctcttttttggactggttttatatgtttgcggtacaatttagtgtctctaaaaaatgcctctaccatcttatagacattttataaaatgtctcttcgtttgtagagacaattcaccataagacacttattagacattttttaaaatgcctctacattgttgtaaaggcatttgataagtgcctctacagtactagaaaaatgtctatacagagtatttttcttgtagtgtactatttattagttgggcgtgctaagtagagcccatggtgctacgtccttacatggggccccatcctcacacaaccatatattgtcttgtcatgccccagcaaacaataaggctgtaaatgactaaatacccatctatgtaaataagaatagttgaatgcatcacacaagtgtaaatcctcattgcttttcgaagggcaattattggtcctgaattggtagcttggcaagatctactgcccaaagtagctacgataaatcttcaacaacatggacggtttaaactattcaacgcgttgagctttgatgtactgcaaaaattccatattacatcgaacaactttgtgatactttatgaaacttgcaaagtagagttgttttttatggtacttgtgaaaaggtgttactccaaccaaggatagttgagtgaaaaggagatgacgaggtagtaaaatatgttgttttcatggtgctgatgaggctacacaacactctttcattgactgtaacagtttgctactagttttatttggcagactattcatatagtttatggtttacagccacccaaaaacattgatcatattttaggaactggattttgggtttggataaaaaaaacaagatctaaggtttcagcatgtgctaatgatatgttgggtaatctggttaagttgtaatcgcaacgattcaatcttgtatgcaggatatctatagtggacatattggctttgttattggtcattgctaaaaaatgaggatgagaaagcagaaatcaacatgggcttgtggggacatatatttgctaattaacactctaccggaagattaaaacaaaactttgaataagaaaaaaatttcgctgcatccaagagcaataccccgaatgaagctggtgccagaggaaggaaaaggacgaatgagttaggtatctgcagccattggcgccaggtgcggcggacgctcatccggctaaccccgaactccaataccccgccactgcaccgagagtgtgcataagaaacatcgccgcgagccaggagggctcggcacttgctacggctgggccgagaggaaggggggcacagctgattcaccgtgggggacggcagcagcaccaacgcgtgatggggtgtccaggtgagcgccgccggtaggcgctattttagctcgaggagaggagacgacgatgcggaacatggtttttgactaatttccaccaaataactgatatttttttatgagtggatgactacggggaccccaagaactgaactagtggaagtttctgaaattgcagggtgaaatttgaaatcaattatgaggtgcatctcaatactgctgcaaagtttagaatcctaaagctttggattttttttttaattttcactgaaaaaggagagcaggaaacgtcaaatgctagaaatgtcctggccacactagttatattatcctcttcctcatgcttgctttccattttcttgtgagcaatgatttgatattccgtggagtcttgtcgcgtgcccgtggtgccaacgttacagcgatgaaggccggtggctgacgaggagggtggaaaaggatgcagttgcatggcacagtcaccgtggggaagctgggttggtagcggtggctaggtagggtaacgaggatgtgggtgctgtggctgcttaactgttactcaggtgtaccgagacgatatccatggaccaactaccataggtgcaggacctgcttctggagattgcctaggtgtcccggtttaggtcatcatctgagaatgtcacagcctacttggggatgaattgtgcgcacgtgggctaaactcatgctaggggcctactcgccgattgcgctccaactgcttgccgtcatgcacagccactgcacctccggagcacattccatgcatacaacgcactctcgccgcttgtcaagttatagtatgctt

SEQ ID NO: 75209 - DNA, 36728 bp, Oryza sativa
  unsure (1)..(36728): unsure at all n locations
cacacccgcacctgcgttgcagagagagagagagagaacgagaacggaggcaggcgcccacgtcagtcagtcagcatcgagaagaagagaacagaagagagaagagccacgcgcgaagcccggcgagcgagggcattctactaccgcggtcccagaggcggggcgcgaagcggggcaggcgctggttgaggacgaggagcgcgtaggcggcgccgtcggcgtcggcgcccgccgccgccgcggacggcgagggcagcaggaaggcggaggagtgggacatggccggcctcggggccatggcggcggcggcggcggcgcggcgacggcgagggctggaagtgggtggcttcgcgccgatcggggtcggggagggtgcgacttgcgagtcgtgggctcgtcgcggtcgtgcgagctggcgtgttgaatgggcagcgcgtgtttgaaaatttgggtttttggtcagaggtgatgggatgatgggattgtcgtaccgctaccggagacttccggagtccccacttgtagtacccactggtgtgtggggtccactgcatttaacatgtgcaggtcagctgcagattgtcacgtgtgtctcatttaatgtaatggaaaaattgcaaatccaccttataagtctctcatattacattccataattcatcttgttgtaagggcctgtttagaaggaggcctctcgtagctttttccagttccggccatccatccccgccggaggtgaggttgagggcggccatgcatattctgaaagcattgtcgctgctggatcagtgaagtggtacggggagtcggtgaaggggtcgaactcgtcgacggaggcgtgtgaatcggactacgacatgaagtccctcatgccggcaccggcgccgtatctgtccccgtccatctccgccgatgcgggcatgagcggctgcggcggtcgatatcggcgaaggtggaggcagaagagggcatgagcggcggtgtcgaggatgaggtggatatgagcggcggaggaggcgggcgttagtggctacggcgggcgagattagaggcacgggtgagctaggttggaatggggaatggaacgagcgggtgaggaatggagagagaaaggggttgggtggggaatggtcggatggagagagagagagcgagcgtgggcatcataggtagtgcgcgtaccgcacagctcccaatgatttttccaaaatttgctgctctagagtcccaaatgatagatgtcaaattgctaacttttgctactaatgtttagatccattttgacaaaaaaaatgctccaaaacaataaaacttttgccattttagaggaactaaacatggcctaaatactcacccacctatttagttttttttttctaaaaaataccaccacattgtgcccgcacttaacctaatcaatatgtttttttttataaaatgtgagccatcaatgtggttttcaccaaaattaaatacttccggagtatagtcttgaagctttgttgaggattctacaaatagaattgttggtgagagcttaaacattatcgcactgagttttactatatgcaaaagaaaaaattcaagcaaacatgaaaagtattttgcaagtacttagacaagattgactcagctaacttaacatgcggtgactctacatcagtgataacgtgctgattcggttaagcacatacgaagtggggtggtttttcaataaaactaagtatggtaggatatttggaacaaaataacttatggattggaatgtcgaaattcaaacgacttatgtgaaggttttgcaattttccctttaattttggaaaatggaaatttacagggaaaaaaaaccacaagtcaatagaagttttaaattttatcccataagtcattttgttgtaaatgctcacctctatttattcatgttgcaaaaaccatccagtctgcacgtgcttaacaaaattaatatattttcataaatcgtgaaccatcaatttggtatttaccaaaattaaatacttctagagtatagttttgagaactttgttttaggttccagaaataaaattgcttatgagagcttaaacgttgttgcactgatatgcacaaataaattcaatgaaacatgaagaataattttaatgcaaacacttcgacgagattgactcagctaggttagcctgtgatggctctacatcagtgataagggaatgatttggttaatcacgtggatcctgggacacttttcacatacttgcaacaaattaaataacttatgagatgaatgtcaaacttcaaatgacttatgatgtggttttacatttatcccttaccaaaatttagacacagtttggttttgattactgaatggattattatcgcatattatttacttattttactaagactgagtttaaaagtgagtttatatatacatttctcaacagctaaacgatacaaattttacaaatagtttttgtataagtttctttaagaaaattaaacaaactcatttccgaagtttgtccctagtacttaactaattatgagcaatgactcaattgttttgtgtggaactgaaatctacgccacacttcaacttcaaacttacataagtaatcatgtatatgtaatgtacttttttaacattacatatggatcatcttaacattttgcagcagaaattgtgtatgcaaggcggttccttttcatccaataataaaataaagaaattcaagctttatttttatttccagtaagactaaaattggagaaaaaaagacaacatattatggcgtacgaccagagtacaataatgcacatggaataattccaggtacaaccaaagcaaaccagtacacacggaattatgatgaagcaaagaaataaagaagaaatatacaagcttatagttgagtcaaatatataatcataaatatgcaattcttccatatagttccaaccagaagtacattgttatatgtgtcccttaatccccttttatgactttttcctatagaatccacaatgatgtatgacattaatgcgatatatatgtctaaagaaggggggccttttaagatcatgtgccactaaacatggatacaccctcaagcacataaggaacccagcatgcatatggataggactaccaagttcgaaccggagatgaccaagactgctcagatgtttcctaccatgatatccagacataagcctacatcagcctcatcaagttgatatcttgagtaaccccacaatcctccatggaccgcatcacaaaattcccatctctcctgattaggtgaatatgcaatattagagttccattcacatacttgtactcggtgtgatctccaaggcaatacctacaaggagtcaacggtattatgatgggtttagcggtgttggacttgaagttgtaataaatgaaggataaagttagagtcgaactttgtcatacgctttatcttaaatagagaggggggcaccacattgtacaatggtgactgcaatgtagcgtagacaagcaaggaaatgatggtggcgaggccatgaactcgtagcggctaggtgatatattgattagggagaagtgcccatgaaaagagtctcaaagatgtaggtttcgactgaacttcgttaacaaatattgtgtgttcctgtgtcgtcatctggcgtatcttgggtgatcaataaccgaggagatcgagaaggttagtcactatttcgctatatcgactaacttttataataagtggtattagagccgaaagtttcagaattgtggaagaggaaacacgaggtgagatcatgcattgataagagatcatcaaccgtggcgatgagatcgattgcgacaacgagaacgttgtggaggcaacgacctcccttgcgattagaccggcgatggtggaacgtggccgaaagatggggtcgggtgtggctaaaagcaaccagagagatcggatgggtagcgccatggacgacgtgcccaacacacacggtggtcgtagatccgtagcagcagggaggctatagcagaagggcgaagccggcgagcgtggtgaggcacagtggacttgcagggcctgaggacgacgtgatcgtggatggtgaacacaagcgttatgactgcagtgagtgcggaaacacaaacaacacatatggagaatgtgctatacacacgcaggatgagcaaggcacaaaatggcagttgacaacaaacaacgtcgtgtagcacaagcagaaggcagaccatatgagatcgaaatcggggcaatgttggactcatgagcatgaacgcaagtccgaggtggacttgtccatgcagtggccgggctcgagttggaagttgttttcagactcacaaggcaacaactattctgaaggatgagcaaagagtgcacgagaatggtctagacttgttgacgcaagggtcaaggaggatgtggatgcgtttgagagcatcacaaagagaagaaaataatctcttttttttcaggtatattttccaaactgttaaacagaaggagcattaactgcatgcacatgtgcaagtgcatggtgttgtgtagtggtgcatgcatatgaggcttggcaaaactacgacgttggttcacgagtaggactagcacagctagttgagttggattaaagtcaatatgagcagtggactaataagtatttggtggcatggacttgggtgcacttggcgactcgatcgtgtggaagatgcagcatggtaaaggagaggttccgcgaattgagccgtcttgcagcgtagaggcagatggtggcatatggtgtaggcaaggcagttgcttgaattggactcagggcatagccaggatgcataggtactcggacatggctaggtggatactcgatcggttgatagcttgatggaaatgatatatgcctaaacattgaaatcattcgttgtttgttattacagtgtacactactacagaatggcatattggtgtcggttgggaaccggtcttagctgccggatttcccaaccggcaccctataggcggcatagatgtgggggaatcaaaggggcacctttgaggttccaggattggaaaaaaggtcggctcgaatgcatcgagccgattcgagccgacactgattccatcaagaacacacatgaacaaaactttcaaccaagaacacacacgaacacacatgaacctccgctacctccatgccatgcaccgcgcgcgcgcgcgcgcacacacacagagagagatagatagatagagagaaagaggtggcgccgtcgccccttcaatctccgccgggcaacagctgcctccatgtcgccagatctagcggaggcgaggcccggccggccgcctccacgccgtccgggccgccgccccctcccgcccccgctgagccgtagccgcctccacgctgctagatctggcagaggcgaggtccggcccgccgcctccatgtcgtccgccgccgctggacctcctctctcgtccgaactggcggaggggaggttcgggccaccgcctccacaccgtccgccgccgccgccaccgcacctcccctcccaccaccaccggagagagagagagaggagaggagaagccaatagaaggggagaagtggatagagagagagaggagaggagaagccaagagaagagaggaggggagaagccgagctcggccttatctcctgcaggtgtgggtgtgggccccaccgggaggaaaaatatctcccttggctggctcggctcgattttatcggtggcacctataatatatggtaggtgccgttttttttaaaaacgacacctataatatattataggtgtcatttttttttaaaaaaaagcgtcacctattatagatgccggtttttctctaaaaccgacacctatctccgtttaaaggtgtcggttttaatttttttttttcatcttatgaaggtgggaaaagcactataggtgtcggttttaccacttccggcacatatagtgccgacatctatttgatgttttgtagtagtgatgtattagtgatttcctttcgtagatttctaaaatcgagatctttgatatcaccaaacaaattctttttatttggttttcatctggaattcttgtttactcccttcttttttaattataattcaagccttttttactcaaggattaagaatggtgtgaaactaagagaaaaggaaagaaaaatgaccatggcatcgctatatatttaaataaatcatttctaaatatagctaagagattatgctccacattaaagtagatcagcataagttctaaatatagctactacatttatcccaaaatttagtaatatttagttatatatctagtcatagctatgtatttggacttatgtatgtctagatacataccctaaagttattatagttcaggacagagagagtaagagattatgctccacattaaagtatatcacattttccgaaagaccaggaaacaagggcagctaagataagaaggtaataagaatagcttatctagacagtatatgtagtaaaagcatacattgatgtattgcctaaacatattttgaggatacaaatcaatgcaaaagattaggatatcataacaatcctttgagatctctatatatatcagtttgcgtgagcacttcttgcttacaacgaaacataggaagatacatacaaagtagaagaaaaatggcatcgatgtcctacttcatcgttgctatgctcatatccaattgcttgggtttcattgcaacaccaattgctcaagttgtaggtagcagttcctcctcgggtgttggtggtcgaaaagttttatctgcgggaggtttgcaccaaatctaccaccatggaggtactgttccaggttcgagtgaccccctaggtcctccaagtgatgagatatatcatcatggtggtaccgtcccaggtccgagtgaccccttaggtcctccgagtgatgagatatatcgccatggtggtggccaccatactaccccgggcccgagtgaccccataggtcatcctccgagtgatgagatatatggtcatggtggtggccaccacactgcaccgggcccgagtgaccccatagatcctcctccaagtgatgagatatataaccgtggtggtcatcacactgctccgggcccgagtgaccccatagatcccataggccctcctccaagtgatgagatatataaccatggtggtcatcacactgctccgggcccgagtaaccccatagatcccataggccctcctccaagtgatgagatatataaccgtggtggtcatcacactgctccgggcccaagtaaccccatagatcccataggccctcctccaagtgatgagatatataaccgtggtggtcatcacactactccgggcccgagtgaccccatagatcctataggccctcctccaaatgatgagatatataaccgtggtggtcatcacactgctccgggcccgagtaaccccatagatcccataggccctcctccaagtgatatataaccgtggtggtcatcatactgctccaggcccaagtgaccccataggtcctcctccaagtggtgtaatatcatagtacctgattagacattcctcatatattagagatgtacaacactgtttttcagattcggactattgtaaccgtgcatctccaactcatgccgaaataataaagcatatcttcgttttcaattttctcttgatgttctactgtttcctccctataagagtgactacttgtatattctacttggttcctgctttatacacatgatatatattttcttcttcgatgtattatctattgtatttcagatatgctaatatcaaagtgaaagcattaatatattatttttatttatattttagcataaagccaatatcagtgtcaacacaacagctgacttcattcgcatagtatttcttatgatattagttggggtaacacctttatgatcaaattgtcttgtactcacggtgcaaacgaatcttttttgataatggaataaatatcgaaattgctaaacttcagtcgacagaaaacctacctccaaatcttgcaaattttggttcactggatgtgcttcgcgattcgtgcttcagctgcttcttctctaactccgatgaactcctcttctccgacaccggcgacaacccgaactccggcgaagggccgaagaattagggtcccggagtggggtggggtgggaagggtgggagggggagaggaataaaaggggagtgcgtcgggcttagagggatggctgggggaggcggcagcccggtggtgggcggcggcgaggcgccggcggcggcgccggagtcgcggggttgaaggacggtggtgggccggcgttggtggcgggggcatctccccatcgacggctcgaggaggaaggaggggggagggggaggaggctagcagctaggggggcctcgccgacgctgttgacgccctccggccagccggcgaggcgggtggcggcaggggatcgggcggtggcgacgtgcgagggtagcggcggcggcggaatgcgcaaagaggtggggaatgggagaaaaaaagttagggttaaagctgtgtacgaatcctaaaacatatctaacggtccaaaatttaaaagatgagaggtgggattgtctgtcatgtatagacagtcccaataaatattccagtatctcgggactagattggtggtctggagattttcatagaaaaatacctggcactgagatcgtagcagggtagtattgtttctcgagctccagcagtaggttgttttttcttttcatatgtacaatatgctctgtagcaggctattatttatttttccaacattaatcggtgttatttgtcctaaatctctcccactagtttaattttgtttcgcaagaattcgcaacatccgttgtgaaaatatcaaaagaacgaggctttgcccatggataagattatatcagatttttcctcccaaagacatctgttcacaatcaagttctgcttatctctgtatttctcccgattaaccaagtcatgttctatatgtgctctggaggccggagctattgttaaaatgattctcgactccctcgctttatggattgtctatttcagtcagtccttaaataaaattcagttcacatgttcaatccgtcttgaatatattgtgttagcatgccgaaatgtagatgatgattttcgctaagagacttctggatgggagcaaatccctcacgcatggaaaacagggcgatctattaacacgtaattaagtaagtatgagcaaattattttttaaaaaatagatcaatatgattttttttaataactttcgtatagatactttttgcataaaacacaccgtttagtggtttgaaaagcgtgcgcacggaatatgaggggagaagttgggaacctgtacgtgttgccgaacacacccttaatgatgagttgatcatatgggtccgtgaaaattacatcatacagttctcaggtttgttactcagagtttctgcagatgttccgtttggagcctgctggacagagcttcctggtgcagattatgttttgtttgaatttggtcaataagagttataatttgaaattttggattgaccagtgttttcaatgcaaatccggttcgatttgagaattaggatacatcaaattgttatatatgttttccttttcttcccctttctgttctgaaaacaaagggaaattgcaagactgccagtatcggaatgactgaggctttgctttgcttttcagggctacatgtgccgaatagcttgttaggattggcagtaaccaaacaactaatcgggtcataaacacaaaccattgtcggttatacgccctcatatgttcagaaaatcttcataacattgattgaattgcaaatgtgcagaagctagactaaactcttccactatcttaaaaatatatgaaatgcaagtaagtagtaaatatcactactcccttcatctatttttaatagttatgttttcaaatctgaaaaatttatttgtgatagtcatatttcaattcaacaacggaacaacatatcattttaatgactttctcggatttaatgcatgactctccattcttacacacaagtaatgaatcgcttgtttacgaggaatgactagcagcatgtttaaatggatgataagtagaacggaattgcttatcattggtctgtgcgtcaagatgaaatattactatcaaaaatagatggagggagggttattatctgcctataattttctacagaaaaaaaacaacaaaaataaattctagctagccggcggcctaaagctcatcgtgatcgtcgtcgccgccgccgtcgccatctcgccgtgagccgccggacctctggtacaccgccgacatgaccgggttgcacacgtcctccagctcccggagcttctcctcgtactcctccttgccgacgtcctggttgccgtcgagccactcgtacgcctccatcaccgccgcctccaccttctccttctcgccgccgtccatggcgcccgccatctcgccgcccaccacggcgttcttgacgccgtagacgtaggcttccaggctgttccgggcgccggcgcgctccctgtggcggcggtcctcgtcggcgaactcctccgcctcgcccagcatccggtcgatctcctcccggctggtcttgcggtcgtcgccggagatggtgatcctctccgacctgccggtggccctgtcggcggcgctcacgctgnnnnnnnnnnnnnnnnnnnnnnnnnnnnnnnnnnnnnnnnnnnnnnnnnnnnnnnnnnnnnncgcgatgccggcgaggtcgaacctgccgagcagccggttgtcccgcgtcatgctccgctcgccctcgaacaccttgacggtcaccgtcgtctgcttgtccttgtaggtggagaacagctgcgccctcttcgtcggcaccggcgtgttgcgcgggatcagggtggccatgacgccgccggcggtctcgaggccgagggtgagcggcgtgacgtcgaggacgaccatgtcgcgggttttgttgtcggtgtcgccgccgacgatgttggcctggatggcggcgccgtaggccacggcctcgtcggggttgacgccctggttgggctgcttgccgccgaagtagtccctgagcagctgcctcaccttggggatcctcgtgctgccgccgacgaggacgatctcgtcgatgtcggcattgctcagcctggcgtccgccatggccttcctcaccggcgccatcgtcttccggaacaggtcgttgttgagctcctcgaaccgcgccctggacagcggctccgacaggtcgacgccgtcgaacagagactccacctcgacgcgcacctggtgctggatgctgagcgcgcgcttggcgcgctcgcactcgcggcggagcttgccgagcgcgcgcgcgtcgccggcgatgtcgcggccgtgcttgcgcctgacgagctccacgaagtgctccatgacgcgctggtcgaagtcctcgccgccgaggtgggtgtcgccgttggtggcgaggacctcgtacacgccgccgtcgatggcgaggacgctgacgtcgaacgtgccgccgccgaggtcgaagacgaggacgttcttcccgccggcgccctccttgccgacgccataggcgagcgcggcggcggtgggctcgttgaggatgcgctcgacggcgaggccggcgatggtggcggcgtccttggtggcctgccgctgcgcgtcgttgaagtaggccggcacggtgacgacggcgcgggtgacctcctccccgaggtaggcctccgccgtctccttcatcctggcgagcaccatggcgctcacctcctcggggctgagcagccgcacgtcgccgcccctcacctcgacgcggacgtgcggcttgccgcccttgtcgacgacagcgaacggcagcagcctcatgtcgcgctgcacctcggcgtcggcgaaccggcggccgatgaggcgcttggcgtcgtacaccgtccgccccgggttcgccgccgcctggttcttggcggcctcgccgatgagccgctcgccgccgccggtgaaggcgacccacgagggtgtgatccggttcccctggtcgttggcgatgatctcgacgtggccattccggtagacaccaacgcacgagtaggtggtgccgaggtcgatcccgatcacggtgccgccgccgccgccggcggccgcggtggagcccgccggcaacgtgaggaggaggagcacggcgaggaagaggccgtgcaggtgcagccgccgcgtccacgttgcgccgcgcgccatggctgtgtgtgagagacgagacgcggggggggcggctcaatatatagctttgggtgtggccgcgccggcgcggcgccgcgcgtgcgtgtagcgtccaatgggaggctctgcggcggggcgtacgcgtcagcggcgtgatctgagccgtccgttgttccgatcgggcggtgaggtgtaggggaagcgtcgtgttaacacgtggcctttgggcgtcgttccggacatggaaggggcgcgcgtggcgcgcggaaatttcatgttggttttccatctcggtgtttggatccggcctggcccatacagacggttcgacacaccggaaattacatgttgggcttgatttgctggatccagacatcctgccgggcccgtaaataaatggatgaacggctatggaacgtcgatgaacggctatgggccagttcagctcagctgccacaaaactaaggcccaattatctagtcaacttctttgggaaaaaatccactttgacaccctcattatacctcggatctgatttgtatcccttaaacacaaaaccggttataataacttctccaactgttaacaccattacaaaatgactcctaggataatattgaagttggtattagctgacgtggctatccaatcataaaaaaaattaaaaagaacagtgggacccacatgtaagtgctaagggaaaaaagccagaagaaaaagtcgcttcctcctcgccgaggtcgtccgcgcgttcctctccggcaattgggacgcctccttcacaacaccgtcccctccgcgcaagccgctgcctgcaataggcggtggtcccatcccgcgctccatagtgcttgtacttcgtggcgttgtccggtgtggagctccatgccctcgcgtggtctacggcctagggctgggcggtggtggggtcgccagtaaagccgtggagcaattcacaatcgaattgtgaggcagaggtggtcctctgttgcgactctccccctcccccctcctccctaatcctcctatcttctacccgaagcaatcaaagtaggcccatctcctcaattcctcatgcaaaccaccgctaagcctaccatcttgatctaccgttacgagccgtctcatgccatcccactgtgacaccggctttgcgctactttggtgaggattccctcacaatcttctgttgtctttcatcgtcattaatgtcgccatgagcccatggctgctcctctactctagatccactccacagccactagcctcacccacacctcctcaacatctccaacatagaaagcgagttccttgtcacaggggacgcgtgatgacacccttggaaggccgagatccatatctgagcttgttggcatctcttctctctccaccgaaccgagcccttgactgccgtgcttatgctatcttcctcgctggaaacctccacctttggatgagccgagtcgtaggacacactcaatcgctcttgttccatcgtcggagcaccaacacttgagccccatctcctctaacctcccaaggctcctccactgagagaatcgtgatactgagagtgtgaataggaggcggaagagggaggaggaagaagacatgtgggcctgtgtctatttttttttatttttgtgatgattgggatgtcacatgttagcgaaaactgcctttaaaacagccgagcgagtctatttacacggttttaatggttgaaggagtcataataactggttttaaggttgagggatatgaatcaaatccgacctatattatgaaggagttaaagtggactttacctatattataaaggagttaaaagtggactttttcacttcttttctgatgattaattcattggatcggttacttgaggacttttggagtcaatttccttgcaagctactctttacgtcgttaaaaataacttctagagaaaaatttgaacttgtactcgtcgaagttgatttttttttttgatgagaatggtgtatacttgtttgaaaactgcatgtttcatcgaacggagtagctcgatcaccgtaggtcgattttgcttaaggttttgaatatttggacaacctgcgcgtggatttttgtgaagctatttctgcgtgtttttacatgcatggaccacctgaataaaacttaaggttttacgacccaagttaacttgaattttggagtccatagaacacctacatttgtgtacacagtaacacagatgctccaatcgaaagctgaaagattatggaacccaccacctaggttagtgcaagcatcagatgcccagcccgaccacttaaccgcaacgtcatctaccagaatctttcaactcgaaagaaattcgacctgatcctaaactcactcagtgaaatttcagatgtcaccgctgctgatcaattcatcctggacatcctttgacatattagaggaaaaaagcaacacgatatatttacaaatataaaatagtttataaataaaacttttatatacgtgctcttaacgatataaaatcaaagactaaaaataaactatgctgaaaaaaaattccaaatcaactccaaatataagattattgaaaattcaaatgtttttcatcgttgccgttttcgaagagtgacataggcggggtgggtgcgttcgtgcagacagctcgatcgatcgagcggtgatcggatccaaacaacgccgctccatcgatcccctcgacgcgcgcaaactccacgcaccgccaccgcccgtgcggcgcgcacacgtcactctacctagcttacacctacccacatcaaccttacacacagctcgatccacactgacacacagagcgcgccgcgcgcgacagcaaggcgagagcatggccgagcaccacctcccgccggagccagccgacgagccccaccaccacaaccatggcgggaaggcggccgtccacgccgacgacctcaagcccggaggccgccgccgccggtacggatactactatggcgacgggtacggctctgccgaccccgcccgcacgctctgcttcgtcgtcctcgtcgtcatcctcctcgccggcatcaccgcgctcgtgctctacctcgtctaccgcccctcccgcccggccttcgccgtcacctccgtcgccgtctactccctcagcctcaacggcaccggcaccggcaccggcgccgtcgccggcgggccggccacgctggccgcgtcgttccagctcaccctcgtcatccgcaacccgaacgagcggtcggcggcgcggtacgaccggctggcggcgtacgtggcgtaccgcggggagcccatcacggcgcccgccccgatgccgccgctggtgcaggacgcggacagcgcggtggcggtggcgcccgtgctcggcgccggcgccgcggcgccgcccgtcccggtgtcccccgacaccgcggcggcgctcgccacggacgtgtcgtacggcgtggtggcgctcagggtggtggtgctcggccgcgtccggttcgtgtccggcccgttccggagcgggtggcactccatgtacgcccgctgcgacctcctcgtcggcgtccgcaagagcggcggcggcggcgcgggtggcggtccggaggcgccgctgctcggcaaccctacctgcgccgtcgacatgtgatgccaggcagctggatagcttcgtcacacctcgcctgtgtacgcgtagaaaatttacctatacagctagacgacgacgtacgtgtatctgtgggtgaccacgtgtccgtatgtatacgtatattggcaagcatacgtgtctccgcttctggatacctttgcaaaatatacgtgtaaaatatcgaaaaataatgataccatatcacatatgctaatgttcgacagaattttcatcaggatcgatgcagaatttatgctaagctgctttgctgtgtgatgagatttataattttaattggagttatgcgaaatccatttggaacatgacattgaatttcagcggctaacttctgcagcaatggccggtaaaacactaaaactgacgtagaaatggtgatgggaactgcacaagtactgggcaaccccgtttcagggttgaagcccagtaggaacagcggcaaccggggatgggccgagcaacggagcaagcgaaggacgcacgacctctggactggatttggcccaaaacaagacgcatgctcaacacaccacaaaccaaacaattcttcgaagatttgggccaaattttactacccaagttttaatctggacaaccgtaaaactaatattttcagtatgaaccgaaacactttgtcatggttgcggtttggaccattccaaacatcttcaatacacatcgacagcatcaatcaaatcggtttgggaataccggtgaacttttccatctattgatctatacgcaggccatatctttgtgaatagaggctagacatggatataaagagagttgggcgatcgaaatcatgataaaattaattgaaagtgaaatgattggtttaaaagtaatcaaaggtaaaactttagcaataaaagatggctcaaaccgcaatttttctattgtttaataactagtcaaatgcacatactttgttgtgtcatgggtaaaagaaaatatataatactatgtcatagataaaatattttcctatcaaatatggtagtattattcgtctgtttatttgaacatatggtacttgattcaaataaatattacactattataaaatattagaaagtatcataaataaatttataaaagttacaaaagtaatggtggtggctgactattaatgtttgtgtagaaaacatgaggcatatctctctctaccctcaaagttattgttttgatgttcaaattagtttggtactccctccgtactcataaaggaagtcgtttaggacaatgtttaagtcaaattttgggaatataaatcatgaataactctcaagttgttgagtttgaaaatatacaaattatatgaatagatttgtcttgaaaaatactttcataaaagtatacatatatcatttttcaataaatattttcatagaaacaagaagtcaaagttgtattttaaagaccgtgtcgctgtccaaaacgacttctgatgacgctctctctcgtggcccgatcttctggtgaggggataactctcgctttaatcgagtgcgacgtttttgacgtggctaccaaccagaacaagtccaggacgccatgcaatcgctacaccacaaacgatgtcgtaccaaccgtgacgcgcggttgatgatccctgcaatgcaaacgagagaacactgtaagaacaagataagatgcaatctaaatattgcgaataggtgattaagcacaaaggaatagttgcgattaaagtggcagatctaatcgacccggcaaatcaacacaccaactattgggggctctaaatcaatagtcgccgactaatcgagcgaggactagagacaaggtgaatgacacttggcaaaattcaactaaacaaaacccaaaagtttttgaggatgtacaaaactatttatagaggaaaataaagctagggttaagtgctaattcgtggaggtggagggagacacttccgagatgggcctagtctattacaaggcccaagtcccaagttcggtttcagcaatagcactgtcttgttttggcgattcccgttgactcgagatgaatttggacatgagaccggatgcgtttgaaagatagcgagataagctttccacgaagtccaagatcacccaaatcggagttggcatgaaggcgctaggtccgtttgaagtcagtgttgtctccggaggccgaactggacttggacttggaattatcattggaacatgtgaagttatgagcatatccgacgaagtgatgtcctcatcaacttcttttacgagtacggagggagtactccagttagcttcagatcaataatttcaactgatcactaagggtccctttgaataaaaaaaattatggaggaatttcatcgaattgaaattctatagtaatttttttaatgtagccctttcattcaaaggattagagttttccaaatcctataaaattcttaagaaatggctcactgcataaaagccttgaagaaaatttagcacgaggttcaacctattggaaaaattccttagagtctatctctctcatccaattcatgtgttttcattgcggtccaatcaaaggcttattcttgtatttttcttgtgttttacaacccactgttttacacttacattcctactagaatcatgcgttttttctactcttttcctttttcagtcctataataaggggctctaaacgtctagcaacaaccaaaatccatccttatgttaacctcactagattttggcaaagcacttctccaaattgttttttccaaattcgtttgtccctcaaatagttatcgtaaatcatttttatatcctaccatctcgatattcagcatgatagatatacttttttttcccgatgcatatccatgtcaaaaagttttttttaccctactgaatttttgcaaatgacttgtccaacccccccccccccccaaaaaaaagaagaagaaataaccacaccggccattactactccctccgtcccacgatataaaggattttgagtttttgcttataacgtttgaccactcgtcttattcaattttttttttgcaaatataaaaaacgaaaagttgtgcttaaagtactgtagataataaagtaagtcacaaataaaataaataataatttcaaaaaaaaattgaataagacgattggtcaaacattgcaagcaaaaactcaaatcccttatattatgggacggagggagtataatataagggattttaggtagatgtgatacattctagtacaatgaatctggataaacggttaatttgtccaaattcattgtcataggatgtgtcacatccacctaaaatatcttatattatgggacggacataatactattgatcgataataacaagtcataacttcgctgtagccccttgtgtgaaccatgcgtgcctgaagggcaccatcgaggtcagactcgcgtcgcacagtcgcatcgcacgcacccgcaccggcaccggccgaccgaccggtcgctgttgccttgcctcccaacggcgccaacgaaccaagtcgcggtcgtactgtgcgtgtagtggagacagtacagcggcggtggtgacaccagccacgctgacgtcacgcgggtgacgtcaccgagagaagagatcttttgggccttttctctctttctctctcttcgaatccgtctccgtcgccgcctgcggatgctgcggagcgtcgctggaaagaaacaaagagaggaggtgatcgagggtagtacccgacgttgtcgctgacgtcagctggtttcgtcagaagaagaacagagtacagaaaaaaaaatttgaaagggacgaccacccatgcatcggtgtgcctccaccgattccaccctgttgcagcgggtggtagtcttttttatttttgcttcttctttattttactgtgtgcagccttttcactttctcttctttttatctttccctcactttcctttggacaggtttatcgagctactctcttcgtacgaatatgtagaagtagcaagttttagttctttgacagagatattataagaagaaaagtaaaaagacttggttgtgttattgggatgcatggttaagatataggtctgaataagttgaagttgggatactacgaatagtttagtggtaaaagtcatatttttttgtcaagtaccacttgttgttaagtttgaaataaattttaagttttaaaagttgttattttcagacgaaggtgtactaatttagctaagaaatcttttcctcaactatttagacaaaactttgaaattgccggtaacttatttgtttgtacaagttttgtttttgaaccacatagtaaaaacacatgtgctcatatacatatgtgcaacctaccacttttaagaaacggggtcaacatgctcctctatcatatcttgatagtatcgtgccgtaataagaatttaactgtgacatcagattgtttgtttctaaacttttgccagaaatgtttaaattaaaaatatattatggcatatcgatctctggttgaatttgtttttggaggaccaggttatttaagtcatggttaatttatgatacatgtttgaaagccactcccaaaatcaattgtaggacaaccctaaacgccgttcttatagtgttgactcagcgtttcttttgagacctaacaaaacccgtttattcaatgatccaagtcaaacagaaaattgtactatatatatacattttcaacgatgaacaatgccactgtataccacatagaaattttttgtcaaaaaagaaaaaaaagtctacacacacatcagtatcagagaatctcattatttgaaccagctagcgcaactggaggagtacgcacgtagtttctaacgcattttccaacagatgccgtgaataaacccaagttaaaaacatatgctaattactccatccattttatattatatatcattttgagttaatcaaatttctttaaatttggtcaagcttataaaaaatattttaatacttacaatataaaaataaacatattatcaaaatgtattcattgttagatttaatggaactaatttagtattttagatgttcttaattttgacaaatttaatcaaacttaacaaaatttagctaataaaaatcaaaacaatttatagtatgaaaacgggaaggaggaactaaagctttgtttgtttgtttctctctccattattctaacgaatttgttgggggtttttttttaggattggaccagagaagcagagaccgtttggtcgtccaacgcatgaagcaatatggaattttgcagtaaaaaaaaaacaaaatacaaagaccagctcatcgcccccgatgggtcaaggcgtttgcacgtttttaaaactatagttccccctctcacgagatcatgcgcgccggcttccccacaggacacgtcaccctccctcctgcccctaccctcgctggtatttataccacccgtcgcctccaagccacgacgccaccgccattccacctctcgcttcgcttcttctcctctctctctctctatcttcacctcgcatcgttggagatatggagggagttgacgtgaaggcgccgcggccaggctgcggcggcgacgacggcggcgcggcggcggcgtcgttgtcggcgcggcgggaggaggaggaggagggggcggtggtgggcggggaggacgagcaggtggagaggttctacgcgctgctggccaacatccgggcgttgaggggcatgtacagccggtacaacggggaggagggcgccgccggcggcgatggcgacggggcgagcgggaggaagcgggcgaggcgcgcggagccgccgtggaggccggcgttcaggatggaggacttcgagttcgaggaggccgccgccggcgccggcgacgacgacgcggcgtgctccggcaggacaacgaagaagcagagatcaggcggcggcggtcacggcgccgccgtggagaagcggcggacggagaaggaggctgccgccgccgccgccgaggacgacgacgacgagcaggagggaggcgaggtcgtcgaagggaaggaggaacaccgaccgggccgccgcgtcgaggcccacgggcccactgaccagtgaacattagctagctagctgatctcgttggaattggtccttcggaaacagaaggcattttcgttggacttttctgattgatgtcctagtttgaaatgttcacatgtatgatagcactagtagtatcacgcaatccatgtgccagtcttgatttgcaaattgcaatgtacttatcaaaattggtgatcatggactatcccagctgtgcatgggtaaaccattagtatttgagatcaggttttttaatttcgaaattggtttttttgccggggaaccgaagtttcggaaatttcgaaattttttggtcgaaattatttaaaattttgacttattttcaatgaatttgaataaaatttgactaaattcacaaaaaattgcaagaaaaactaaaaatttcgggcaagatatgagcttgcccgagggaaacgaaatttcaatccctgtttgagatagactaacacacatcactccaattagtttaaacttgaactgcggtaatatatgcatttcaaaaaggagatttaaggaagaatgtcagtattttaagcagttaagcacctctgaagatttggtaatgcgaataggtgttcgatcttccggtagtttctattttgcaacgtgagccatatcttgagattagcaaagtaactatagatatttagttgtcgacggacgacctaccactaaaacaatattttgctataaatgcgatgatctatgctaagtgtatgatttaaactcagatgatgaacagcttcaccacaagacaaagaacctaaccagctgagaaaataattaggtataaatgtgatgatcaacgttaagtatgtaacctaaactcggatgaacagtttcactacaagaaacccaaccaagttacactcagtttacaaggttaggtggtgtttgtatctcctaaaaatgaagattaagtgtttcacgtaaaatgagatggtaataacgtgtgattaattgagttttaattattacaaacttgaaaaatggattaatctgatattttagagcaacctttatatagaaagttttcgtatgaaatacaccgtttagcagtttgaaaagcataccatgagaatctaaaatttcatccaacaattgttggacattcgaacgcagccactagtatagttttcatgtcactttaacgtaaacggaaaacatacttcacaagacaggaatttcgtaaaagaaaaggttgaagagatcaaactaaggccctttttagatcccatataaaaattttacaccatatcacatcgaacgtttaacacttgtatgaagtattaaatatagactaaaaaataactaattgcacagattgcgactaatttgcgagacgaatcttttaagcttaattgctccgtgatttgacaatgttgtgctatagtaaacatttgctaataacggattaattaggcttaataaattcgtctcgcggtttactgatggattctgtaattagtttttttattagtacctaaacaccccgtgcgacaccctatataatatccgatgtgcaacgccaaaactttacacccctgatttaaacaccccttaattaaagtgtatggaaatcttgcaaaactctcatattacaaagcactggcagagaaaacctttttactcccggttgggaaccccctttagtctcgggtttccaaccgggaatagcaatctaggactaaagatggttgaaataaccgggactaaagatgaatctttagaccaaccgggaccaaccgggactaaagatagagtatctttagtcccggttgttgttaccaaccggaactaaagaggatagctaggtttttttccttttttattttctcccgaatctaggtagtatgcatatccttttttattttctcctgaatatgggtggtatgcatatcccaaatcaaagtaagatcccaagtccacattacaaatctgaaagttctaaaaaaattacatcacaaatcaaatatatcacaaatcctaaaaaaaattacacacaagtcaaattacatcacaagtttctacaaaattcatcacaaatacatcacaagttcatatcacacacaaatcaaattcatcacatgatcatgcaataaatcacaaattcttaaaaaaaaacaaacagaggagccggccggccggccaccgccacgcggccccaccgcgccgcccgcccgctgccgcgccgcctcccctccgcaccggccggccccgcggcgctgcctgacgccgcgccgccgccgcggtcctccgcgccgctgcccaccgccgcgccggcctctcctccgcgtcggccggccaccaccgcccgtccctctgcgccgccgcgccggctgccgcccggcccgctctcgctccgatccaagtggcactaaggaagaagaaagggtaaggatagggagttagaggggaaaaaagagatagagaaagagtttgttgtgtggacgggaaaagaggataagtaatagggattatataatacgtgttgatttttaattccggttagtaacaccaactaggaataaagttagatctaccaaccgggactaaagatcctagccgcctgacacggtctgacatagagacaaccgggactaaagatctttactcccggttggggtaaccccaactgggaataaagatcatctagtcctgttacgcttataaaccgggactaaaaatcgtttttagtcccggtttttaaaggaatcgggactattgtggatttgagttgaccgaccaaagatggtttctctaccagtgaagaaatccaagtttctaaccctagtttgtttagttcgcccaccatgatgtgataattttgaccaccgaaacccctaagcagaaagaacaggacatttccacgtacagttcattcagatcagcatttccatgtagttgagcgtgcggcgtgggttccacgtacagtcttctcaaatttctaattttctcttctctcaaccacaccgagcgtacaatatgcacgaacagacaaactgaaaccagaggtaaagacaatactggagtaatatatagaaagctaattcctcaatagtgttacaaagtttcttaacgaaccgtgacccgctaatttactagtacaattatttaagtgaaactgtgagagtacaaataactttaaccgtaggctgctaattaaagaaaatagtagcatacacaccatgcagcggaagtatcgatggtgtaggggacagggcctgagacatcttgggcttgagcttcaaaactccatgtaattttctttagaaattgtatgagaattttcaaaaatatataatgcctaactaaaattgtcaaattcagtcttagacttgcaaaaaaaaaaacatccaccactgatggtatagtgtagtagttattgatgcacaactcacccactgggggttttaaatcctaatgccttcaataggattttaaagaatccacgtacttaaaaaagtatttgaatatgatatgtagtggtgtgtatatgcatctttagtattcaatgtaatcgaataaaaaacatacataggatttcaactaacggttccatcctaaatgtagaggttggagatattttcatataaaagaatacaaataaaacagtaaagatcacatgaggtaaaagagtaaaaaaaaagattaattcataagtacagtggtaaaagaataattggtcaatggtgtgtggtttatatgaaacactataaccataatatccgagattatatgtttaagtgttatagataaggcatatataatatatatttttgtgttaaactcggtgggacccaccatataccaagttttatactgaatcaatcctaatatacgaaaagtattccagataaagaaagaggaaaaagagtctactcgatactaccaggactatttggatcgtataatacttgcctacttagttttacttagaaaaaggcacacccgaagatataaatacaagtcccactagaagaagtgggaggccaagacagaacacaagccaatacagatctaaacaaatacaaaacaacttcaaacctcaccaagttcatagtactcgagaaataagattacactagttgtcaaccacatgtgagagctccatgcggctaggccaacagtgactagattaggtcatcccaaatattatactcgcgtgatgttgatagataaaggcaacaccggcttcaaccaagaagagcagggctattacttgttagttaaggtcatgaccatgtataaaaatccttgtctttcatctcttttacttcaatcttggtgacaccaactacccccatactctataaataccataggtggatatagtactctctcgtcaatgtgtcatgtgtcaaaatttatggagtatgttttatgtaatcaatattacttagggttatactagaaaaatgcatgtgtgttgcaacagataagatgtttttaaatcagcatacgttatactcctttcttagttttgggccgaaagccaatccctttcttctttttcagccctagcccagtctgctacctccctccgctcggcctgcctctctttggtccaacctacagctggagccgtaggtctaggtcgcacgtcttcaacctccagaagatggtgtcgtgctcgtacaataccataattgattctccccatcaaatccgtccgaatctttgtcgatcttctaaaattggtttagggtttttatccactcgatcttctctttcctttttttccaaaattggagtgagcaaaacttgggataaaaatggccaagttagcttgctggcctgccatcatcgacgacggttaaatggagattaaatccggccaattaaagccgaatttaaggggcaaatcatggggaaatgatgagggatgagtgtgaaatcgatttttgcaatcaattggaggagaaaacgcatgaagagatatatcgatgtggtggtggagctagagataggtatagcgaagggaaaagacggtgacgaaaagaaaaccgaaaagccagaagcccttaccgcgtgcgagaaaaaaaccgcaacgaaaaaacggtggcggaaaaaaaccgtatgagaaaaaaaaatgaaaaataataaaaccgcgacggaagaaaacaacgaaaatacgaacggagcataaaactgaaaggcttacagataagatccggataataataataatagaactggaaggcttacaagttttttatcaggtatatagattaaaactgaaagatagaattaaaaccgattcaaacacatatgacgtatcaaaattctagcagaaatattttaagtttttataatagtgtagagatgaaatttactatagacaaataagatcagtaacttgttatataggttcccctgattaaaaatgtcgataggcttgaaatcgttagacatcctgctatagatcgaattgacattatattccatgagaaactctcattccaagaaataaaagatatgttcgtccccatattcttcgatcaaaaggttcggaattctagaggagaaatcatattcttggcttggatcgatatggaagtgcatactgtatgcttcggacggtttcttctgttggctgtcaaatccagaatcaaacatcaacacatccggcggcagtatcatctccttttatggcgtgctacgaaatgatgcccacacacttgcacacagtaatatactccctccctcccattagagcagagcaggtacaataaaagactataagacatctataaatacagttcgagaagataaaagaggagagagcagcgggctatagatttatagctagctgcagcacggattttaagatatatgtgtgtatgataggtgtgaccaaatattaattgtgcagtatatgtttataagtaactattgtatgaattgactattaagttgactatagatgatttgaagccaactgttggctatactattaaacttgctcttataagtgcagccataaattttcgtatctaacgtttgatcgcccgtcttatcatctaataaaatactattcttattttatcatataataacaataaagatattaatcataaaaatatttcaaataggacagatggtcaaagttcgacattgaaactcacaactgcgtttattatgggacggagggaatagctcatgagtaataatggagtagctcgttcaatagaaacatttcacgccaaacaaacaaaccgacaaatttcgcaggcaggcggtacaacatcgtgcgacacgcgcgcgcgtgctctcccctgaggcccttcacagtgcagtgagctggccagttgcttcacagctccacggaggatggttgatggcgtggaggagagagggtgtgggccagagttccttcacatggttgctcggttccttggtgagcaacgagttcctcgtcataaaagcctgcaaaaatgcctgaaaaaggactgagcacgcacaaaaccatcgggagagagagagagggggaaagaaaaacgacctgcaaagcgattccgtggtggggccggcctgaaaaaaaatgagggtgggttacgcacgtgtgcactatggagagggaagcttcaaccacttttacatttgggttgctcgcccaggctcaccgcattgttactgccctgaaaaaaaagggcccgatcgatcgatcgaaccaccactccgtataattccatgtgctttgatcacctgctttgttgtggagcacacgggcacgagcacccgcgcgcgcctggcctggctggaccgaccgaccgagctgaccagatcgaccagctaagccaccacttttgcctttcctttaacccgtgcgcgctgacgtcacggcacggtcgtcagcggccccccgttcccgtcacacacacgtccccgttggccgttggcgcctctcttttttgtcgtgtgcgcctgcgtcatccgctgacgtcacccatgacccaaaccacagtcgacgtggaatggaatactgttcgtcctttggtttaccccgatttgtccccaccgaccagcgacttggcgtccccattttggggatggatgggcgagggcagtttcgtcacttttgcagcgatgattaaagaggaagaccgggggcagggcaaatgcctcttttcatcagggtcatagtttgtttttttagtggtttggtgactgggttgtggggcccgagacaaaaggacaacagtatcgccatttgcagctgggctattttcccttttttttatttttatttttgaaaaaaaaagagggtgacgtctataacgtgcgcacactgctattgacgggtacatacattacctactactaaagaagcacactcttatcaacgggtgcgtacattgtctactattgaaataatagttagaagtaaataagaacactcgtatcaaaaataggatttgaatctctatgggttagtttcaccacaaagaatctagctaaccagataagctacgctcaccttactggttagatttttttttcaagagaatatgtcgatattttttatagtaataagcagtagtgttggcagtcgtacatgctccattatttttggaggactacaacgcatcagacggtcaaaagaaagaggaatattcctatagagtgagccaccaaatcatatcgatgttgatttgatggaggaatatttttctgggtaagatgtgataattacgtttgcatgtggtttggttagaaaaagaaactatttttcaaatttctattaatgattgtaagtggatcttcgcatgaaactagattttaagaaccgctactttcttatattagttgtttgacttttttaatcaaaattctttagatttgaccaagtttatagaaaaatatcaacatctacaccaccaattagttttattaaacttaacattaaatatatttagacaatatgcttgttttgtattgaaaatgttagtatattttctaacaaatttggtcaaccttaagtaagtttgattaagaaaaaagtcaaatgatttataatatgaaacagagggagtacataattctagttgcttatctttggatttacttcgtaattcttagttacctcctccgttccacaatgtaagtcattctagcattttccatatttatattgatgttaatgaatctagatagatatatatgtctagattcattaacatcaatataaatgtgggaaatgctagaatgacttacattgtgaaacagaggaagtacttatgttcctactaaaacaattttagaatcaattaatacaagttctgttcagtttcttttctttttgattaagtgaagacgctgatatacacactctattacgcgcgcactcacatttttttaaggattatatggaagatgtacgcgtgcacaatttgcgctctgaattttgagttactccacttttgtttcttctaataaaattttagaagcaacagaaaccattcaatttagcatcaccccgttaaaatcctatgaaaaatatgcgcacataatatcttaatattagaaccttaatagaatcatacaccctgatcctagcacacataaaaacttatactaacgtgcaattcttttgcccgttcagaaaaacaccgtacacgaaaaaacacaagtgcttctcaacaaaccgtccaaattaatcctacatgaatggaaatatatatggaattgttcattcggcctcagatttttgacattgctctacttttgactctctaccatggccgttcaaagttcaaacctttgtatatctcttgctcctgatttgacttatttgagcacggtaataatgcttctccgtttatacgcatctgattccgatcgaattaagacgtgtctaacttcgatcgatcagatgctggcaacctggcaacgaaggcggcgcttttggatttacgtattctagagaggacgcctaattaacgtttaattatttaatcgtaaatggtccggtctaatccaacgatcgagatgtgtgctgtgtatagtgtgtcgctgcttcacaaattcaattttaacttcgctttcgttttcgcaagctgttgctataaatttactcaccatggctgcgccattctccgcagcagccagcctagctagccctagcctactcccatggaaaccaaggcggaggccgccggcggcggcggcgagaagaaggcggcgtccgtggcgccgcgcgacgccggcgacgccccgtcgtcaccgcgagcggcggtgggaggagagcagcagagctcagcggcggcggcgtcgagtggcgatggtgtggcggcggcggcgaatgtggatcggagcggcggtgtcgccgccgccggcgaggcggaggaggacgaggacgacgagcagcgggccgtggagaggttctacgcgctggtcgccaacgtgcgggccatgaggggcatgtacaggagcagcggcgacggcgccagcgcggacagcgccaccggcggtaatgccggcggcggcggggagaggaagcgggcgaggcgcgccgaccagccgtggaggccggtgttcaggatggaggacttcgccgacgacgtcgcgggcggcgccgccaccaccaccaccaggtcggacgacggcgccagagcgccgccggtagagcaggcggcggcgccaggagtggagggcggcggcgacgtggagcttaggagaggccggcgccgccgcgccgccgcgtccacctcgccgccttcgccgcggcgcgcgccgctgccatagccgtgggacgaattaacttttttttttttggcaatgaatgtttgactagtcggcaggttagctaagcttagcgtgaaacatctgtggcgagcgcacgatgtgttttgtttgttaccacacgtttttgtgtgttatgttaattggtacaccaattaatttctgcagtaggacgcatttgtcacgcgcttacttctttagcaaactttcgcacgacttatcgctttcgatcattaatgtttgaagttagtattagattcgatctcacttgaaaattaaagcatcaggccttagctatgatctgttaacaagatactacgacactaaaagagtgagctaagctatctctgacttgaacaaatttatgtacgtgtaggccgtagaaattctacacaaaatatgcatatatattgcctaatcttaccaaggttggtgtttactgtttagattgagattgaagatttgcaattagtctttgacttagaagactcattatttttggatgtggaagctggaggtgttgagcccttgatggagctaggctcactatagttggagttcagagttttcttttctctcttttttttttgtcgaaatattgttataaaaccgatgatggcattgagtggaaacatgcagcatcgttgggccatggaggacaggacagggagactggcacattaggttgacggagtgatagccacacgggacaacagccaagagagatggcgagctctagggctccctagggctcgttcgtttcaaaggcattagggctcattcgtttcaaggaattgtaaagaaaaagtacataagtatgcaatacttaaatggacatcaaactgtcattcgttttaaaggaatccaccgaaagagaattttcaattctatccctccaattttagggggaagacaaaggaaagaacaatccactcttaactcattgttttcatgttctttggattgtttgttgcacaactatagacaagttttttatgtttttcaatccaaagtttccacatgtattcccatactattctttttttttctattcatacattttaaaaatcctacaaaccaaacgagccccgactggaaatgaactatcgaactatcttctagtttatcttttttgttaaaaaaggaagaaaaaaatttagtataagactcaaaaaccttgataaatcgagttgaacttgagagttaaaaggtgatcatcctacggagttgaatttgagagttgaaacgatatctgttctaaattattttcacaaactttttacaaacaccgatgtgttacattatggttgaatcttgacttttataacttctagtttactcaatcggacatttgagaattttgttagtaagaagtttgtaagaaaattttagtacatgtagcattacttcatggagtaggagggtagctgagggtaaaatggagaaaatttgaatgggatgtgattgatgtgaaaagtactactacctcatgtatgacactgttaacttttttttataatatttgaccatttatcttatttaaaaaattagcataaatatgttaaactataagttaagattatattttatttgatgataaaacaagtcacaattaaataaataaaatttatactataagacgaatgctcaagctttatacgaagagtcactggcgtcatatatttggaaattgagggagtagtatggttgagttgcatttactttaggataaaaattaaatctagaattagatccctcgttatactgctacccccatagtatgatcccctcaggcagcaaatgaacctcccagtttagagccccattggataccctaataagctaaagcaaaagctaaattttaaatttcaaacttaattttgaagttgattttaaaataatttcaatgtggcatttttatattggattttgagtcgctaagaacatatatataaaaattttacctataaattaatttttcttccttaaaaaaccgttttggcttataagacttgaagaacaataattcagtattagacttgaagccctcaataattcgagttgaatttgagagtttaaggtgatcgtactatgggatagcagtaaggcccttcacagtgggcgttacttcatatacgtggagcattacttcgtcctacgtggtaaaaaaaagttggtgggacccatagcttcactagcttcttcggttccaagtgaaggatcgagaacctcacttaaaaagttgagcgcggggcccaccgatgagagggatttgggtcacatgagcctggagagattgggagtgacctacttttatgtgggacccactaggatgaaagttttcttggttttgggtcacgcactgtggagagcgtgtccttcctgccaattttttttgtttcgttcactttttacggctgaagacacgctatacgtgccttgcactgctactgccctgctaacatctcaaagtgagcagccgacctacagagaaagtacggaaccagcagcaggcatcaggtagttggactgtgtcggcaaaactacacacatcgaaaaggattttgcacccacgtgcacacagaaacaagaatatgtactcatatggcattttgaattggtttttttgcaacgctttactaaactttttgtttatacaaattattatttttatttggtggccggccagatggagatgcgccactgttacatggattgaaattcgtagtacctttattccaaaataagtacacattcacgaattaggataaacttaaagtgaccgaaaaaaataaatacacatttatacatgaattctatgttttaatttatacatgattctatgaattctggcttctttagccaggatccatgaaaggagcaagaagggaactttacaacccctctcctcccttaagaaaattttaaaatatctaattaaatgattgagattttagaaaaaaaaacaaacttaccactattggccctagctctactccctccgtaaaaaaaaaccaatctaaaaggagatacttcctagtacaacaaatttggatcatattctcttataggttggtttttttaggacggaggggagtactgcgtaaatttggtacctttgccaccatcttgatgacttaagccttgcaaaaccattatcgttatacgcaagcaagcggcaaatttaacgattcttcaggggaaaaagggtccaaaacctcgttctttctttctacccgcggcttctctgagctggaccaattgattcactacaactcacaacggcacagcttgtacttgcacagatcgagagatattttgctggagggaatcgtatgccaagcgtatgtaaaatggccggtatcaatggctataagcacatctcattcatgggaatcagattaccttttagtttcttcgacaaggatgcgtatctttttttctttgcgggaatagagagctttattgattacgtaacaggattacaatcatgctgcagacattgcataacacaattcggtacattattacgccaaccgtgctttgccccgaacggatagcaatctgagcaagttcatgtgcgaccctattacactctctattacagtgcatcaaacgcacttccttaattaaccctataactgatcttgctactcgcagcagaaatgaccatcttgatctctcttcagtagtggaggacaacctcgcaatcgctgtggcacagtcacattcaagcataactggcatgggaatccattcagcagctagcttcagcccttcatagcacgcaagcagctctgcttcctccgctgacacacatcgcctgagaaacttccaagaagacaacagaacttcgcccctcgaattcctgattacaactccagtgccccattaccattttcaggattgaaagctccatcgacattgattttagcccagccattcacaggcataagccagcaaacacgttgctttggaaaggcccgagttggacctgactccttcccctgttcagggcgacacaaagccttcccttttctgttagctcttggttgccctcgtctgatcgtcggcacggtttataagatgtagcagccagtcaggtcctgactgagagaactcttgttcccctggtagccaccaattctgccgcatctctgccctcagcgcagctgctttcgtgcatgcaaccgtagcatgaaacgcatcttccacttctgccccacatatctcacagtttggcttttgtacaatctgtcgtcgatgtttattatgttgtgtggctagacaatctcttgatactctccaggcaaaaatccttattttctgtggcacttgcacattccaaatgttcttccacaacttcctatcaccatcgccatttgagcattgtgcaacctcttcgtcagctctgatttgggcctgtagggctaatttgtaagcagaacgaacagtgaacatacccaccttatcatagtgccaagcaatgaagtcctcttcagggctatgtggcaattggattctcaaaatttcctcagcatccaggggatagaagattcgatgaactagctcttcattccaaatttgttgatgtggaaccataagatccgagacccatttgattctcgatctaacagcctttcccaaaacccttagggtatgctctctcggtatctagttatccctccagattctgactttgcttcctgatccaatccgccaaattagaccttgtttcagcagctctaacccgtggaccatccccttccaagtttctgaagagtcaatagggaaagcagtatcacacaagtccccattggggtaatattttgcctttaaaatttgagcacacaaactgttgg

SEQ ID NO: 75210 - DNA, 1009 bp, Oryza sativa
aaaaagaaaataactttaatgaatgtgtcaacgggggatacccgtagaccggatatagagggtattggggtctgttggtacgaggatctacgtagtatgacatcaagcagacaaaagacaaggattatactagttcaggccccttagcaggtaatagccctaatccagttggtatgggattatatggtggaaaccacagattacaaagggaataaaagaactcggtgatatcgacgagaccgtagtcgagttggcccgactagatctcccggtgacttggctcctgtaagctccggcttcgtaggctgtggtgggtgtgttggcggtgagatttgatgccttagatcctgccagggggtcccttttataccgcgggtcagtcgatctccaagtagaactcggagatatcggacccctcacaatatggtaaagatccagtttcgtccgagtaggactctttccatccatagattctgttcctatcacgggatagatttccttaatgtatacggaaactattcgtacacgcacgggtatactatatcggtacgcatcgtatatccaaggatagagggcataccttatgcgtaaccctgacagaatgtctttttaattggatgtgactacacagctagtggtagctactttgtactccatctagtatctcctttcaacttaaaaaatacaacagtatcttcttttctcattctacatgaaaacaaaaatgaaagggaaaaaaacaatcgatgattaaacagatttatagagagttacttttgaaccatgcaaaagttactaccaattaacattgaagttacttttaaaaattgttaaacttatgtgtgttgatccgtgctgattaaatttaatttttagataaagtcatatttttatccgtacaacgaatttacttctattatcgtgacaaaattacttccgttttgttttatgttacttttataatatatgtaaattacttttagactctattaaatttacttttatatat

SEQ ID NO: 75211 - DNA, 2259 bp, Oryza sativa
attaaaaaaaaatagttcggttaaatgtaacattgaatatgttttttttaaatgttgctatattcttttattatttgatcaaacttaaaactagaaaaaaaatcaagcaactaaagtcttttttatatgaggggaaaagagagaattgagaagatacgcaaaacaaggtgagcattagcgaataattaattgagtattaattattttaaattttaaaaaatagattaatatgatattttaaagcaatttttctatagattttttttataaaataaacatcatttagtagttcagaaaatatgcgcgtaaaatacgagggagtttttctgtttctacctaatcaatttctctcaatcagttttatgatatgaaacggagggagtagatcgctaattactggtcaggcttgggtgactggtactttttgcaaatactggtttcctaggttttatcctaacaaataatctggagatcttttacggtgtttgcattttaaaaagggtaaaagtctatcgctgcacaatgaaaggtaccacttaaatggttgatatagttacttactacctccgtcccacgaaaaatccaatcatagcatcccaagatagaattagtggaggatagaaatgactaaaatgcccttaatcattgaaaaaagtagtaagagtattaataggtaggtaaaaggtattaaagggagttttatctgtaaagagtaggtaggatggtaggatggtataggatggtagaagttggtttttttatgggacaaaattcaaactctagaagttgagtttttcttttgacggagggagtaggtggtaaaagtaaaatgataattttcgtaggagatagagaatggcataattgttttcgatattagttctaggtacataggtgcatacaatacctcactaactgtgtgcccggtaatttacatgatatgttttttagatttacattttttcctgcaaatatggtcacgcagtaatcctctgttacattatttacgtgtttgttttagatttatatttacgtgatattttctagattttcattttgttctaggagcacgattggttaaaatatgaccgaatgtttgccaggttattttgatatttacattttatcacaaagaacatctaaccttggtaaaaagatcagtggttagtaggttcatgtgtaattcatcctcaatacgatatatttatgttgtttccacgtgtttgcgtcatctccccgatgaaatttaactaaaatgtcttaagcaattaaatagcttatttccttacagttattttgtaatgtatcgggtaaaatggaaatcacatgcatgcttggatagcatgtattgttcggaagtgctaatgggcgatcgatcgcccggcgacaagggttgccatcgatcccccttccccctccctccctccctccacctggttttcttttttggcaccgtattactttcctattttagtaaatttatgcacctaaagtttatacatctcaagtttacacatctaaagtttatacacctcaagtttacacatctaaaatttagagaccaaaagtttataagtcaaaagtttatatatccgattcaaatttgaatttgaatttaaatatttttttatatatagtatttctatatatacatctaaagtttatagacccaaagtttataagtcaaaaagtttacataccccattcaaatttgaatttgaattatatcgggattcaaatttgaatttgaattcaaatattttctatatatagtatttttatgcatctaaagtttatacacctaaagtttatagacccaaagtttataagtcaaaagtttacatacccgattcaaatttgaatttgaattatatccgttcaaatttgaatttgaattatatccttcaaatttgaatttgaattcaaatattttctatatatagtatttctgtacatctaaagtttgtacacctaaagtttatagacccaaagtttataagtcaaaagtttacatacccgattcaaatttgaatttaaattcaaatattagtttatagacccaaagtttataggtcaaaagtttacatacccgtttcaaatttgaatttgaatttgaatttgaattcaaatattagtttatagatccaaagtttataagtaaaaagtttacataccaatttcaaatttgaatttttatttaaatttgtatggtgtagtagtaagagaagaaggggaggtaaagtagtaggggcaggggcg

SEQ ID NO: 75212 - DNA, 664 bp, Oryza sativa
atgccacctcggatttgagcttagcgccaacaaaagttggcgctgagacgttatagctcagcgccaaggtccatggcgctgagttcacggcctatttttggtgaagttttttgcagggactagtttcgaaataagtttttaaaaaagactaatttgttaaaaaaacggtggttgtggcggctccattttggggaattttttttgacttagattctaatttgctacatcaatgtctgaacccaacaaaccaacgtaggtgtccatcaattcatctagcaagaaaaatcatagcagcatacaagtggtaaaacatgttgaaggatacaaatatattacattgtgaatctatcaaatattaattaagagagccatcaatgcgagcagtgcttttgcatacgtagcaggtcgatgaccacatccaccaccctagaatccattgccacctctagattggtgcacccttcctctccactaccaccattccgccatggctccaccctcattcccccatggctctaccctttgaagccctgccactaccaccatcgctgaaaaaaaagtaaagggaatatagggactcacctacgctggctagtaatgatgacaatgatggacgaggcgttgctcggtcgatccggatggggcgggagctcggtaagaagag

SEQ ID NO: 75213 - DNA, 2233 bp, Oryza sativa
ccgtcaagttgatacaagaagagttgaacattggcgaccctctttagctacacaaagaacgggagagacctaactagacctaaacctatctactagtggagaaaggagccgaaccccctctcctagacgccgacgactgggtggccaccggagaaggaagggaaggggccaaaagtcaaagctttttttttttgcccaagaagccgcctttcgctaggcatttcgaggtgaagagataaggactaatgccaattgattaggactttacgtcgtccacaactatcattgcacgatataatgtccacagagtgattttcaaggatcaaacctcgtcatcatgccaaaatatggagttagcttagcattttccacaattttattgccaggtatcttaaaaatcatatactattattagaattttttggggattttctatgtttaaattcgaacaatttttatcaaaccctatcgctggtagcttgggaaaccctgctttctacatgtcaacggctttgcatcccggcttcaatttttctaacttttctaaagagccctcgcctgatgatatttaaaattaaattcaggcatacatatcatcactaccatatatatgatagctgttttttttagagaaatatatattagctgttgattttttttttgctagttaacccctaatttgctagattcaatacatatatggtaatgaatctagcaaaactctacaaaattcatgtctcaatctagattttgtttacatgttaatgttcaaaactaaacagtgtttagttgcatacgaggttttaagatgatatacagtgtaatacagtgagaacattctcatgtaaaggggcctgtgggttgtttcatctgggagaagcttcaattcttcatctgttcttgtccctgggttttcattttgtccattactctgttcttatcttcacagaaatagtagtctcctactctccttttcctcacaagctagctaatgttctaaagttgcctgaaaatgacgtgtctgagctttcctcatgtggttttcaattaacagagaaagtcataagcagccctgcaggacatctgaccagattatctttgacttcactgaatttcagaatcaaacgtagcagattccttacagtttcgtgtttacacgaccaagacaatcttcactacttatccgattttttatcctcatgaaaagaattaatctttatatgataatattgggcctgtttgatttggagccaatttttggccaaaaactttagtagtgtcaaaaacttaccttgacaagttttggtattaccaaatttaataatgtagaattcaaactatgaaagaaaccaaacattgttgccaaaattttgggtgggtaaaaattggcttcaattcaaacaagcgcattgtttcaaatattgtcacatagtgaagtctaaactttctcatgaatggttctcttgggcttattcgtttcagcgtttggactgagatttctgggcggcatgcaaaacgagataagttattagtgcatgattaatagagtattaattattataaacttttttttaaaaaaagaaacatctatatagaaaattttttacatagtttatgaatttgggaagtagccatcccaaaaagctatttagaacacacccttagcaagtatagcatatttttttcaaggacatgtcagtataaaatgaaaagaaaaaaaaattccattttactcccttgacttaattcaatgtagagtactgctatacgtatgacccgttgtacgaatagagacatgtaaccatagatcaatcaaaggagagcatgttcatatacactaaaatacagtcttacatgagtcggacatttggatcatatgcatagcaatttccttcaatgtatcgcttaacctgttgtactacttttggttcatttttaccactaaaactattaaaccattgaaatggatcactttactacttattgacatttgtcttttttgttactatttatataagttgtatttaaagctgaaatttcttagacatagatagcaccattatcgaagttgaaatttgttttcatggttgtttgctttaactttaaatttttggtgtttaaatcgggcttatgcgctttcatcctacgcgaagtgagaaaaagaataaaacaatgttgatacgtaagttgtgaatgcatctgtattgtcctaaatttttaatgcgaactatga

SEQ ID NO: 75214 - DNA, 4974 bp, Oryza sativa
  unsure (1)..(4974): unsure at all n locations
tcagaaaacaaaagattatattattcgaagttacgatagtacggcataatgagaagtcaataggcacacgtatgcatgatattatttacctataaaaagattaatggcatatgatataacaagcactacaaatagataattaatggacatgcaggttgaaattgctgcctgagttaatgaaaccgaagctaaattgtctgcaaatcaaataactaaagtctactgtatagacggtacacaacaacttgcaagcaagaacacccaacttttctccctgaaccaaagcctggataacaggtgcatcttcacttggattcactaggcagtagccactggacgttgagttctctacaaggtcaaaccaaactaatcaaactttggcaccatttctccacaaagtttctacatcaacacttctataattgtcaggtacacccagtcctgttcagcacttgagatatttttccttagaacacattaattagagttggacgccgccccaagtgttgaattctgaaactctgaattaatctaccaggagatgagcacacacaggacctagcttttccctgcatgatgattattcaaagaaaaattccatgattccacattactatcacaccaggaatagttcaactgacaagctgcgcagctggactgaaaccttcagctcatgttcatataaaccattctggtaagtacaagctaatgagagaatacattgtccattaacactagagagaagctagctagtgagataacacagaattcagatatgcagcatatggttaagccagtttgcatattgtgtctacagtgtagcctcctctatggcgttcatcttgcagcagccgttgctgctgccggtgacggcaacggcggggaccagtttgcctactccggctttgccggagtgaaggacctaaccctcgacggcacggccatggtcacaccagatggcctactcgagctgaccaatggcaagccgcaggttaaaggccacgcattccatccgacgccgctgcgcttcgaggagttgtcgtcaccagaaggcggggagaagaaggcagcagtgcggtctttctcggcgtcctttgtgttcggcatcgtcactgcctcccctggtgtcggcggccatggcatcgccctcgtcatcaccccaaccaaggacctctcctccgggctcgccagcacatacctgggattcctcaacagatcaagcaacggcgacaacagaaatcacatcttcgcggttgagcttgataccatccagagccccgaattctccgacatcgacgacaaccacgtcggcatcgacatcaatagccttgtgtcttcaaatgcctctgatgccggctactatgatgacaacaccggtgagttcaagagtctaacactggttagtgggaaagccatgcaagtatgggtggactatgacgacgatgctacacagattgacgtgaggcttgctccggtaggaatcaagaagcccatgaagccattggtctctacgagatccaacctctcaacagtgatcaccgatgaagcatatgtgggcttctcagcgtcgataggcacaatgacctcgcaacactacgtgctcggctggagcttcggtgtgggcacgcaagctccggccattgacatggacaagcttcccaagttacctggcagaagaagcaagaagtcttatccgcccaagaccatggtgatagctctaccaatagtctcggtggtgcttgtgattgtcgttgctgctggtgtttttctactgattaagaggaagtttcagagatatgtcgaactgcgtgaagattgggagcttgagtttggagcacatagactgtcatacaaggatttgcttcaggcaacagaacggttcaagaacaagaacttgcttggaattggagggttcgggagggtgtacaaaggagtgcttcctacttctagttcggaggttgctgtgaagagggtatcacacgactcaaggcaaggaataaaggagtttgttgctgaggtagcaagcattggtcgcctccggcaccgcaacctcgtacaactgcttggttactgtcggctcaaagaagaacttcttttggtctacgactatatgccaaatggtagtctcgacaaatatttgtacagccatgatgacaagcctactctgaattgggctcaaaggttccagattataaaaggtattgcatctggcttgctttatcttcacgaggagtgggagcaaattgttatccatcgggacatcaaaccaagcaatgtgctccttgacaacgacatgaatggacggctaggtgatttcgggctcgcaaggctctacaaccgtgacaccgagctacaaacaacagttgttgcaggtacctttggttatatggcccccgaattagcactaaccgggaaggcatcccctcttaccgacgtgttcgcctttggcgcatttctccttgaggtcaccagtgggcgaaggcctgtcgagcaagacatcgaagggcatcgactcctgctgacggactgggtgtttgagaattgcagcaaggaacagatccttgctgttattgacccaagacttaacggcaacattaacattagtgaagcaagtttagtattgaagttagggctcttgtgctcgcacccaatgtctaatgtaaggccaaccatgcgacaagttgtgcagtacctcaacggagatatgcccctcccagagatgtcaccaatgcgctttactttcagcctgtcagcactcatgcagaaccaagggtttgactcgtcgttgaagagtttaggcacgattagtaatctttcaattgggagatgacaatgcaagatgatgcatttctgttcataagtagaatctgtttcttttcaccacattaggtcagagtttattgtagttattcttagctgaagtgcactctctccagccttgagttgagagatttactaatgtgcctatgcatgtttctttcttgtgacaaagtttatcaattccttgtatataaatgctgtaaggcaccgaactgcctgggctcccctctcatattgagaaccacccgcgtatgatcttgtaaaatctggagttagaggagtttaattttttgtttcttcttaattgagtgaattaatccataagaagtcagaactacaagtatagaggatatgtgcaccatcatgttgcaaacaagacttttggccccagctttgaaacttactagcagcttaactagtacgcagtgatgtgatttcacaatctcctatcctattcccatagcccctgaagtcgccgcttccacgctggtgtagttctcagtgccagcgtgtggagggtgttcagctaattcagttatccgcaaatcgatccaagatgtgagggaataaggttcaaggaactggagtatgagttctatataactctttgatcttgtgggctccctagtcccaacgatgctaatcaagactgacggcaaccggcaaatatatatattacngtcattcctatattacatagtttgtttaaacanaatctaaataattagagggccgagcccgttgaaacattgatatctgtccgtggtggtggaggatggtaagaatctgaggtgtgcccgggtgccgcagagaagatcaacaataaaaccgaaaacaacttcgcctaaacacaaatgcgactacatcgtttatatgacactaaatagaccaacaactaaaattaatccgcatgcaaacatgcttagattacctgttcagctcgtcaagcaatatgaaatgaacccaattgtacttccacctcttctacctgttcaccagcctcttccaccgcaacaattccattaccacaagtagttggggttggtggcacatcacccacggttaaaatagctattcaaatctgacaaacaagcgatgaatctcagtcattcaatcggttttgtaccaaataaataggattaatcggaaacatactgcccaatgtcctacctaacctaacctacctctttgagataccttccgtcgctgattttcagccaccaggaaatcagtaatcgagaaccacagctcgcttgctcagctcctcgataggctccttccaccagctcgaatgctcgatgcgacgcagacaccgagcgcacgcagccgcctcccccaccggccgccgcttgcctccaccgctccacgcgcctggctacccagtcgcagcctccccgcgcttctacggactgtggcgcccgcacccccatatgctggccgcccagcggagccctcatcagccaccccccgctggccgcccggccgccggcgggcggcggcggcggccggtcgccaacaaggcgttgccgttgcgctcgctgctggggttgggctcaatcgcacaaggagttggataaggtggtcaaggaaaaagtacactttgactccttaaagtacgctgaattgattcgtaccctttaaccagagaactagacgattcccgaactattgaaatcagtgcaatttaactctctcgtcgattttcgagggtggttttattgacatggtggtagaactaaaaattatatgtaggacccacccacttgtcattaaaaaaatattgggacgcactgacatgtgggtcccacatgtcagtgggtcccataattttttttattgacaagtgggtctcacatatgtttttttaattctaatgccacctaagcgccacgtggaacaaagaccaggtcaatgccgccacatcagtgccatgtcagcaaaactaccctccaaaaccgctaaaggagtcaaattgcactggttttatctagttttctagttaagagatacgaattagattcggcgtacttaagggacctcaagtagactttatccggtggtcaaagctggtcaacactgccctctgggctgggccctagcctagttctgatacatccgggccatcattttgtctactgaaagggctgcaggaat

SEQ ID NO: 75215 - DNA, 7321 bp, Oryza sativa
tcctgcagccctagggggtgtttggatgggctaaaatttgttagtcctgtgtagatactaatttgcagtaataattttataaatgagactaatccgcgagtcaaattttttaagcctaaatttaatctataattaacaaatgtttactgtaacatcacataggttaatcatatattaattaggctcaattgattcgtctcacaaattagtccaaggttatggaatgtgttttttaattaatttatgtttaatactctaaattagtgtccaaacatccgatgtgacaaggactaaattttagtccctgtgaaccaaacagggcctaagcaagctgtaggccatcgctctctcacgcaaacagctcgcatgtgccagtcgaggggtctgtttattcagattctgagaaggaaaaagtacaccgaaggcaaattacaaaagcatctcctaaccacaaaaccggatacaacgcatcccctaacttacaaaaccaatgcaaactaggtccctcggtgtttttgactctggttttgaccgacgtggcagctgactcagcgttggacccacgtgggtcccacatgtcagcctctacttcccctcctctctccacctctcttcctctctctctcctcctctttccatgtcagcctctctttcccctcctctcccttcctcctctctctcacactcatctccctaggtaggtgttggtaattcttacggtcacagataaaatccgcaagcgcacgatatattaatgtagcacttcccctacagagtattccaagggtatcgaatccaagggaacgtatgtagtcagatcttcctccggttcattcaaggacaccaagcaaaggataggccaggatatagatgatttattggtgagaaacaatgtctgggaaagcttaagtttaatcctaacgtaatacttcaggcactggcaacccgttgttcccagatgtcgctctactacgtacccggacagggaggacttaagtgatctcgatagctatcaccacctctacacctacctcaaacgtactatgggatacgcagcaattattggataataatcacctaaacactacgtctaagcaattaatatctacttaagtgtttataactcactaaagtaattactatattttagtccggtatgctatttaggaactaaccaagagataattctcataagataaatctaaattactcaggaagaatattatattgaaatcagagtaataaacagaataaaatatagtacaatagagcctcttataattcagctcaaccttagaagtgtgtgagggagtgaagctccttatatagaggtaggtatgacggttgtacaacgcgaattgtcagaaatgccccgcaaccgccatcaggagatgatcagaaccgtccacgccaaaccccagcctgaacggctgagattttggttcggctgaacctgggctaggcccacctagcctggccttcggcctatctcctccccttgtcctcctctatctatttctcggagtttttggctgagtctttgatattttgatgaagttcacaacccatccttgtatggatacatgtttctcctcactttagtctagatttcctcccaacttcggggtttaatacctgcatacaaatatacaccaacactcatggaatatgtgagattaaacacctatcactatgtttgatgttttattatctgaactttatgcagatgttggcggtatagaatcggcatttaacagccgccaacaaaaccccccacacttcgctctttacttgtccctgagtaaaggttagcgtagaatgaatttctccaagatataattcaggcatataaatcattcacaaccatacctgcaccttcgaactttatcagtagctacttaccatcttgagtaattgataaatggaacgatcttgattccagtccttcttgcttctcctgtcagactcatgggattttatgaattttcgcaaaccagctcttttcctcatattgacttttatctctcaaggatatatattttcttgtggatgctcaccaagacgaagtgtgctagaactcatctctattctaaggctgatatgtggagctcggtagtgataaattgtgacatacctgcatcatatatattgcaaagccaaaaatatggactcaagaagatcatcagtcatactcctaaatcaagggtctttatttgtggtggaaaaatgggaaagtaaaatattttgtggaatgatggaataaagaaatggttctccttttttcctttactttctcctccaattttcttttcttgcatgaatatggaaggggcatggctatatgcacttttttcatcatgctcaatgttttgagagcaagctttatttctctctttatttctctctcttttcttctatagccatgcctttccctccttttctcattttctttttgccaaggatcttctaggagaagaaaacatagtctaaagtaggagttttattgaatggaatttttgtgggaagctaacttccggtgtagaagcttagcttgattaaatatgtggaaatgaaagtggaaatgaccccttgatcatgagaatatgaaagatgtctatcacgagtcacacacatttgacaaagctcaatataatgtcaagcagtcatatgcatgataaggttcatcaatgatatacttgcatatggccttggtaggtataaaatgaagtcaataggaggaatgagcctttaaaacattttttattttgaaaaacaaattcccataaatcatgacaacagtcgcgataattcctttcatctttaatcatctcacatgtagcaatcacttagatgtataaggttccctaaacatggatggttattcataagtacaagtttagctgagaataatgaatatacaagagtaatcataggaagaatttcattagttggaaattttatttttttcaattatgcttgaaccaattgtttctagaattttcagctctagtactataccatgatggagatatacagataatagacgtgcttacctgctcacctgtaaaaaatgagagggattggggccagcactgcaattttatgcagagttcagtgctttccaggtgttcagaaattcagtaattttcagagtatgtgcacgtcagaagatgggatatctcccccacacttattcgaaacctgaactttcttaaacatgaaacaaaaacaaacttggcatacattggggttaacaccaatgagccacattatttatagcaagtacttgcatgattggaaaataaatgaccaagcaaccactactactttattcatgggagaggagacatccaattagcataatactttttctccttccccatctctatgaatgcacgcttaatcttagtgcacaaaccacgactaagggtatcaaaattgtttctaagctcagtaagctctacccctagttccgcgttgcgatccctaagctctatgttctccttgcggagtttcttcacttgaacggcgagtttatggaccgagggctccggcgattttacttcatcttcttgaaactggccgggtgcccttacaattggagggggcgtcaaatgatgcttcaccttcataggtggagggctaagggactccgctgccccctccttctccgatgtcgtcaaaggccggagcaatccttttccatacccactgccgggagttcgcactcctcgaatgcaaaattgctcctccttggtagtggacggagtggcggtaggtgtggtgtatttgtggagcacctcatcccctgccttggtgaatagggtgcccacataccgctcagtgggaggcggagcggccttctcatcgtgttggaaaatacgtcgcatcttcaagagaccgagctcacccattgtcagccgttgcgtaggtgagtccccccggatttttatcttagtaacatggcgaggggagagggatcgcgctgccgaacggggccgagaagggttcggcctaaccagcgagctcgccggccggctccaaatttgctggggagccgggcaccgtcacaaggggttgtgcccacagtgcgtttacccctttcattgtatagttctccaccgggatcaattgatttgccggtgtcggctctctgtctaggttgtaggtggaattggaggatgaggcaatgtatgggatcaaggatttgccagccattggtgagttaagggtggaaattaaggaatttagttaagatggagagggagtttgcaaaggtggaggagaggaggaagaacaggtgttctgagtttgattcgttcgatctacctccgaaagcgcatcacaacaaactacaaacgagcatgggagaccacagtttgaaaatggtccctcccattgactatgcaatttcccatggccgaaaaacttaaccctggagttgaacatcaacactttgtctcctggcttgaatttcttaatttttatccttttatcataacagcacttcgtcctttctttgtatatcttagtgttgtgatatgccttttcactccattcttcaagttcagcgatttgcattttcctccattctcttgctccttcaaagtccatattccagttcctgatggcccaatatgctctatgctcgagttctacagggagtcggcatgacttcccacagactatctgataggaggacaatccaataggtgtcttgtatgctgtccggtatgcccacagtgcatccagcaatttatccttccatcctgttcccattttgttgaccgtcttctgcagaatattcttgatttgtttgtttgaagtttctgcttgaccgctggtctgtggatgataaggtgtggcgacattgtgcttggctcccatgtcttgtaggaggtctcggaaggttttgtcgatgaagtgcgaacctctgtcacttatgaccatcctaggggtaccaaaccttgggaagatgatctctgtgaacatcttcttggcatgctttgcatccgcggcgctggacggcatagcctcaacccacttggatacatagtcgactgccaccagaatgtactcgcagttgcgggatgtcacgcccggaaaatacctttccgaacgctagtgtattaatccccatcccaagaaaagccggggtacaccacaacaaacttgatacaaaaggcacatctttattaattattacaataatatttacattattacaaaggcacgttaggcctgacaacaaaaaaaaaacagcaacggacttgcgggcctacgactctatcttcacaggcactcaactggggtataagccaggactcaacctaaaactttttcttcaaaaagcttctctgactggaggggaaaagattgagcaagaatgagtacaaccaacatactcagaaagccatgctaggaaatgaattataatgcaaaggggaacaaagagttggcataaaagggttcatttttgcgtaaagccaaagttgcaatattttgatgttttgaaagcatagtttaaactcggtcatatatctaagcaatattatcacggttgcgaaaccacgcaaactgccttaaacccaggttaaccacctatccaaagtgccatgaattccatccatcacttagaagaaaaacactaacttggtacattgctaggcttgcccataaccgagggcgcggctattcgaatagttttactctgatcagtgctgtacatctttacccacaggacacaatacttgacttcatgtcagccatgcatcgtgataccgaaaaggcacctgaaaagtcaagatcatgacaagactatccacctagctcaacccaaaacagaaggacccgctaaggtttcgccgcccgccggtccccgacaaggtaaaggttgccggatcccctgagacgagacatgccccctcttgcgccaggtcaaaatcggcctcccctggccccagacctatcataccaatggcgtttgttttgagatgatctagacttctagtcaggccttatccattagacttgtggttgcactgttatgcttcgcaacataggcccgaagaccggtccttatagtggccgaggtgcttctaacaaaaccatgcacctcgcggcccaccaaaaacagatttagaaagttttgaaagagattccaccatatcatggctcaagtagccacctaatcatcattcttacatattttagttgttacccacagtctaatttataaaaagggattctatgttggatctaagcatagataagcccaacctagagcaactagtaagtccatcacatagggagccatactaatcattttatctttttactaaggttgtcaagagcatgggtagcaattcaacaacatggctatataacaaagaacattggaatattaactattaaataaacaatggtgagcacggaataatttataaaagcggtgcatatagaagtaaaacaacatagtttttgcaataatgggattcaatatgttcaaggaatatggtatgacttgccatgctcaaagagaaggtcttctgatgaattgatctacacttcgggaacttctgaaacgacagcagctacatgaacacaaaacaaggctacaaatctaaggaagagacaataacaatacataaaaacaacaaacacaagttctttaagttataacaaaaattaaacaatttaaatgggtcaattaggagctcgtatggccgagaaatgaccattcgaattttaagtgcaattaaagtagatatttctgagttgtttaattattattgttataccgttaaattatgcgcaatgtaacattgctcgagagagaaaggatcgagcaactggcaaccgggactaccacgtgagctgcacacgtgggcaatccacgcggcgaccacacggggaggacgaggagagggcagcgagggaagaggttctcaccacgggcacgacgcggcaagggaacaacaacggcgaccagcgacgaccttggcgcggcgacgacgaacgaaggagggcgacagagacgaacggatcgacgaagagaggacgactctgacgatcttcaggcttgatgaagaggcggacacgacgggtttggcgctgtggacttgacgacgacgacgacgggcgggacttcatcttgacgagaacgacgaccggaggaaggcgaggcgatggggcgacgttcctggggtcttcgggcagtgaggaggcgcggccgacgatgaagacgatgagatgaagccgccggcgctccggcgacgagggagggctgccggaggacaaggatgaagtcgaggtcaccatt

SEQ ID NO: 75216 - DNA, 18578 bp, Oryza sativa
aagaaggagaagcacaagcatagcaagcatgatcgctatggccaagctcaccttgggatgatcttcggctccgactccgagtcaagctcaagtgatgaagaaggagttgccacgttcgccgtcaagccttcatcaccaccgagattcttcaactactcaagtgatgaggacgctcccatttgcctcatggcaaaggagtctaaggtaccctctcccctcaactcatttaatgttgatcttgttagtgatgaggaggaagatgttgaggatgaggttatggatgacgagttgttcaaatccataaccaaggaatctataccacacttgagtgagttgcttgggagacttgaggaccaatatgcaactcttgagaggcaagaggctttgctcattcgtgagaaaaagcgatctcatgaactcaagagtgagcttgctaaggagagagagaaaaatgaggctttggtacggctctacaagcaaaccaaagagtctcatgctaatcttgaggtggcgaacgctcaacttcaagagagagtggatggcttggacaaagcatacctctctcttgaagaaaagttcgaaaccttaaagaatagtgtctctctccctagtgagccgtcttgttccaaaattgtcccaagcaatgaatcatgtgtgagatgcaaaaatattgatattgaagcttgtgctactaactctatttctttgagtgctttgcaaaagcaaaatgagaagcttatgtgactctttcacaatggcactacttaagtgccatatgggtagtaaggccctaaaggagtacctaggctatcaaagggacaacttcaaccatgagggtcttgggtatgttcctccaccaaaaggaaaggtggacaagagtgtgatgatcaagaggccccaaggtcttagcaattttattaaggccaaaagtatccttcctaatgattatgcttcacattgttcttttgatgcatcttatgttcttaggaagaatgctagtggtcgtgttgttgctaagtatgtaggcccgaggggcaaaaatgtttccattaagagagttctttgggtgcctaaggcacttgtcactaacatgagaggacccaagcaagtgtgggtacctaaaactagaaattgatctcttgtaggaatctctctccggtggaagaagttgggtgattgatagtggatgcacaaatcacatgaccggagaagaatcaatgttttgctcccttgatctaaatggcacttcgcaagagaacatagtctttggggacaatggaaagggaaaagtaatgggattgggtaagattgcaatctccaatgatctttccatttctaacgtccttttggtaaaatctctaaactataatctcttgtccgtttctcaattatgttccatgggctataattgtctttttaccgatgttgatgtgaccgtatttagaagggatgactcctcggtagtctttaagggtgttctcaagggcaagctttatcttgtggatttttcctcaactaaagccaaacatgagacatgcttagtggctaagtccgacatggggtggctttggcatcggaggctagcccatgttggtatgaggaatcttcacaagcttctaaagcacgatcacatccttgtctaacaaatgtactttttgagaaagatagggtgtgtagcgcgtgtcaagccggaaaacaaattggagctcatcacccggtcaagaacgtaatgacaactacaagaccgttggaacttctacacatggacctcttcgggccaattgcttatctaagcattggaggtaacaaatatggtctcgttattgttgatgacttttcacgcttcacgtgggtgttcttcttgcatgacaagagtgagacacaagcaatcttcaagaagtttgcaaaaagagcccaaaatgagttcgacctcaagatcaagaacattcgaagcgacaacggcaaggagttcaagaacatgtgcatcgagagtttccttgatgaagaaggcatcaagcacgagttctcggctccatattcacctcaacaaaatggagtagccgagaggaagaataggactctcatcgagatggcgaggaccatgttggatgagtacaagacatcggactgtttttgggccgaagccgtcaacaccgcatgccacgccattaaccgcctctatcttcaccgccttcttaagaagactcccgatgagcttcttaccggtaacaaaccaaatgtctcttactttcgtgttttcggtagtaagtgcgacattcttaataagaaggctaggtcctcaaagtttgctcctaaagttgatgaggggttcttgcttgggtatgggtcaaatgaatgcgcataccgcgttttcaacaaaacctccaatattgttgagatcgcgcgtgatgtgacatttgacgaaactaatggctctcaagtagagcaagttgactcacatgtgttaggtgaagaggaggaccctagcgaagcaatcaaaagattggctcttggagacgtgcgtcctagggagccacaacaaggggcctcttcctcaacacaagtggagccacctacatcaacccaagccgacaatccctccacttcaagcttggatcaaggtgaagaaggcgagcaagtgccaccctctccgataaatctagctcacccaagaatccaccaaagtatccaacgagatcaccccaccgacaacatcttaggagacatcaacaagggagtatccactcgttctcgtattgcaaatttttgtgagcattactcgtttgtgtcttctattgaacctctaagggtggaagaagctcttaatgatccagattgggtgatggcgatgcaagaggagttgaacaatttcacccagaatgaagtgtggactttggtggagcgacctcggcaaaatgtgattggcacaaagtggatctttcgcaataagcaagatgaggccggggtcgtaataaggaacaaggcgaggttagtggcgcaagggttcacccaaatcgaaggattagattttggtgaaacttttgcgccggtagctagacttgagtcaattcgcatattgcttgcttttgctactaacctcaattttaagctatatcaaatggatgttaaaagcgccttcctcaacgggcccatcaacgagttggtatacgtggagcaaccaccgggcttcgaggatccgaagtatcccaaccacgtgtacaagctccacaaggcactctacgggcttaagcaagcccctagagcttggtatgagtgttttcacaattttcttgtgaaaaacggctttgagatcgggaaagccgattcaactctttttactaaaagacatgataatgatatttttgtgtgccaaatatatgtcgatgacattatatttggttctactaacaagtcttttagtgaagagtttagtaggatgatgaccaaatgttttgagatgtccatgatgggtgaattaaagtttttcctcggccttcaaatcaagcaactcaaggaaggaaccttcatttgccaaacaaagtatttgaaggacatgctcaagaagtttggaatggagaatgcgaagccaatccacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgcaagatttcaagccgctccgaaggagtgtcaccttgtggccgtgaagagaattcttagatatttagtgcacacatctaatcttggtctttggtatcctaagggagcgaggtttgatctcatttgttatgctgatgcggattatgccgggtgcaaagtggataggaaaagcacatcgggtacttgccaattcttgggtaggtcccttgtttcttggtcttccaagaagcaaaactccgtcgccctatccaccgccgaagcggaatacatttcggcggggagttgttgtgctcaacttctttggatgaagcaaaccttgagagactatggcctcaatgtgtccaaaatcctactcctatgcgacaatgagagcgccattaagatagccaataatcccgtacaacattcccgaaccaaacatatagatattcgccaccatttcttgagagaccattccacaagaggcgacatagacatccaacatgtgagaaccgacaaacaattggcggatatcttcaccaagcctctagatgaagctaggttttgtgagttgagaagtgaactaaatatcttggattctcggaatgtggcttgatcttttgcatgcatttgttttcaattactagaataagattgcatgccacatcatgacaaagtgatcattcaattcatgaatgaacactagtcataatctaagtggatagcttgaatctatgtgtacggggatatcttgtctcatgataattcactctcctttgatctttggatcatccatttgacttgtggctattgttttgtgtggttgattgtgtgctagccatgaactcaaatggggcctaaatgttcgaccattcctttctctccaactcccatcaaaagtttgtgaaaaattgaatctcttcaaaattcccggtgcaattcccttaaaaaattcatttccaaaagtttgcaaaatgttttcatcaaaattccagcaaaaatcctccctttttggtgcttagatgccaaagggggagaagatctatccttttatttattatggtcgaacatgagtggttcttatttgtatgagacatgtgtgtttcttaagttagtttaatgctttgtaagtcattattgtttaattatgaatgcttgggatgtaatgtgatatatttgtagatgtgatgaatgtgatgagcaaaatgtgatatatttgttgtcttgtgagcttcaatgtggatgcaaagatttagggggagctctctacttgctttaatgcacacttttaggcggatctccaccaaaatcctaatcttttattacttctaagtatgttgtcatcaatcaccaaaaagggggagattgaaagtgcatctaggacccctcatttattttggtgttaatgacaacacaattagatggtaactaatgctttttgttgagatgtatgcaaggatgaaaaaggagtggatgtcaacacaataagtattgcgacatcttttgtggtaattgtcttctaatccatgtatatcttgtgttcttgagtattaggatgtcgtactattaagagggatgccacatgcatataattggtagaacactagtgctcaaaatcatttatttgaagtgttcctgttttatatctgtcggactatccgatgttgatcagactatccgatgctcagactatccgaaatttcacagaactttgctcactgtcttgggtctgagtgttggctaaaaaatatcggactgtccgatataaggtcggactatccgatacgtcggactatctgaaatttctcaaaacttcactctctgttttgaattgctttttattccttttgagtgagttttaaatcagactatccgatgtaatcggagtattcgatgatccagagactccgaaattcaatggaacttgagtctctgtgagaggatgaaattcttggttcaaaaataacggaatatccgatatgacatcggactatccgatcgatcagattgtccgaaattctccagaattttgttctctgtctctggcctgcttgggggtcaaaaacatcggactatccgatgtcatctcggactttccgaggtggcatgaaaagattctctcccaacggccacattttgggggcttctataaataccccccacctaacccttttctagggttacccaactcatttcattctcattcactttgggttgagcttggtgtttaggtgctttggatctttgagctctttctccctctctcaaatccctcctcgttctttgtgtggtggatcttggtggttgtggatttggtgtttgagggcctagtgtgtgtttcactcgatcttgagcactagggtttgactaagagttgtgtggtgtttgttactcttggaggttgaggactcctagacggctaggtgtcactcccgagccaccgatctacgtgtggttggccgggagaagtttgtgaaggctggatctcgcctccgcaaggaaagagataccccttagtggaaggaggagtgcttagtgcaacctcttgaggaaagggttagcaaagacccggctcttagtgagctcctcaacggagagtagaatcccctcaaggatttgaactccaggaacaacttcgtgaacttcatcattggtgatctcccttcatcctccttttagctttgcttaattgtgccgctatagatctagtcgctgtttgtgctttactcttgtttgtgtgatagatctacttgttgtgcttcattggtggatcagacagtctgatccaacatcagactatctgatatttttggatagtctgactgtggatcagactttccgaccttatttcagttttagcttccgtataaagttttaaattagcctattcaccccccctctaggcctatttgaccctttcaagaagttctcttagcagctgccattagaaggagataggttttttaactcatgatgcatacttaatgatgaaccctaagtttcactcgggatactcaaggctgtagttggcccgatctttccgtgagttgaagataactacgatttgggagaaacgttgacgacccgactacaaccgtacgagacgttgttgtgttgcgccttagcgatcgatacacctctccgtgggttgttgatcttgccggtgcagatcaaccttattcttgcaagcaaatcgaagaaacaaacaagaacaagataaaagcaatctaaattgcaaatagcaattgagtacaaatgataagtttggtgttccgtaatgagcaaaacgacgatttaaccgttcacgggattacccggtaaagtagcaaagctaaactttaatctaaacaaaacccaagaaaccctgaaggggaacctaactatttatggagatgggaggacccaaggtcgtcctccacctggttggggcgcaccccacatgggcctcacttgggccggggtcccaaacgaagttacaagcccataggcccattacaggtgatgcatcaccttgttctatcaattgtagctcactgagatggaatttcgcaatgaggatagatccgttggaaggaggactccgagagatttctataaagtactcacgggccgaaaacggagctcgtatgcagatttggcggccgtttgaagtcagcagtgtagcaggtagccgaatcggattccagctcttggaggacttgatccttatatcatcttgtccatccatgatgtgagcaatggttgtatctgtagtagccatggtcacatcatcctccccttcttcacggaaaaccgttctcggtttttccgtatggtgctcgtcacataggccctgtttgattcagcttaggattattataatttggattattaggagtaagctgaaacaaacagatagcttattacgatagattattacaatctataagctagattactataatatggtaatccactctaaaggtgctttttctagattattgggtggctaacagctaacatacaactaataatccaaagaaacaaacagttaacagcttattccatgtcggtttattataatctaacttatagtaatctggcttaataatctagattacaataatcttaagctgaaacaaacagggccatagtctattcaaaataacttgtttcatccaatcaaaactagagaaactcgaagttgtgtgattagcaataacatgtttctctaaatccgaacaaatgaaaactctatgcaccaaatatattcctctatcattatatacgccaaagatatgaaaaatagcattagttggacatggaaaatcatacttagcaaataatttatcctccaaattattgagctcacaaaaatcatcaaactgaacatagccaaaagtatttaaagaagttatcaatttatgttcctcaacatcattagcaatgtgaacaacatgcttaaaatcagcacacaatgaaacactagaaatagcatgttcattcactagttgtggcagtgatataagtgaagcattatcacacaactcttctttatcacagggaacaacaagtaaatcaacttgtgacaaaggcaaatcagaagtagtttccaccaaaatttgctctagattagtatggatagtggtcaaatgtgactcatcaaaagcacaccaccttgagtaataacagcaccatttaatttaccttctatgccctcttcagataatgtaggtgcatcagtcttctcttcttccttcgtgagcgatggagatggcatctcgatcatattgctcttctcctcatggtgaatgttctgagctccctgcaaaatgtcagtaataggaggcacaagcatagattgtttctcccttgggttctttaaaatattgctctcaacactacaagcaagcatgaacaagtggcctatatgattatatgtcacgttaataagcccagtctgaatatcagaattaagccctctaaaaaatctagtcattgtgctctcattgctttcttttaaaccactataagtggtacaaattttaaagtcatgaaagtactcccacacggctttatcaccttgttttagatgttctaatttctcaaggagagtacgtttataatatgaaaacacaaaatttttcctcatcattgttttgcattcatcccaagtttcaagcttattgccaaaagtataccaccaaaaagatgcagaaccggtacacttattactagcagccttaatcatttgagcattagagaaatcatactcatcaaattgtttgtctactgctagctcccaattaccataagcggcggaatcataattaccatcaaaaacaggcaaattagattctacccttgcaagatcattatcatgtaccttatatgcaaagagagaagaagacgatatatctcattgatggtgaagaagtagatgttgagcatgaccatctcgtttccccttgcacaatcctgccatggttagtagcaaacaagaaacatacacaagaatatgcatgctcctatcaactactaggtagtggcagctgaaatatcacacacactcaatcttttcaccaagctcttacaagttcttaccaaagcaagcggaatagtgacatacaccgactcaaccaagcaccccaatggagtttggatgtatcgatgccttggcaaacacttgctgtttggttgcaatcagatctgtggagctctaggtaggtttaaatatgtagcaaagaaaagcaatggttcaaatcagataatgcaaagttgaataattgttcaaagtcaagtactgtgctggtcctaggctagaacgtactaaagatgcgagcctagacacgaacgataccacaagatagcactagaactaactcaagcacactctgatatatgaaagtaatctcaaagatacaactgattcttctcttttccttcttttttttcctttcttttctttttcttttatttttttggtgcggcttttcttttctttttttatgcacctttctgcctttttttctcttccttccgtttttttgattttttttatcaaaaccgacaaaaggacctcaatgcaagattatagggactcaaatataaatatgaaaatttatagggactcaactgtaaaagtccaaacccaaaattagaactatacaaaaatgaaatgctctcgtcccataggttccgttttgcaaacagatctccaatccgacactctaaaaatttttaccaagctgtctagcatctcacagtatgcattgaaaccgacagggagggagtcggatagatgggaaaccgactgtctcggctgaaagtttggatatctcgcatgaaaggaaacaaaaatcaatctcaacagaaaccgatctaatctaatctaccaaacagacgcccccttccctttttttttcacgcgcaacagcacggccacgggacctggcagaacaacacgccatacaacataaaacctacacgcaactccaaaaccgaccaacaaaaacttgtgaaaactacaaaaatagaaccgtgacggaaagacgattccgttttcgtaggtcccgacaacaacaagcacgcgacgactgtggtataaaatgtgaccagaactcgaaactctaaacgcactagacgctatgaccagcaacacgacatgacgatgcaacacaaaactcaacaacgcaaaaatagaaaagaacaatgcaatggcacaaatatggctaggtacaggatgcaattttttttgtagggcaatttttctcgatataggtaaataaaaaaaaactcaccgagcaacgaaagctttgataccacctgatgaaccctgagttccactcgggacactcaaggctgttgttggcccgatctttcggtgagttgaagttaactacgatttgggagaaacgttgacgacctgactacaaccgtacgagacgttgttgtgttgcgccttagcgatcggtacacctctccgtgggttgttgatcttgccagtgcagatcaaccttattcctgcaagcaaatcgaagaaacatgcaagaacaagataaaagcaatctaaattgcaaataggaattgagtacaaatgataagtttggggttctataacgagcaaaccggcgatctaaccgatcacgggattacccggcaaagtagcaaagctaaactttaatctaaacaaaacccaagaaaccctgaaggggaatctaactatttatggagatgggtggacccgaggtcgtcctccacctagttggggtgcaccccacatgggctccacttgggccggggtcccaaacgaagttacaagcccataggcccattataggtgacgcaacaccttgttctatcaattgcggctcactgagatggagtttcgcaatgaggctggatccgttggaaaaatgactccgagagctttccatgaagtactcacgggtcgaaaacagagctcgtatgcagatttggcggccgtttgaagtcagcagtgtagcaggtggccaaatcggattctagcacttggaggacttgatctttatatcatcttgttcatccattatgtgagcaatggttgtatctgtagtagtcatggtcacatcacttatctttgtcctagattttctttttgaagttgtgtataagcactaatactgagatgtgcacctctgcatcagcataccagagacatgagtgaaatcaatggagtcagaaggtattttgaaatatttgattgagaagacatgcttgagcatcataaggtttatctttatttttcccccaaatgttgcattatatcctcaaagaaaacggtgttatacatgcaaatattgatgatggtattaattaatcatggcttgcatttgacaaacatgaggctaaaaatagttagtactttctggttatgtaaagtccttttccaagagttcaattcttttatccatgaggaataagtattatcatattaatgtgctttatcaaggtggtttgtactagggtcacaagctttaagacttgaaatgctatgttttttttttgcctccatccttttttgtctacacatattctacagagtgcaactagatcaaatcagacttaattatctccaaactccaatagaactgaacaatatgtctatcatgtgatatattgttgatctttgcaacattctgtttaactaatgtgaaattgttaactactttcctcagttgatggcgtataactcttgtccacatctcttccaggtaaaacgcattattcttccccttggtcttggaggtgatgatcaatatgattattattggaattaccttgtgtacattgtttctacttgtgcagaactttttttacattgatatctttaaactttgacactttttttacagtataaaagcaaatactttggttctttaactaaagaaggaacttctatggcctagaaaattcgcaccgtgttgaagataataaatcggcagtactaactccctacacaactgttgtccacaaacctcaatatagagttgtattgatcaaaccagagaaagccatgcatattactagatcttttggtctcaacatggtcatgatgtatgttgccggggaacggtaattgatcatttccgaacccagttcatcctcgtatctctttttcactttttattctacctttacccctgctacccagagaagtattcctgtcaaactcttctcgactatggagcaacctctcttggagctatccgctctaggggcgaattttatgagccatctccttcatcggagccaatttatacaactggctatgaaattcgccccgaactcatcagtatgattagagaaaatcttttttctagctttgatctagaaaatccctaccatcatctgtgagactttgagcaagtctgttcatgccttaagatttgtggtatgagacaagaaactatatggtggaaattgtttctgttctcccttcaagagagagcgaagcaatggtacacctctaccattggatgtgtaaatggtagttgggaaaagttacgagtcagattctgccttgccttcttcccagttactcgtatagctgcccttcgagtagagatccttagtttccagcaaatcaaaaatgaatcaatcagtgcaacctcgtcgagattcactaatttagtgcagtccggaccaaccttgtccatacccgaatatgtactcttgcaacatttccatacgggtttggataaggaatctgcattctatctggacataaccatcggaggatcattcatgcacaaaacaccatcggaaggaaaagtaattttagatcgcattctagaaaatactcccttcatggcacaatctgatgaaccccagctagaggcatccgtgtccaagatagaggaaccttcagcaattgagtcacaatctgagccttccacttccactgacttgattgatgagaaagttcctgagcagccatccgttgagaatgaagaaattcagactccggctcgtgccacaactctgttcagggacggttttgacgaagattatggcaactccctgaactatttcagtaaaaagaaaccactcgtccccttaacgcctactgatcctatggaacttgggttcctcagggaaactgtttgggagctaacatccataatgagcaacgaatggctaagagaggcagagctttcatccgaagtaatttggataaatacccctcccgaatcattccttgccatctggaagggaacgatgttggtattctttacagtccaactgtcggggttaatctcatctctgagtcatttgcattcgcttatttgagcgataaggcagtaaccccgataaacaaattcttcaagcacccgaacggaaatattattgaaggatttaggattatacaagatgtgcctatctgctttgaagatagggaggcagtcttggatttccacgtctttgaaattcaagattttgacattctaatcgggcttctcattgagcaactcctaataaacacgccccggttagatagcctcaagataactttgggagggaatgaattctcagtctcattctcgcgggcaaggttcgccttgaacgactctctcccagagattgagtcagcggaggaggttacagcagttccccctcacgagtctcccaagtcccttttggaagatgaagtccctgacttcatcaaggaagaagcggaaccccgagagactctcgatcttccaatcttggaaccactacctcgacctccgcatgagcttaaacctctacctcaaggcatacgctatgctttcttacacaatgacagagaagcccttgtcataatcagtgacaagctctccgaagacgagactcgacgtcttctgactatgttagaaaagcatcgcgctgttcttggctattcccttcaagatcttagagggattaatcccgcgctttgcacccatcgtatcactattgaccccgagagtaccccctccagggaacctcaacgacggctcaataatgcgatgcgagaagttgtaaagaaagaggtcctgaaactcctgcatgccaggattatttattccataccatacagtgagtgggttagtccggtccaggttgtgccaaagaagggaggaatgacggtcgttgcaaatgctcaaaatgaacttattccgcaacgaaccgtaactggatggagaatgtgcatagattacaggaaacttaacaaggctacaaaaaggatcattttccgctaccctttgtggggacacccaataaagtcatggtgcacccacgaatacgtaactgcccaggatattcagttacgcatgaaatgatataaaagcataaacttcgattatacaatacttaagtcacttagttcacaacacaacataaatacaaaccattacatatatggcctataaagccttatttctacaaacagataaactgctagacttcaccacaggaactgcctgagcgtaggatgacctagtagaaaccatagctgtcccactctaacgggtcaacaggatcttcacaagcatcttcctcctcatgatctgaacccatttatgagtacaaaaggtactcaacaagacattcttatgataataaatacaataattgcaatataaaacatgtagtatcgagagctggaaggtttaaaccctaaccttaacaattatttcatagagcctaacttaataaacatttgatataaacaacactattgaacatttaatttaaacaataataatgagcataaaaatatatatgttacttataaataacttgaatagaacatcaagtaataaataagttaaccatattaattaatagccattttgtttaacttgtgcccataatctggaatcacccatagacacatctccattaaccgggagcacggtgtattcgaatactcaacgactctgcagcgtctacccagctttacccacacgatacccacagctggccaggctgaaaagtaacaaggtgtaatattgctccatatatctctctcccttctgcctagtaagttaaaaggatgctcgggatgttgctcagagtgatccggtccgaggtgtgtgccaacctacctccgcatccacttaccattgttcgttactcgatgagcagcccagaacttcatgggcccatagggcaattctgaactctcggggcccatcgagcccacatatataaatcatataaacatgaaccatgtcactttgcttcacacacttgaaagctaatggccaggacactgaaaggcctgcagaagtttaatcaattggagcaatatacgactaggttcgataactcgatcgtgtggatgggcgaaactatatcattcttattgacacaaggggttgattattatatcaattttaaataagaaataaccataaatatatccatatatccatcacgaccataaacaggtccataaaaccaaacacatgaactctatcgtgtgtaccacccgctcacatgcggtgtcaacaattcttagcatatagccataaatagttccataagcatgtttcatatgcagtaataatatccatattaaatcgatagcatgctaaataattaccaatttgtttaagtgttcctcaaattttatcctaagttggttagactccaaggctcattaaggtgtttataacaacaacagaaaatatagtgcaataatagtaatataattaatttaaaagaattcgtgcagtctatcgtactccaaaggacgagtacgctaccaaaataactctctctatctactgggattaaattgttcaagggagggtgcatgtcttgcaaccttcggactcgatgtagtcgtacaaaccgtctcctcctggcacggagatttcactcgcttcgactatcggaccaacattggcgttttctatttacgcaacaatcatcaccacaataaataacaaaaaaacaaagataaccaaaaacaaatagtatcctaaagtgcaacaatgggtgaaaaggatttaaagaaataattttagggatttttggaatttcggtgaacggtgaaccctatggctaaaattagggtcacaacaacggatactcggattgcaacgaaactaacacggatggattcggaataattctaggagtttggaataggtatcagatttcgattttgaggtcaaacagatgatcaacctgatagaataagaaaaaggatttttctgatttatttttcaacaggaaaataggatttcctgtccttctcgttctctgcacaggagccggtcggcaactccctgacgccggcagtggagatgccggttttgggcaagggggcgccggttttgtgatctagaagccaaggcgattccgtttttgtggtcggcggtgagagaagtgccggtggcgaggctggcggcggcgagcagaaacgggaggcggaggcggccatggcggcagcgactccggcgaactccggggagggcggtggcctggtgagcatcagtaaggcgaggggagtctaggggtggcggcaacttaggctgaggcgtcttggagctgcggcgcaccatgtggccggcggcggccgaacagagcagtggcgacgggaggcggcgccggcgatgttccgacaacggattggatgatgatagagaggggaaagggagtattcagcatggcgaatccaattttaccttcaatttcagaagatttgcgttgtatgcgacgaattttggagctcaatcaatttcagaagatttttccttcggtgatgacgattgagttaacgggagtaggggcggatttgaggaggtgaaagaggttgaaattgcacttcttttgcctctggtcttgagccttctagttgagagacgaaggaaatacgaaggcgggaagctggaggtgttatccggggattcgtccgtcgatcggcctcgtgtgtgtgcgtgcgagcgtgtgggatgcgcgggctggcacgagctgggcgcgagcgcgcgcaagcgcggcgcaatgtggcacgggattggcgcgaggcagcacgagctggctcggcctagccgaatagaggaagaaagaaaaggaaaaacagagaaaggaagaagaaagagaaaaacagagaaaaagggaaaaagaaaagaaaaataatagagaaaaggaaaatttggggaaacttaaaatagatagaatttgaattgatgtcatatttagatggtgcgatatttgggatagatttaaatcggattcaaaggaattatttgagggatgatatgcactttgcgacaaaaattaaacgagaaaagaaacaccggaaacaaacttggaaaataatattttaaataaatgtctaactcgacggttatatttttagagaaccaaagcaaactaattcggttttaaaaagttgtcaaattttagggctgttacacccttcattgatgaaatgttggaacgactggcaaatcattcctttttctgtttccttgatgggtattcctggtatcatcaaatttctatccatccggaggaccaaagtaaggctacattcacatgtccgtacagtacctatgcgtatcgtaggatgtccttcgcactgtgcaacgctcctgcatcccttcaaaggtgtatgatgtctattttcttggacatgatcgaggacattatggaagtcttcatggatgatttctctgtctacggaaataccttcggtcattgtctgcagaatttaaacaaagtcttacaacgataccaagagaaggatcttgtacttaattgggaaaagtgccatttcatggtctatgaagggatagttcttggtcatcgagtgtccgaacgatgaatcaaagttgatcgtgccaaaatcgatgtaatagattagcttcctcctcctatgaacattaaggggatccgcagtttcttgggacatgccggcttttatagaaggttcatcaaggacttctctacaatcacccgacctctgaccaacctcttagctaaggatgctccctttgagtttgatgacgcgtgcctaaaatcctttgaaattctcaaaaaggcactcgtctctgctccaatcattcaacctcccgattggactctgcccttcgagattatgtgtgatgcaagcgatttcgatgttggtgtggtcctgggccaaatcaaggacaaaaagtatcatgcaatctgctacactagcaaaactctaaccggagctcagttgaattatgcaactactaaaaaaaatgctcgcggttgtttttgctatcgataagtttagatcttacttggtgggagctaaggtgatagtttatactgatcatgttgttctaaagtacctgctcactaagaaagatgctaaaccacgtctcttaagatggatt

SEQ ID NO: 75217 - DNA, 655 bp, Oryza sativa
gttttgtcttgatttgcaccggcattttcttaggctggtttataaattcaattttaggcttaggaggagaacttagggtgtgacacctggtatggccggtctgaccggttctaggcagagcgctggagggcacgtttcaatcaattttaaggccgaattaattgtgaattcggacatttgtgcccaagaaacagaagaagattggaggattcctttgattcgatatttgaaagatcccacgcttaaggttgatcggaaaattcgacggcaagcattcaagtacacattgcttgatgaagatttatatcgccgaaatatagatggtgtcttgttgaagtgcttagatgaagatcaatctaaagtggctatgggagaggtacatgaaggaatttgtgggactcatgaatcggcccacaagatgaattggttgcttaggagagcggtgttctattggccgaggatgattgatgattgcttcaaatattatagaggatgtgaaacttgtcaacggatcggcaatgttcaattggcgcccgccgccgtgttgaatcctataatcaaaccatggcattccgaggttgggctttagatttcattggtcaaatttatccttcgtcatcaaaggggcataggttcgtgctagttgctacggatt

SEQ ID NO: 75218 - DNA, 1462 bp, Oryza sativa
  unsure (1)..(1462): unsure at all n locations
aagcagtgtaccgttcctggatcataatcacccccttataaaacaaggcatggactccccagcgacccccgtgagcttatctccgccacttcttagtctagtgctccgcaatgaaccatgctatacaaaaggtaaagccgttgcccatgctggcttgtggttggcacggttaatgtttcacaaccgaaactcgtgaaccggtccttaattgtcatgcgcacgaccatcaaaactatgtgttcacaacccaccattatcaagttttagttggcacattaattaattaaccaatcacgattgaccatcgtgagcttccattaaatatccataagtgatagtgaagcatgatttatcccattagtgagctattgtttctaagcatggctaagcatctattataagtatctagctgaaccaaactaatatataaggttctagctaatcaaattataacccataaaaaaataaagtcatcttcggccataattaaatgggaaaggctcaccacccggtgacattcgaacataaatgcacagttgaaataaatagagaatttaaatataggattaacatgctcaaaggaattgtgtttgggatctgtgtgacttgccttgcaatattcggtcttcaataagtcttctggaacacttccgacgcactttcgaaccttcgaaacgacggaaacgacaagctaacacgccanannaaaanaaacgaggagaaagactaataaaaaccaaataaacagtacataaaagtaaacaaacatgtagatcatgattttacataaatttagagacttgaacggtctcattccgatttcatatgaattaattacaaattttacaagatttaattccaattaaacctattaaagaaaagactattccaaattaattaaaccatttacaaatgatttataactgagacaaaagattaaagcaacctccagaaaagattagatcatatttggtagatgacatatattaaaaaggaataatatgccattgaaaagaggagaggatttatatcgattttggacgactgagattaatcttgaccgagagttgaccaagatcagatggcttggattgatctggcaagcgagcctcacgagataccgactcaacgagtcaattctacatgacacgggatcgcctaaatgattagccgaaaccggcgaacggagccggcagctctgacggctctaaactaaaggacgactccacacggatgaatgaacgaaacacggggaacacctcgttcgaacgaacgagcgaacaactcaacaacggctgtggctaaaccggtggactagaaacgattcacggtaaagccccggtacggcaaacgataggccggtaggaacctagggatgtacctacggctagacaactcgactaccgagcaacgagctaaagcggtggctaggtttaaacggcacacagctgcgacacgacac

SEQ ID NO: 75219 - DNA, 591 bp, Oryza sativa
tgagttttagtataagattatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacagatggctgatcacgatgaggaacagatattgtacgatacaatcgcggagggaagcagccagtactggaacgaagaagaggggaacgaggacccaaaccagtatttgaatgaggaagggaacgtggagagggatgcggaggggaaccaggaggggcacgtggaaagggatgtggaggggaaccaggaggaggaggctagtggaagtcaaccctccgttggacagaagagggcacgtgggcaacgaggtgccacgaagaagcttgagggtcggcacatcataacggaagtggaagaagatggacgacctagtgccccggcagaagccaccaagaactatgtacgtcacagcggttgggttgtgcgggataacgtgcctgtcattacggtgtattggcgaaga

SEQ ID NO: 75220 - DNA, 3185 bp, Oryza sativa
ttccacctcagctgctccttcttcctctgctgcacctcagcgttctgagtcttcttctcccataaagaaggctcttagggctatcttttgcatgtgtgccaagacagctaagaaggtaaagaagatagagaggcgtcaaaaggatagattggacttgcagcaggcaagggatgtcttctgacatttctgatgatgaggagtttgttgatccttttgctgcttatgagactgctcgagacattgctagtggtgagggtccctctggcacttctcgtttcttcaatgaggagtcctctcactccgaggagagcagtgatgatgaggagtcaaatgcccctaccgagaatgttcttacagatcccgatgaggcagtggacgccgccgggcaagacatcgactctcctcactccggcgacaccgagatcattccttctgatggcgatgatgatgaggcttgatcctcttcttcccttgtgattttgtctctttttggtgccttgatgccaaagggggagaaaattgcaaacgaaggggggtcaaaattttgtttttgatgcttactgcctgctatctgtataatccggaagttccggatcctcttatctggaagttccggacctgacagctccctctccttattgtcatgtcagcttatccggaagttcctggtattttatccggaagttccggacctggcaatcctttgacccctattcttaagaactcatggacatgttctaattctctatttgtgtgaatgtaatgtctattagatgctcttagccgccctttatttatactgctcttcatttatgctatgagtgtcttatttgttgtttgtgttatgatgttgattttatcctcttgagtgctcaccatgtcgtatcttttgcatataatatctattcttactgctttttgcatcccatgaatgagtagggatgaaggaaactctcctcggttgctcccttatatatatgcatatgagcttctctcatatcttccatatgcatacattaagggggagtttcatttacctttaaccattcaaaacaaaatttaattcaatcttttgtaagctttaaccatgttgtcatcaatcaccaaaacgggggagattgaaagtgcattaatccccctagtgggttttggtgattaatgacaaatgtggttaagggactaatgagttcattgagtgactttcaggtgcattagtccaaggtgtggaagatggatgcttggagacccccaaaaaagtacaaaatcaaagcggaccggaactcgagaagggcataggatagtttatcttttgaaatcgagtttttaggaaaaactgtactattaagaggggttccaggtgatgctctgagatatatcaagtgctcttagtgtgaaccaagtgtcaagtttccctaggagtcatttttgcaaatactccatctgtccaaaaatgcaagtccggaacttcctgtcttccaggtccggaagttccggtcttgtgaaaaagattttcctaagtgtagtccggaagttccggtctttcaggtccggaacttcctgtctagtttccagttcaaatttgtgagtaacggctagatgacgttacctagccgtcatacatatacagctcgattccagctcgttccttggccattccactttcatttttcaaacctagagctattgctagcctctcccaagtgtttcttgtcttctccactcaatctagagcctaattcttgtgagaaagagagattgagagggagagaagaagatttggagatgtgtgaagactaggatcttgggtgagcacttggaatatctcgtgggctgtcatctcggtgcttattactcttggagatgatctcctagatggttaggtgtcgcccgcgagaatccgttgcatattgtggatgtcccgggtaagtttgtgaaggatttcctctcctccgaaagggaacgaggtaagttggtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggatttcctcaggggtttttgcacaagtgaggcaaggggttaattgagacccagctctttggagctcctcaacggagagtaggatcgcaagattcgaacttcgggaaaaaatcgctcttgtctctttctgtgatgtttctgtgaatgattctatgatatatcctctgcttagaatacctgtgcaccatcttgtgaagattggcttagtctcctgtttcaaaatttgaatttcatctctgttttgttacccggaagttcctgtcttagcacaccggaagttccgggcctagcaggccggaagttccggagttccttactaggaagttccaggtctgtttgaaattttaccgctgcgatttgtttttaagatttcaggggacagcctattcaccccccctatagacttcatcagcgagttcaattggtatcagagcaaggtgctcttgattcaagcttcactgctttgagtgatccacgatgtcggatttagggggaaagaacggggaaaatggaaatgaagatggaacgagcagcaaggaaactccatcacccaagggagctactataccttttgattacagcaaacttaccattccccctcacaactttgtctccgtgccttctaggcgtgctcctcaatttgatgggacacattacgccgcttggaagcacaagatgaagttgcatctaatctttttgcatccaagtatttggaaagttgtttgtataggtattgatgtaccccatgatgacatggagctcacttcggagcaagagcaactcatccaccgcaatgcttaagcttccaatccaattctctccgccttgagtccggaggagttcaacaaggttgatgggcttgaggaggccaaggagatatgggatactttgcaattggctcatgagggatcacccgccgttcgtgaggccaagattgaattattggaagaaaggcttggaagatttgtgatggatgacaaggagacaccacaagagatgtatgataggatgatgatccttgtcacaagattaaaggacttgggagtgaggacatgacaaatcactttg

SEQ ID NO: 75221 - DNA, 743 bp, Oryza sativa
atgcctgctccctgacgccaccatccaagagctacactttccccatctgtagcatctcgggcttgagcatgtcaccgtctctgagggctcacttcacagcatgattgccagctgccctgtcctggaatgcttgctgcttaactgcaaccttggtttccattatcttcggatcaattcccctagccttcgaagcatcggtgcacgcatcatatcctatcgtaatagcattggacaccttcaattacaagaactcatcatcgaggacgcccctcttcttgagaaattgccccatcttgaatcgcgcaatgacctgcatgtatttgataatttccgcgcctaaactgaaggctgtaggctgcctttgtgatccatggtttgtccactccaggttcacgtttggcaccacagttattaaggtaaccatgctctttttttcccctttagaaggcttctaagttggtgtggatgaaatttatgtctgctcttatagatggcctatgcttgttgaagggagttaagtacgaaagtttggcggaggttgtgtgcaatgtgaagattttaggtatccatgtggatatgcttaatgtggataatgttattgacttgatgctgctttccttgcttggataggttatacttcaaggtaactattctttaccaattgtttattgtttcaggctgcccttgtgattaatttattactgctccaccaaaatggttgatttttattctttgtccttttt

SEQ ID NO: 75222 - DNA, 10405 bp, Oryza sativa
cccgcgccggtcgcccgatataatcattctcgctattttaaacatactccctccgtttcgaaatgtttgacaccgttgacattttaggacatgtttgaccgttcgtcttattcaaaaacttttgcaaaatatgtaaaattatatgtctccataaaaatatatttaacaatgaatcaaatgataaaaaaagaattaataattacttaaattttatgtgctaaaaagtcaatcgcgtcgtatatttcgaaacggagggagtaggatttttcccatcgtcacgacacaacccgatttcattcgttgtccatcgtgggtccgtctgcttttctgatttttccatttgtcgtttgattactccgcgtcaagcccgcatcttccgtatgttccacgtagcacgcgtacatcatgcaaggcccgcaaaccgcatgccatcaaacactcaaatcaaatatgaaacggagagagctacggattggtcgcccgatcggggctgggaaaatcgggcgctcacgtgagcatgatgtcagcgttcgatttacgtgcaaaactattttaaactgatttttctcttaaattacttatctaaattatgatccgattgcatcattaaattcgttgcaattaaatctttagaacaagaccacacattgatatattccgacaaaaaaaatttagcttattattgaattatttttaaatattatatgatgttccaacaggtatatcggaattgtttcactaagtagagcgaaaatgtttcactcgtttaaatcgggtgttgtttcaccttatataaaaacaatgtttcagcaaatagcaaaataatgtttcagttcactgcaacattagatctatacatagcgaaacattctaagtacactaggtgaaacatttttcggtggaacaaaaaataaactaaattctcttaataggggtttccaaaatatatggtttttttgttgttgcaatggagtatttcaattaaataagcgaccaagatttttcccacaaaatcaaaaggacaaaccccaaaatttttccgaaacaaatccaagtgcaaagagcatatgcagatgaaaaggtttcaaagggctcttagggtttccagttggcttgtactacggtcaaggtcggctctgataccaacttgtcacgcccagaaattcacgaaccagaatttctaagctgaatgtgcattaaacccctgtccaggaccagccagggtacacaaacgacaattgttgatatacagatccacgtcttacaaaaatataaaacattacaaatgcagcggaaaagataaaagtgagctaaacctgaagacttgactcctgcagcgaggcgactccattccacaggcatccttgacggcagcgacgaagccaacttcttcgagacatcttcaactgaaaaggacttcaactctagtgtgggggaaaagagagcaagactgagtactatccactgtactcagcaagtcataccggaagagaaggtatgatgcagggtataaccaaaggaggctagaggttcatttgcataaagctagcatttaaaagcagcagttgaaagcaataaaacagttgtagtaattaatcaatattaaccaatcactgtccaacgctacaccacgttgcaacaggcccaaccaaccacctgaactacaccaattcattagctaactagggtgagactaatcacggtgaatctggtcgaccgcccataaccgcgggcacggctattcgaatagttttactctgatcagaggtgtacaactgtatccacaacacacagccccacgacacgtttccgtgcgccgatatgccaccacgacataccggaaagaggccgtgataggacccttcacataaccccctctaaccgatcgcaccacaccttaggattcgccctcgtccccaacaggcaacgggcagcccccctttcgtgccgcgatgaatccggaagccgatcaaccggacaccccggccgacccaactccatcatgcccaccctcgcctgggtacgtcggctagaggaaagctacactacaagcctagccgttgcccacgctggcttgtggtaagtacaataagttcttctagggcatcccgcgaaccggtccttaatcgccatgggtacgactagaaaaaccatgcacccacagcccaccatgtagtgtattttaattaactaacaccattgcggtggcactaatccaaagctatgccaataatcaaagtccatgcattaatgtgatttcccttttgtgtactagtagaactaagcatggctaagcatctcctaaaccaacatctagtcattttagtacccaagttatcaatgtcataaggtaatcaatatatggctgagtagtaggacctatcccacatgatattgtaaaacaatgcaatatttaatagaaatgccggacatttgtaaattgggtacaatatgatcaattgtaatatatgacttgccttactctcgcactgatgagaccacagcaacgtctttgagaaaccgcggatcgacgaaacggccgaaatctacgcgtcaaacaaagcacgcaagcaaaacacactataagtctactaaaacaggaaacaaaactacttttaatggattctatacatttttcttgatttaccgagacttgaatggacttaaacggagctcggatgaattacttatgaattttagaagataaactgtgtttattactataaaagaaaattcttaatgagttttattgcacaataaaggatcccggatgaagtcagcagggggggtcggcgccgacatgcgggacccacccggcagtggctcaagggggaggaggtggcaccggctggtgggtgggccccaccgggcagtggctcaaggggggggagacacctggttggctcggctcggcttcaaaccggccggccggttaggcgatgcagcggcggcgagcggccaccgacggcggcgactagcggcgcgggagacggcggtggctggcgaggaggcggcggcacacggccgaagcggcggcgcggacaggaggcggtgacgcgcccaaaggcggcgacgcacacggggaagagggagtaaaagagggggagggagtcctcatcggggattcggccggcgtgggtgaagacgacggcggacggcggcggcaagcggcggacggcggggcacgcggaatggacgagacgggcctcgatctcgcgaggccaacagcggcaatggagcagcgcgtcataaactatcagtgtgtccgactaccccacatctagtacatgctttgaacttcaactctctttccctgaaactatcaagggtcgcatcattgtcgtcatcatcatcatcgtcatcgtcatcagcagagaaccgttctcctgattcatcatcttcgggtctgggcggaccgtactttataaggtgccgggttagctgacgcgctccacggaaggtattttttcgtctctgacgcttgggtatccttgcggcatcttcaggagtaaattctgaactagtgatgatcatggtccaaccattatccatcttccatattactgtcctgttcgctccagagttgggctgcaaagtaccatccttcttgtcggtaggctgacttggagcttggttacttcctgggcactgcttctcgtccttttcaagtgacctggcgaacaccttccatgggcagttccttacataatgaccttactcgccacagtcataacaggtagcacttacttctctttggtttgacggtggcttggctgaagttatcttcggggatctggacagcattttgacaggggtcttcggtgccgatactgggaactcctgactctgactctgattcaggttctgggctagcacctggacttgcatttgtggctggtggccttgccgcggctcctaacattgtcgttgcatctgctgcatctggtatatctcgtaccgacgtcgtatctgttgtaacaactcttccactgtttgagtctgattagccatgacttggggttgaagctgatcttcgtgaagttgacgtggaatgcccataggattgcactgagttgatccatgaaattgttgagatcttgacctgatgagattgtccctcatgctgaccaattgttgcgggcacaagagagagagggggagatgagaggggttactaaagataaggtactggacctcttgcctattgatatgttgttaatggacttttattgttcaagttgcttaagcaaacaacctagtatggtcgcatccccaccaatgatgcaaaccatacccctacacacaagcaaacaatcacacgatctagcagctaacgaaactactcttccgggaaggattgggttttaggtaaattctaggaaaacttcacttggccttcgtggaacgacgactctggactgatcttcttgctccttgctgcacgaagcctgagatgacctgacatgacttgacttccgaacagacatgaagctgacggtttgtccaccgggttttgcaactaaaagagttggagagaaagggaggagaatttcgaaaaaaccgtttcacaaagaaatgccgaagggcgagaggagacgttttgcaaatagggttatcagaaagcttgtccttagggtttgaccatttggctcaacctacagtcgagttggctctgataccactttgtcatgcccagaaatttagcccaaatttccagactattttgtgtattaaatcactgtccaggaccagccagggtatacaaaacgacaagtaaatatacagatccaaacataaataaagcgtaaaatacttacagaagaggcacttagtcctcacaccaaaagagaacgacagcagcggaaaaaggcgatcctagcggggcttcagctccactccacaggcaaaactcaactggggtctaagccttggtcttctgactccgtcttcagctcagaagcactacacttctgaaaagggggaataatagcaaggctgagtacaaccaccgtactcagcaagccacaccaatgatgcagacgtgcaaagggattcaagaatggcttgtggctatttgcataaaggcggttgtaaaacattttattgagcaaacagtaaaacaattgagtaatcaaggtaatattaaatctccactgatcaacgctacaccacgttgaacaggcccaaccaacccacctgaactacagtgcattgagtcgatttattaagtgtgagactaatcatggtgaatctggtcgatcgcccataaccgcgggcacggctattcgaatagttttactttggccagaggtgcacaactgtacccacaagacacaatccactggaatgtcaccatgcctgcgcagacacgtcaccatgtcgagtgattgtgacaagaccctccatataaccccctctgaccaagcacaccacacctcaggtttcacccccgcccccagcaggcagcgggcagtcccctctcgtcctaggcgaatcagaaagccgcataggccgtcgcagggcccatccgaactccatcacgctcacccttgcctggatgcgtcagccagcggaaagctatacttcaagtcaggcagttacccattcccgcttgtggcaagcgctgtatgtcttccagggtttcccacgaaccggtccttaattgccatgggtgcgaccagcaaaaccatgcacccacagcccaccattcagtcgtgttttagttggataattacgactatgaaacatggccggatgtctcgagcacgcagctcgtcatgataccaaaaggtctaatactgcaattatcccatcgactgagctagtggtaattaagcatggctaagcataaagttctagctaggtcatcatagtaacccaagctagtcgatttatcacccaaatttgacaaaggaccgtcacgtcccaaaacgactctaaaatacatcctctaaattatgccgagaataattaaaatccgtgtgaaagcctccaacaattaaaatgtgcaaagttaaaagtcaaataaggcttgggggatttttgtatatttcctaaaagcctaaaatacgtaaataaattttagtggaattttcagagcacaaataataattattaagaaataaacaaagttaaaatgattttataaaaagaaaaactctaaaaagtcccctctccctccctctccctcttgggctggctcgtcccatctccctccccctctctcctctttcccgcggcccatccggcctctccccgagcgcgcgccgctgacgggcgggcccgcccgccaccctcgctgacgggtggggcccacccgtcatccccttcctcccgccgctctcgccgcctcccccgcaccctagcgccgccgccgccgcggattccgccgcatcccgccgtccccgcgtgcaatcaataggggggaattattccccgcgatcccctctccctttccccccatttttccctctctctctcgcgttcaaacgggcggatttgcccccgcaaatctcgccggcgccattgatggagcccgagatcaccgcgccggtttccttcccctccggccactctctcccctttccaaccctatataaaccctccccgtgcctccctcacccgtttccgcccttgccgcaccgtctcctcgccggaatcgagctcgcgccgtcgctctctctctctgccatcgccgtcgagctccggtccgccgccgccgtcgccccggaccacctcccacctcggcgccgcctccttcggcttcgccgcatcctcgccgacctcgtccacccctctgtttcggtcgccgaccgccggaacgccgttgaccccgtcgacccgagccgcgccgccgccttcctccgctccggccgcctttttcgtcgtcgccgtcgacctagggtgagccgaggaccgccgcctcttttcccccttcccttcccctctctcggccgccgctccaccgtgcctatggccgccgccggcgaccataggggcgcgggcgccgcctcccgccggccgcgccgagtggccgccgcgtggggcccggctgtcagccgcccgcgtcctcgggtgtggctgacgcgtgggacccatggcaccgggcggtgcgagcccgggtgcgcccggtccaccgtggaccgtgaggctgccgcgtgggccccactcccgtggactcggtccgcgcgcccctccccctcggctgacgcaataaaccctttttaaattaaaatttaaatgaagaaattcgcaagtattcatttaaagagcatataaacttcaaatggccataacttggccatttgaactcggaattggaccattcaagtctctaatttttccttaagaagtcaagaacccatttttgtgctctgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattaatgcattatcgctttatttaaattcccgcgttatcattgttttatttagccatgcctatttatctttgttatgaccttattattattgttattgatattattaccttgttcaccctagattaaacaaaaccccaactagtggacactctactcatggttccactagtatgaatttaggtagatgcttcgctggttaattaggcaacattaggtggttttacaactttagactttgggaattctcatatcatttggacactatggaatggttggcttatgttggaattggacacacacctccccctctattcaaaacccccaaaatggttttaggctgggctcgaagtgcgtggttgggttttgttagtcgtacctcgggtactataaggattaagctcgggcctctgttgcaaagcactaccgtacttctacatgtctagtgggtaaggcttagtttgtggctcagtctggttataaacaaaagtacacggatagagatggatgaagtcgggggtcgatggacatctctaggacaaatgaaggctacacgagctgcggcccggttgtcgagatgtcatggcacagggccggtgtcctgttgctaggggctcagtcctgcctacctgtcctgggggttccagccgtaggtggggttgggtcggtattcttgtctatggctaggatgggttggaaactatgtcacgtctttcgtccgtataccgtggtggtatgtggcacgtggttacacgtgaggaagatgtgtcttgtgggtaaagatgtacacctccgatcagagtataatctattcgaatagccgcactctcggttatgggcaagtcgagcaatgtacccaagttagagttttaattcttaaaacctgcctaacaactaaaatgtggaatggttggcctgggttggcttgggacgagctgggacccagggtcgggttgccagttcggtctgaatcatcgtaggccttgggttaaggcaggttcgtgtgggttcacggccttgtttaataatattgtatagctctaggatcgtatttacaaaatagctttgagcaactaagtgtcttttaatgctgtttactgcaaaccctaaccctttatattataactcccttttactcccttgcatttattctgcacttgtgggtatgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgagtgtgctgggccttcgccgcccatgtaataaattatctatttacgcttccacttgttaaactctgaactgtatcaacttttggtgtaccttgcctcctgggacaaggaataatgcacgcacgtaaggaacgcccgttgtgttattttcggtcgtgacaaggacagatatcaaataatatggcacaagcaagcatatacgtgaaccctattcccatgtaattagcaaaacgatgcatatttatttgcaaacggaaaacatttgtaaggtagggtcaaaatgctcaaggggaatgtgtgacttgccttgcttcttcaaacaatcttccgaactcttttcctcgcgaccgcagacttccgaaacgagggattctacatgctggtacgcaaaacgaggaaaaactcaaataaacaccaagaaaacagtacataaaaagtaaactaacatgtagagctcaattttagatgaattttgcaacttgaatggctcaatttggagtttggatgaattagatatgaattttagaagctttgagccatttaaatgaatttctagaattaatatcgaattattgcgcaattattatttatttttacaaagaaaaggggattgctgacatcagcaaggggtgaggcgcggaccgcgtccacaaaggggtgggccccacacgtcagcgacacaaggaggtaccggcccatcgtggaccgagtccatggcggcgaccggccacgcgggcacacaaggccggcggcggcggcgaccgggaacaaagcggcggcggcacacgggccgggcggccaccggcggcggcggcgcgacgcgcgcaagcacgggaggcggccggcgaaggggagaaggaggagggaggcggctcaccgagagccgcggcgacagagggagcggccggcgaagggaggcggcgacgctcctcgggtcgacaacacggaggggctcccggcaatggaaggtgtcgaccgagcggcggccgagaaagagcgtgacgcggcgagggaggcgatgcagccggcgcgtcgcggcggcagccggggcgatggcgaacggcgaccggaggaggaaaaaggtggccggtagggtggtgtggtggggaggtggttctggtggtggagggaaaaaagggatgggcggccgggcttgccctcgcggtggtggagctaacagaggcggcggtgtggtgtgaggtggccgggaatggcggcaattagcgatcggaggcggccaatggtggtgggagtgacggtggcggctagctggagggcgccgacgggcggcggagatcgggcgcgcggtgcggcggtgttttagaggcggagaggggaaaagaagtaggggccggggtgtggcgtggagcggcgacgacggtggtggcgacggcgcagcgcggcgacggcgagagcggcggctagaggcggccggagctcgccagcgacggcggggagagggagcgacgatggcagggtggtttttgggcatgggaaggctcgggagggagggaaaaatg

SEQ ID NO: 75223 - DNA, 5418 bp, Oryza sativa
ggtcctgggtgtcggcggtgacgatgccgaacacgaaagaggacgagaaggaccggaccgccttctcgttcccggtgccgttcgtctttgtcgacggcgtgcggcggagcctcaccggcggcgggtagaacgcgtggcccgtctgctggaccgtgccgttggtgagcttgaggaggccgttcggcgtgatcctggccgcgccgtagagggtcaggttgacgccggcgaagccgttgtacaggaactggccgtcgtcggcgagtccggcgacggccgcaaggcggaggaggagagcgaggcaccacgacacgtactttgttccggtcatgtctgcggcgcggcgcggcgacacgtacgtacttttgttactgtttgatcaatgcaaatgatctactatactgtttatactgtttcagctcaattgtggttcatatcaacgcgtacgttgaattccgaagtcttttgaatttgcctagtcaatctccctactcatatttggtttgaaaaaaaaagaagagaaaaattgagccttgcattcatagcgtgatgaggacgtgtgacttaacgagtgacagaattaacatgatggagatgttcgaaacggtctagtagcttgtatttaactgttcatcttggaccaggctctctcggttattatagtttgattgatatatggctttaatttgggttgttcatggtagcagtagccgacaaagctgatagggaaattcgtggagaaaatggaggcaaattgctttcaatgattcagtgccagtaaagcgaaggtcagctggctctgtgttttgccatggatgtaagcaaaaggtatatacggcgtacgtatatttctgtggacacaatggttacgatgaaatagaacctactgttgcgtcaaaaaatagaacctactgatgccaatctagaaattttgaaagaaatacgggttggtgcatgacctgatcggtatggcatttgagatttatggggatgtgactaattaggatgcatgaacccagacttggagggggcgttatagttttaaaagaaattgttttggacgaaatttttgccaaatttctcgtcataaggaatctggtaacggaaaagttcaactttttttctcttgtcttcaaactctgctcacaatctaatttttcatcctaatatgaaaaaactagttagttatagattgagcacagttctaattgaaatctcaaactgacttcaatatctggtaggagtaattcttacgcacttacacagaagatgaacatatgcttacatgagctgatgagcacacacccatgagtgcaccctcttaacacatcactaagttcctattaaaagtacataattgtgttcttatgacctgggtgaagtcatgtatccatgactccactgcaccactagtgctttcgctagattataaaaaattaaccttaaacatgtctaataaattatcatcctcttttaatttatttgcttaattttgaaattattgtatatggttgaccttcttttctgaactaataattgcttctctaaattgtcaataagttaagaagttaatcatggctctaaaacaatattaagtcaataaattttaatcatggctctaaaacaatattaagtcaataaatttaggctattcatttaatactaacgttgggttgaaatttgaaaatgacaggacactcagactccttacacaccacaaagtttcaatcattattaattattaagttgaacagatgtggtgtagtgataattattgagttgatttaccagcaatgcgactgttttgtaaacgtccattaaattttggatatacctcgttcggcagatatcattggaacaacaaaataattaattacaaatccaaaattcaaatccttcaatcaaattgactaattatatatgtttaattatttctttacttgtcgagcattgcgactattttgtttctagaacacgcaggagatctacgttgcgagtattctacctatcctatgaattggagcgcttgagacaggcaccttaacagcctgccgatggcgtcacaaggcaaaatcaagttatcatctaaagtgccgctcaccaaaaactaagagactcgaatatttttaattccctcgtccgacgattaaattatgagtgaataaaatgaaaccctctctatcagatgttgtaatgttgaatctcaattagcaatagttttagcaagtgattaaatttagctcgatggaatagaaaagcacagacattaattaggtgccactaatagaattttcctaaccaagtaaccaatcaacatagatgcaggcagcatcatgcagcagcaagctagcagcaacacactaggaaggcatcatgcatcagcaacactaaaaaaacaccagcagaaactcagttggatcttgcatagatgctgttgggacatcaagccatgcaactagaaaaaggaaaatccctagaacaatacatccatggggaggtgggggtcccggccggtggctagctgggcagccagcccaccgtgccgtatggggccctccgcctctgaacaaaccaaacatattattgccagtaggaataagtctacttggtctccctcaactcatgcacctagttgaatcgcatccctcaactataaaaccgggtataacccatcctacaactcacaaaaccgttccaaatctactccttggacggtttgggaggcggttttgtcctacgtgccgtctttgactccgttgactagccgagttagcacgcgagccccacatgtcagtgtaaggtatggtcggtgaaaactcatcgagggaagaggaggcaaccactgccatgcggtctacgccgcccacgcccaacgccctcacctcacctcctcttccacccaccggccgccaccatcaacctggctgacggagatgccctcgactaggaccccaaggccaccaacgccgccatcaacccagctgccgaccccaacaccatcaacaccgccatcaacctggccgccgcaaggtcggaggaggagagcgcggggatgaggtggggaggaaggagaggaggcggctgaggaggggcacgggaggggaggcggcggtggtgaggtcggaggagatgccgccactccgccgttcctgttgtcttgaactgtgctgacaccaacaccatcaacaccgccatcaacacgatgagaagggaggagaggaggcggggatgaggagttggtggcgaggagaggtggttcgccgagttcccgtcgccccaccgctccagccgtcctgctactccctccgctcccgtcgtcctgctactccctccgccccaccgctctctccatcttgctcgccgctgagtacaaagactgaggagttgagtaactaccacgtggacccaaaatttctttttatttttatttaggtttgtttttattttagtgccaagtaagcgccacgtcgatgtcgcatgggataaagaccaagtcaacttgccacgtaagtgccacgtaggacgaaaccgcctccaaaaccaccaggggagtcaatttgcaatggttttggaagttaggggacaggttatacctggttttgcggtcgaggggtgcgattcaaccatacgcatgaggtggagggaggcaaagtagacttattccttgccaatactaccttaccaaattatagtaattctataagttttcactttgaaaaattctataaatgctggtaaggttttaaactaaacacatccagcgtcgaaaaaattttgtaataacaaaatgtaccaaaatcgttaaattttagtagagttgaaagtggctataaaatgaacaagcccttaattcaattcagttttgtccgatttgatcaatccaattgagatattagcctaagtcataaattcatgacttttttattgggtttctcatgttgactagtaatgctaatgtttatctataggtttgctatcacaacttataaaatgcacagagaatcaaaatcgagttaaattatataatgaaaacagcagcaaagtatcaaatctactgttcattataatattcgaaggtttacagtttttttaaatgttatatcatagtggtcaacacatccctattgtgtggtttagcccagggacaccacaaaaacatggccttggggaaagacactccataaccgtggatatttgccgatgaacaccatgccatctaaatgaaacttgtcgtgctgacgtggcggtcggtagcccggttttttacgcggtcggaccgaaatgcccctacgccttatcctcatattgcagtttaggatcgaatcgccaccaccaccggcggtagaaccctagctcccgaaacaccaccagtccgccgcctcgctgctggctgtgcccaggcattttcgccgccggaatgcaaggttgacctacggtgatggcttcactatcgcaggaggtggtggaatctgtggtggcggcaacgccggcgacgccaaaatggatgcccaaaggataagtatttttcctctctttgattcgttttccccctctttgattcgtttgggatgcatggtttgttggatctgatttgggggcctgtttttctcctcatttgccgtcgcattgtaggatggatccgaactatgcatgcagagttgtggttagggttgttgcttatgttgagtatatggataacggtagccaagattatcatgtttctagtacacataagtgggtagtagataaagacagtatgcttgatagatttgatgaaggacttggatgatgaaatcatccgtggtagtgcgcaggagcttacaatgactttctaggacaagagagcgggtagggatgtagaaatttcttctgatgttgtgttgttagaggcatttaaccaatactgggatgttaagaagcttccattgcaagtgacagtgagtgaggatatcatgccttgtacccaaattgtgttttgtgtggatgatgaagctgacacaatggttccactgagtatggttttacccacgcaagcaagtcaggctgataatgtacctaccagagatgctaccataaaaaaggtgcccaccaaaaaaagtagcatgtccagggacaaagctacagatcaatcaatgccaaatccagatccatggggtgagtttgatgaggttgagtatgtgggagttagtgatgagatggagaattacaatgagctggtgtcagatgatgaggctaatgatccagattatactcctgatgatgatgatggtgatgaagagaatgctgatccagtagatgatttagaaatcaatgataataggggttgtgagcctctaattcatataactgatgtagacaatccaaggatagaaattggtgttacttttgaggatggactttgttttaagaggtgtataagat

SEQ ID NO: 75224 - DNA, 6208 bp, Oryza sativa
ggagaaaaccacacaatagggatatcctataacaaaattttccatagtttaattatattccctttgtccataaatattttatgggattttagctatatgcatacatttgtcgatggagggagtacaaacttgtgtcaaaaaaacagctcctctcttgtctagtactttgtccacaaaatttgtagttatctggaatctacctttagagacgctcctgtttgaaaaaaaaaacactttttcgacagtgtaattttatggtaagacatgcttgcaggttgcagagtcgccgccatctgctgcagctagacaacaacattgtaggagatcgtggccgcgattacacaggtggcataaaacaaaatgctcgaccttaactccataaaacagtaagaccagctgaataatttacatgatgaaacaagtaatgggaatcaatgcaacgccaacattgcatccagtcaatgatacaacagattgtataaacaaagtgctcggccctcagaatccatgctacatcgcctacttacatcgcagctagtcacactacccaaaaacaaaatgagactagaaccaactgaaccaaagctaggattaaacagtagtcgtgggatccacgagagctttccatgtacaaatctggcaaaggaactgtagctctatatagaggcacctgctttgatgaacgtactgaataatatggaaggtccagctaggttgccgaaatagaaaccttgccatcacaggtgaggtcgtgtcgtgttcgtgtgttcttctaaactagggtcgagttgggtggtgtgattccttgtgataagtagtatgccttctcggcatcggccagcctcgtttgaaatatctcccattctttcctacagcgtgctcttacctgagacaaaacgtaccatcgtaagaggaatttatgtgctgtacagagttcatgcgttgggaatatctacaacatttaaaactgcagattacataaggatatgtatttgcttaccccttcccatggtgcttttccattctctgcgttgccctgcaaggtaaagtagtgcaagatcaggttacacagtttcactgagcaaaatgaaggacagtacactaaatagttggctaggggctaacctggtttccaagtgatggcacagcttgatgaacaatccattgagcatcgacgactccaatcttctcatgagcaggctgattaatttcatgtaaaacagaagtgtttaagctcagtgatccatggatgatttggaatagcattcgaagtggaaaatgatatgaaggcggagcacaaaaataattgctgatgatagacttcaaaatttaggtgaattaatgttgttaatcagactaagaacagaagctctgaacttctctcattgctattcggggttcaggagaagtggtttcccactatccaaccacaaaaacaaaaatccaatatatgtagcttcttcccaagaatcccaacccccaccccatttcatggcccactccagccaccccagaatataatcaacccataaagtcagcatcatttttcctaggtcacttcataggaaaagaacaaacaaagagtacctccacacatttccttagagcgaaatcaagaccccatccatggaccaagtcattctgcagaagacagtgtgtaagaataccactgttataaacaatgttaaagttgaacatgtagtgccactccacctgaatcatatgccagacacagcgccatgcatccctagagaacacggttgccatgatttcaacaaatctgcacatcaaattgaatgtaatacagatatttgggcaaagaaatttaaatacacaataaaattctgggcccttagccccttacgctgcacatggtggcagatggggatcagtgcaccagcctggcctctcctcagtaactctgttgaagaaaaaagttactcaagaatcttatataggtggccaacgattaatcattgaataaaaccatatggattcagcggctcacttgtgaacttcttgatcacctcgccgttttgtcatttgccatgtcagtcccttgtcaggttgcaaaccaggctgagagatatctagcccatgcttcctaacaagttcaatatacctgaaaaagagtacaaacataatcgcacccaagtggaacacaaggtcaacagataaaggaacaaaaatgcagttcttacttctctgcattgaaatgctcaacacctaggtcctcatcccagatgaatatgtagtcatatcgggcaacaacatcaggatgcaaaaaccgctttgcataccaccttaggtaaaacaacaagtacatacagtattaagacttcacagcaaaaattcaaatggattcagcacagataacatattaataataacaataacctttacctaccacttagtctgcttcctgacactcacatggatagctcttttagaccactcaaattcatcccattcagtagtccggccatcataatggaatagcatgatagtgaatttatctgaaaactatatgaaaagcttctatgaattcagaagcaataattgcatatttacattaagaaaaagtgactaccagttcaccggaatgcaagattaactgtttatctgttacagggtatagttgattgatgcaccaaatttaagcaatgcaagatgtccgtctcagttacctttttgacagcagcatcaatattagccttctgtgtaattccaactgtaaaagtaacaaggtaccgtggttcgctactcaggtcctgacagtacgaccatatgtttcagattgtatatcatagaagaaaaatgatatagaaaccatctaattcaatgccctactgagcaaagttacaacaaaagaaaccacaaacctcactaggatcaccccacaatctccgtggaaaaagatctgtttcagaaacaacaatgcctggtgggagcctttcagcacctttagggtttgtgggaacataaatctgcagaaagaattgcatgtgactttaaaacaaaataaacaataggaaatgtggtctatgaccagtaaccaactacttttcagttaattactagttgagaagagtcccttgtagtacactaatatcgacaattcaagattcaatcatcgattatcataattttataagatgcaacagaaaacttttaatatagacagaaaaccctgatatcgtccttcatgtaatctttcagcctagaacttcacacattatgcatgagaaacacaggagtggtattaacagaccccacatatcaaaatgtagtccccaacccaactagaatattgcccaactcaactaatacaaacaaccttaaaaagtattagaagtattgatgtgaacgtaccttaggaacttcttcagaggttgaatcggaattgtttttgttatgacgatttgcagatgcccacgcatgatttaacaatgtctgggttgtgatgccagagttcctatcttctatataggagataatactggaagggaagtgaagctgcgaaatgcagtaatgtagaaagtaaagattattttcctaaacaaaatacatgatgagaaaaaacaagagaagcaaacgatctacttcaccttggttatatttactgtagggaaggaaaccccaaacaagtatcccaacataacaccaacaactgccgagaatatgagcctcatcccctcatttgatcttggcgtgctgttgatgatgaatgttcacaattaaattacaatgtgcaaccatgagcaccgtagaaagaaaaagaacacttggttggtgttactagacaagtgggcaacagataaattatcaatcagcgctagaaacggaaaagaaacagttaagaataaacagtagctgcagtatcaaacctacctacggccaatgctattagcaggttttgccatatgaactgcgaatcttcccctctttcttttctactacagttgctgccgaagaaacctgtagagctgcagctgtcgattcacaaaccacagtcacaacgaagcaagataacaacaaatcagtgcttcccaaatagcataagttggttcaaaattcaaacacaatagaaacagctccctaaaatttgaactaatcgttactagtagacaacccgctacaacaagctcattcgagatgcggaccgatgaatctctccccccaagtcgacaatcgccgaccattctcgggaacgcgaaacgcgaccactaaatcactaatctaccgcaacccagcagccgcccccgcacgaaattggacgcggtcccgcgagctagatttgaaattgaccgcgtcgtcgcagcctctacctacgcgcacacagcaaatcgaaccgccccaccccccccccccccccaaacaaaagcttgagaaatcgtaccgacggaaagcgaatcagccgcacacccggacagatctcccccgcagcagcagcaggtcggcaccggcggcggcgcagtacggcggcggggacgaagccgaatcggggggagagacggcgcgcagatgagacgatgattgggagagaggagagattggaggacagcgatggaattgggggggagacggggatgggatttgtatcgcgatgagcagctaggatctggttgtcccacacatgcgccccaatcattcgccgccgcgagaacctctcctccctctctctcctctctctctctctggctaagtaagcgatctgctctcctctcgtctcgcagcttgaaagagtcgagaggagagagggaggtcggcggtcactggcaggtggggtccacctcgagtccaccctgcgctgtcctgtgctgttgtctctctcgcttggtttggtttggtttgcccctgaatgaaaattaaaaagaagaaaagaaaaggagagagagagagaggaatacttgggggaagatgtctgtttgactagcggtaatcttctggttggttagaaggttaggattaggaaagttcctggggctgaacgcagatttgtatgtactatcctgtcctaaaataagtgcagccataaatatacgtgctgagcgttttaatcatccatcttatttaaaaaaattataaaaaatatttaaaaaatagtcacacataaaatactattcatgttttatcatctaataacaataaaaatactaatcataattttttttcaaataagacgaacggtcaaacgttagacatgaacaatgctaaaactgcacttattttggaacggaggaagtactgcgtacatgctcctttgggtatgggtagagaagggacgtgtattatgaaaccgtgtgcagtcgacttgtgtttattgatcttttcaaagtagtactacatcctctagatagggatatttgtcactctaaaaagaataatagggtaatttgttttataaaaaatcacttggtaagctaaacagcacaaccaattttaacactgctcttcatacatctctcgaccgttcgattgaacgacccatgccacttctaacttgtccacacatattgtatttatttcttcacgcggatgcacacggagaaggatggcattagagcaatcacaatataaaaaactagtcatgattttcatatcctccccattacgccgccggctgctcgtcttcctcacagcctctcgtcttcagctctctctgtcaagatctgaggtaagtgcaaagatggtattcctcttccctttctcacctccttcgattttttttggtaggatattggttactctctgactaaggtggtagtgggacaccaaatttatatatgcacatatggctatgtgatggttaatgtgtagtggacaccatattattgttgcatgatctctgcctcatgttaaatttcatccttctgcacttgttttccatgctgcaatgacatgagttaaattgtccttctgcacttgttttattcttgttccttgttcatccatttgtaccgacaaatgcaaacttggtcaaactatttgcaactggtcatttctgatgaatagtgcaaatgtgaaggatgcacgtgatgaatggtgctgatttgtgatgcataaataagaacatattttgtacacttgttcatattttttagggtcacctgggaagaagctagatatgatgaacactgctcctctgttttattcataagaacagatgtaagcatggaagcttttatttatgactgcatatatgatg

SEQ ID NO: 75225 - DNA, 46292 bp, Oryza sativa
tcacagagccctgctggaagcttaaacacactcatcacgtaggtcggaatagcctgtaggactgatttaattaaaacttccttccctcccatagagaggtatttctcattccaatccgttaatcttttctcaaatctctccttcaaagattggtatcttcctgccttcagtctacccatcggagtaggcagaccaagatatttatcttcaaaggaagtgtgctgaacatgcaaaagtgatctgatgtcagactgcagagcatccccacaatgctttccaaacatcaaagaacatttggccgggctcaggagttggcttgtgctttgctcatacaaagtaagagcactcttaaccacattagtctgttccatatttgatttaaagaacaacaggctatcatctgcaaacaagagatgggaaattccaggggctctcctgcagactttcagaggttgtaaccgtcctgatctttcagcttcactcagcgccattgataaaccgtctgccacaaagaggaacaaatagggcgacaggggatcaccctgtcggaggcctctggtcagtttgaaggattcaagcatggatccgttgaagcgaacagcatagctaacagaggtaacacaggtcatcaatagctgaacccattgagaacaaaaaccaaccttaagaagagctccctccgggtatctccaatccaccctatcatacgcctttgtaaggtccaacttataagcacagaattgagactcaactgatttacaccgattgatggcatggaagcactcaaaagctatgatagcattgtcagtgatcatccggccgggaatgaaggcgctttgcgctagcgcgataacatcctaaagtaacggccgcatcctattcaccaaacacttagcaatcaccttgtaaatcacattacaaaggcttattggtctgtaatctttcaaatcctttggctctttctttttcagaattaacacaatggcagtgtcatttacaccttgtggcattcttctctgttcaaagaacagcttaacagccgcaataatgtcccgtttcaacacatcccaattcttctgaaagaactttgtggcatatgtgagaagggatggaagacaacatggaggggaacgacgatggtggtttcttgggcatggaggcaagcggctgtggtctcaagggtggaggaggacagcgatgggccgcctccccggaagctggagccgaggtggactctgtaccttccctggtggaggtggaagtcgatcggtgcgggccacccggacgtcgaggtggacggcggtggtggctcctctgccctagccgtgcagggaggagaggaaagccggcgatggtgcaccttcgcctgcaaatggttgtggagaacgtcaaagaacaaccgaacccaagaggatgaggtgaaccagattggacgccgtccggaacagcgtccacctttggacgctcttcaaaagaaagtgtgtccaagtctggacgctattgggaacagcgtccttcctatttttacaaatttaatctgagatttactatttatttaatttaaggatcattaattactgtaaataaaaaattcggcgaaatataagtcactggtgagaatcccctttggccataggaagtggttcgaatgggattctcccctctgaccataggggatggctcgaatagagactttcctcattggctacaggaaatagctcaaaaggaagatcctggtggacatcgtcttgggcagctccatttcaatttaataccaaggatgtttagactgaatatgggatgattttaccccatgctacaacaaaatgcatgtctgacattggtttcgtagaaatatttgatttaacaagtaaagttggggatttttctggtgtgttgcttccagcccgcatacacaatatttcatttaatctaaattcacaaaccgtagaccggatactattaagttatataaagcctaacaatctcagatactattaagttccttgccgttttgatgcataacaatccttcggtattttcttgcttcagaaaatcagttctcctgtttcttttgcattttcataacgattcttcctaatgactgtattatttgcagaagaaattttagcactaccaatgccatgaaggcaagaggctcaggaatcagaacaaggccatggtgagatgatcactgctgccaatcaaccatcaaaggctctgcccgtcatagagacaaagatatgaccacttgtgccatgccttgaaaatggatattttttttgttataacaagtttatgcttaataatcatttaatcattttaaccggagtagttttcaatttatacttggattattatttttttgcccgttgcatagtatctttactacttaaaaaataagagatgtttccttcgtccgtcaaaacaaaataaatagcgaaaaaataaaaagaaaagtccgactccctctcagaaaaaatagtctgactctagatccgattcccccttaaaacggaaaataaaacaaaccacggtttgagtcccccaggcaccactcctcttggtttcaatctataacatgataccccattcatcttcgtgaaaaaaattaatatgccggattgaagatctgtttgcaaaaacggaacctaccggtcgagagcattccatttttatatgattttattttttggggtttatacatttacatttgagtccctataatcttgcaataagatacttgaggttgtttttgttaagaaaaaataataaaagggagagaataaaagcagaaaggtgcataaaaagaaaaacaaaaaccgcaagaaaaaaaaagaaaaacaacaacaataaaagtttgtttcccctaggtggcgaaaaaaaaccgtagatccgattcctctaaaaggcaaaaaaagtggtgaaaaaaaagctagatctgattcctttaaaaacagaaaaaaaaactctgtttcctataaaggcggaaaaaaatctgaaaaaacatctaaaaactttgttcgattccctaagaaagtggcgaaaaaaatagttcgtaaaaaataaaaagttggtttgtacaaaataaaaaatgcgtgcgagaaaagaaaatgaaaagggcgaaacaaattacaatttctaatcagtatatatgtcttctctatctctaatctaatctaactatttaaaaagagaaaatacacgagaaaaaacggttcaaaaaaatgcgtgagaaaaaagcgaaaaaaaacatgctaaaaaggttttccatcttccaaaaaaaaacgtgggagaaaaattatttccattgtaggtaaatttttttttaaaaaaaacatgccaggaaaaaactgtaagaaaaaatgcaccatttctaaaaaatgatttaaaaaaccgcgcaaggaaaaacaccgtctattaaaaaaataaatcgctctgaaaaagctgtaagaaaaaacactaaattaatggacgcttgagtcggatagaatccatcgattttttgccatctactacacggcttttatttcgtcatatattctcttgtattggaaaaaagaaaaaaaagaacatttgaaaaaaaacaagcaaaaaatgcatgagaaaataattgtcagaaaaaacaggcaaaaaacacacgagaaaaaaaaaagcaaaaaagggagaaaaatatggtttttgtcgtcagttaaaaaaaaacatgctgggaaaaaatgttagaaacaaatgcgccatttctgaaaaatggtttgagaaaattgcacaagaaaaaaacaccgtttataagaaaacaagctgctgattaaaatacaaacattgtcattgacataattatgcatgaaaaacgtatattatcattagaatttattcacctgttgcagcgcacgggtatttttgctagtaaaacaaaaaaagaaatcagggcgtaggagatgatcaaatactcgatcggtagtgcatatgcatgcggaataagtccactatgactcccttaaaagtgacctgaatctaatccatgaccctaaaccgtaaaaccggatatctcaacccccgaactatcaaaaccggtgcaatttgactcccttgatggttttggagggtggttttggtgacgtggtggtgttgacctagtctgtggagttgacgtggcgcttaagtgtcatttgaattaaaaacaaatatgtgggacccgtttgtcattcacacataaaaaatatggggcccactgacatgtgggacatgttcttcttcctccccgcttcctcccctctctctctttctttctctttctttcccctttggccggccgggccgccgagggagcatgagctagagcggcggcgggtgggcgccagagcggggaaagctgaagtggtggtggcggtgggagtggcgacggatggcgctcgccctgcaggccgactgcttcaccagcgacctgagccagctcatcatcgctgacgtgatgtccgggtcagtgccgctcgacgcaagcacgagtatctccgggagggtggccatcttgggtgtgttcaagccagacaaaattaattgctcccgtatgcctactcatcctattcttcagtggatggtgaacgacctgctaataatctctggttagttgctaaatgaatcaattttatttctggattttgtgatgcttgtggccttagcagcaccggttgaaggagacgcaatgggggatgagttggtggtgatgatggggctggcgcgggaattgacggccacgcagcgagctcgagcaatgacttgacgacgtcgtcgttgcaatgttgaatggcatagctcgatggcggccctcaccctaactagcttgacacttgagaggctcgatgtcgcatacgccagatgcccggatcttgttgttgcaatcggcggagaggccagagcgccggatcttgttatcacagacggcgggaggcggcggagggagcagggagctcgttccccggtgagggcgccgtgccggtggaggtgaggactggggttagggcgtttaggtgccgtgccgttgaccgctgtccccccgctcgatctcgtcgacgtcggcgtcagcgttgccgtcctctcccgcctccttgccggccatcgagctgcctgttgccgctctggaacccgccgttagctctagcccgccgccaccaccgcttcagcttccgctggccgccaccactctagccctcgcccgtgagaaaattgggattatactatcgcaaaagtgtggttttgctgaaatgctatcgcttcaaactgattcactaaaatgctatcctaaactgagaggtgttcaccaaaatactatttttgctcttttgggtgaatagaaatgtttttcttaattttaactttttcccggaccaaaatacccttaatgcggggcccacctgtcatactctctaacgtcttttgttcttgttcccctctttctctctctcgaggatgacgtcgggagcggggtggccggcggccagcggcggcgtggcgagggcgtggtagagcggggcctgcagaggagcggctcggccagccgcctcagccggagttcatgccatggaccgccgccccccagccacagccgccgccgccgccggtgagccgcgtgtttgcgcggcgcctcccccgctgtgggtggccttcttcgcgccgccgccgcatcgtcgccgccgaggagcaggaggcgaaagtggacccggatgcgacggaggcggcagagccactggtcgacgggcggggcggcgctaaccgagggacggtggacgcgaatggtggcggcggcgcgactggattggaggaggagcaggagagggagcagcgggggccgccggtgccggacccggacccgatgcttaggcgcggagtgaggggcggcagtggcagcggacgcgaatggaggcggcggcgcgagtggactggggcaggagggaggggaggagtaggtaggagagtggcgggggccggcgctggcgccggagccggacccaatgtggaggcgcgacggtgtcgccggtgccgatgtcgctccgcactcctcagttagcgccgattccatctggtaaacctatctgagaccaggtattttggtcagaacaaaaatgaaaatagagcaaaatcatttctagcaaccaaaaagacccaaaatagcattttagtgaacaccccttagtttaggatagcattttaaagaatcactttgaagggatagtattccagcgaaaccatccttttgcgatagtaaaatcacaattttctccctgcccgctgccgctccagccgtgctccccgcggccggccgaaggggagaaaaagagaaagaaagagagaagggaataagaggggaggaagaagaaagagagagagaggggatgacatgtggggccacatgtcagtgggccccataattttttatgtgtgtgaatgacaaacgggtcccatgtatatgtttttaattcaaatgccacctaaacgccacgtcaaccccatagactagttcaacactgccacatcagcgccacgtcaccaaaaccgctctccaaaaccaccaagggagtcaaattgcaccggtttcaatagtttgggggtcgagatatccggttttgcggtttagggttatggattagattcgggtcacttttaagggagtcaaagtggacttattcctatgcgtgcgaattctactcgcgatatatttctcccgattaggcccagcccatcaggaaccaaaccagccagtcgggccacggcctctttttacgcgaccacgaagcgggcccggtccgtgagagcctacacttgtgctgggccgcgagccagcccagatgagcccaagtactccgccacatccaaatctgcaccgttaacgccgcatcccacggctgtaagctcccctccgggagataaaacaccctccccccgatccagccaccatcgccattctctagggtttattccacgcctcccgtcgccgccgccgccgccgtcgttgtcctcgcccgcgcgcgaggagaacgctaaactccggtcaagatggtgagatccgaacgccctttactctctcttcttcgcgtcgttcagttattttctttttgtttttttttccagttcgttcggtgccttgtatggtcagtccagttcttgatttaaaccaggatatgtgatcgtctagttggcgtagaattacgtgcattgtaccggtggaatcttgttgcctgtgttagatcacgcggtgagttgatttgttcggttggttagttcttactagatcggtctcttctttaggttcatgtctttttgatctacctgtaattctttgtagagcgagttctttgtcaaatatgttattttggatcagagatcattttgggtaagtgctctgtgggtgacaacctggtcaagttgttagtaaatggctcaacacccgttctattagacatccttttggtaattaggagttactttctgtaaaactgtgattcccaatcataaaacatcctttgatagttatgagccattccatctcaacattaaatgtttgatgaacgcatagaatcccaaggaatgatggcatagattgtaagtgcttatttggtgaatcttgtttttactgtattgcccccttttcatttctctcatttggattggttaaacgctatcaatatgtatttatcttgttaaaagaatctccttttctgcttaataggcgaggggtttgaagaagcatctgaagaggctcaatgcccccagccattggatgcttgacaagcttggtggagcatttgtaagtacattgtatagccgcaagttatatcacgcagttcaaatgcattctgtataatgctaatgtagtgtttggcaaatgggaaagggaaatgatttcccacccatctttaaatcctaaccattcattctccctcttccatttaatcctaacccttcattcatttcccaatcccaatcccaccccccatttcccattatccaaacacatcctaagtgtttgctcgaattttttctgatgtttatttcctgggcaggcacccaagccttcttctggtccccacaaagctcgggagtgcttgcctttgatccttatcctcaggaacaggttgaagtatgctctgacctaccgtgaggttatttccatcttgatgcagcggcatgttatggttgatggaaaggtcaggactgacaagacttatccggctggattcatgggtgcgtgccctgatttgctgcatcattgtacgagaagtcaatgtctaattaattccatggaatcccttattagtttcttgtatcatgcagacgttgtgtcaattgcaaagactggggagaatttccgccttctgtatgacaccaagggtcgcttccgtctccacagcatcaaggatgaggacgctaaggtttatattaaattatccatcactatatggttcataatagtaggaacttttgctttgtattcttctgtgcaatacaaaaacaaacaactaaaaatatccttatcaagtgaaatcctacgccttgcctaatatcaagcaaacttcttgatctttaaattctactagtcatgtttgcctcctatggctggtttcatcctccatcggtactgttgacccacaaatgtgtacgccagtgggcccgttccaccagatgtagcttcatatcatgttgttctgtttagttctttatgtttgtgtgatgtaggaattgaagacagatcctattaatatcctactaatatgtgttccttttataggattcttatctttatagatttactttgaggttctctttcttgtgccaatgtggtttgcttggtttgtgctttttttgcttgacaaaattctattgagtcctacacttttgctttaaaatatttactgaaatacttctgttaataatgcagttcaagctctgcaaggtccggtctgtacagtttggacagaagggtattcctttcctgaacaccaacgacgggcgcacgatccgctacccagacccactcatcaaggccaacgacaccatcaagattgacttggagaccaacaagatcgtggacttcatcaagtttgatgttggaaacatcgtgatggtgaccggtgggaggaacacggggcgcgtcggggtgatcaagagcagggagaagcacaagggcagctttgagaccatccatgtcgaggatgccctcggccaccagttcgcgactcgcatgggcaacgtcttcaccatcggcaaggagaggaagccgtgggtatctctccccaagggcaagggcatcaagctcagcatcattgaggaggcgaggaagcgcaatgccgaggctgccgctgaggcttgatttctgaaaatctccatgaatgaaactgttgatttgagcagtctatttatatagattatttagctcttaagatcatatgtccattggagaccgtcaattggcgcttcattgttcgatacttgtcgagctgttttgaaactatgaattcatcatctgttaccttcagcataatagatccagaatccttttttagcttgtgtaatctttcccaaatgagaagctaccttgcatactgaaatgaattccacatgatgtttggatttgcaagttcgtatttttgggccctcttttatgggttgtgatggtcaacgttaccctgatacggctacaaagcgacgtatctgtatctgatacggcaacggatacgttccggtacggacggatacggatacgttccgatacgtattcggtatgtatcccatatatttgtgatttcaaaaaaacaaaataaattgagatacgccagcgatacggccgcgacgtgcctccgtctacgctcgcatcagggatgcgccgccccatacgctcccatcctgatggctgtctctcgtgcgtgcccggcaatgccaccggagacgccggctgcagccgcgcgcttggttgccgtgcgcgggccacaacgtcctctccgcgagacggaagagctgccgcggctgggcggcggcgcacctccttcgccgccaacctcggaggccacgaccgttgccgggcatagcggaggccggtggcaggctggccgctggcagcatcaaagcagggagctttttctttgtttgcttgactgcctggccgggtaaatccatgctctttgaacgtttcttgcttgaatctgttgtgcctttcatgtttttcttaggacaaagtaccgtttttgttagatacaagtgctagtgcatccagcaattctagtggttactggttagtgcggctgctaatgttgatgcaaagtcatcaagagttatatgattgaactattaatacgtggtttttgggatcttaatcgtttgttaatttgaattgcttatagaaaagaaaattgcaaaatattgatatggaatcggctactattagtattatatcgctatttctttataaaagctccttattttttttttgtatttttaatatatattaatgtaatttccttaattttttgtgtgttttcaatatatatatagacgtatccccgtatccttggtttttggaaaatgtcgtatctccttatcgacgtatcgcgtatccgtattcctgtatctgggtaacgtaggtgatggttgaacagcaaactgtgcatccaagtgaattccacatgatgtgcatccaagtgaattccacatgatgttttggatttgcaagttccacatgatgttttggatttgcaagttcgtatttggccctcttttatggattgagatggttgaacagcaaaatctatgcatccaagtgctggctcgagctttgggatcttggtttgggcaaagtttgaagaacaggatgcgctgaaaatttcataaactcctttatccagtgcatattcagagttatggattctatgtattcagtgcacattcagaatttgcacgagctgcgtgtaaaaagaaaaaaaattccgttgccgggactcgaacccgggtctctcgggtgagagccgagtatcctaaccagctagactacaacggatgttgtgctgtagttgatccctgggaatatatattaatgttttttgatcacataaacagtattttcgacgcgtattgtcgtagatacagcgtacaaataaatgaatgtattggttgggtcgcgttggatacgtacaggacacagcagcctaggctagtaggcttgattgacatgttaccgagaaaggcctatacggcgataatgtccatggatgaccgaccactcatctgcatgcgccgctgcctagctgcaccttcccttattattagccgaagcacctgccatggcctccctgttgctagtatatactacctcaatctcttctctactacttaaaaaataagaaataagagatgctttcatcgtccgtcaaaaaagccagacaaaaaaacaaaatttgtccgatccaaaaaaaaaaccgggcgaaaaaaacgtgcggaaaaaaaaaagaaaagaaaaaccaaatctgccctatccagaaaaaagaggcgaaaaaaactggcaaaaaaaaccaaaattgtctgatctaaaaaaaccggcgaaagaaaacgtctagaaaaaaagaggcgaaagaaaaccaaaattgtcttgatccaaaaaaaccgggcgaaagaaaacgtgcaaaaaaaagaaaagaaaaaccaaatctgcaaatctgtccgagccggaaaaaaggggcaaaaaaagaccgggcgaaaaaaaaaacaaaattgtccgatccaaaaaaaaccgggcgaaagaaaacgtgcgaaaaaaggaaaagaaaaaccaaatctgacgcggtaaaagaaaattcgggggaaaaaacgaatctgtctgattccccaaaaataattgtctgatctctactattataaaaactagcattgtggcccgcgcagattgcgcggctagcatcattatattttctctcatataatagcatatatgttttctcattatattattcaaatatattaaaatgacaatataattttaaattttgcaataactctacaaaactactaatgtgtaatgttcatattatattttatatacgtgttagttattaattatttttaatattaaattttagttattcgtaaattatatatattcctatatggattctagaatcgtcttttaatatttctttttttagttccgaattttctgtaaattgtatttctatatagactctatgctcttcttccaatattatttatttttatttcttaattttcatattatattttatatacgtgttagttattaattatttttaatattaaattttagttatttgtaaattatatatattcctatatggactctagacttgtgtcagggttatggataccacattcctaatagtagttgactaaatctcggcaggacccaccgcataccatgtcctatatggaaacaacctgcggatataggaggagttccggataaggaaagacaaccagagttctacattgaaacgacaaggactactcggattgtatccatattggtttccttagttctacttggacaagggaacacctatgggtataaatacaaggctccctaggaggagaggggacacaatacacacccgccatggaagagacccacaatcaacatacatggaacatagatcaagacagaagatcaacatacaagccaacatacgccaagacaagacgtcgggtatcgacttcagggataagcacggctagtcccttacgttgtctccggatactgtcaggagagacgaaagcgctatctttgatctcgccgggcacgaactcgaggaggaagactaccctgttgtcgactatgagtcagaattacagaccgctatgtcgacaacagttagataggctaccccaaatattgtactggtgtgattatgatgaataagagcaataccggcttcggccaacaggatgtagggttattacctgacaattcaggggcccgaacctgtataaaaatcctcgtccccgtctcttttacctcagtcttatgtatatcctagtaccaacgattcccataccatgcaaatactggaatcgcgacatcaaacgtcgacaacttgtcttttaatacttcttttttttaataccaaattttctgtaaattgtatttctatgtagactccatgctcttctttcaatattatttatttttatttcttatatttcatattatattttatatacgtgttagttattaattatttttaaaatcaaattttagttatttgtaaattatatatattcctatatggactctagacttgtcttttaatatttctttttttaattccaaattttctataaattgtatttctatatagactctatgcttttcttccaatattatttatttttatttcttaatttttattatttctaattgtatttctatgtggactctaaactcatctttcaatattctttattttttaatttttgaatttcagttactttgacggagcttgggctcctcaccgggagaccgcgcaggcccctctttgccggttcggccgggggcgctatgtgaggttcttcgccctcgatctaaggaacgtcagcgagaagaatcgcacaagacacgggcgacatagacaggttcgggccgctgagaagcgtaataccctactcctgtgttctggtggatctgagtgtgaaggaatacagagagctggagagcgagagagagttcaggctttcgcctctattcgccagcctccctcctctcctaggcctgggcctcctttttatctagttaggggtcaccacatgggcctcaagctgcctaaaaaaagaaacattccttttacaatgagggctaatctacagccggaagtgacctctgacaagcacagcacacgccttctgctccgctcgtcagctctcccggtggacgcccctttcaaccttcattcaatggccagcgactttcttgccatgcttgcgctgaagcctggcatggatctgaccgggactgacataccaactccaggagtcagcacgccggctccggctagggacgagagccaggaagctctcatcattccgacgggacggggcgaggcgtgtgacaggccgcctgttgccacctaacccgcaatctgaccggtctgtgaccggtcacataccgcgactggtcacggaccggataagcatgcgctgcgccgtattgaatacggcgcggcgcgctcgtctaacccgctataaatgcggttaggtgagcgccgctgtgctcacctaacccacacacgtggcgccaacaccacagggggtcggggcgccccagccctcggggccgaaacgggagcggcccgacccctcggggagacagagggaggggtggccacgtcaccctcgggcccgacccccccgagggggtcgggccacgtgggtgatcgcggctacccaagcctctagtcacgatacccccgcccctatgtcaccgacagtagcccccggcgttacgccagggcgaccgcccccctcgagggaggcgctcgggcgtgacgccactccttaggcccggtgacaggtggggccggtccccgcaggcgggcagaaacccaacggtcgcaaatcgcgcgcatcgggacgagccggtttgtttcgcctggggacatgatgatggcgttttttgcggttggcgagcgcagttaatgcgcgcacgatctgccccatctcaaacgtcacggctgcacatctgccgcgtgcgccgcaaacgggcgagtggggttagtggtggcgtgggtgcgagaaacgagggggcgaggtagtgggcgcgggaaacgaggagccgggcatagcgttggcaagggtacaaagacgccaaggaagggatttgtttccttcctctcgccactcttccccttgccttcgccacttgcgctctgactctttgtttcctgcgccctacccttgccgtactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacacccggcgccacactacccagggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgttgaaccgctacattccttgcgtcctccgcaaaaagtgggacgactggaagagcgattggttctacacccccctcgccgacgaagcgcgcctccgacttcagagccagcctccggcgcaggcctccagctggcgggcggcggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggtcccccgtggccacgatggcgcgggagggagccgcaggggggaacaatctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggccccgcaagatgggggggaccgagccatgccgggggaacctcatctcacccctgaggtggtcgtttagccgacctccccgcaggttcgtccccgcgctcgccgcggccgtattcattctcccatctcccaaggcgagttttcactcacccgtttctttttgtcttcttgtttttcttctgcctcagcgagatcccgtcacgccccccccgccattccaagtccggccggtctgaggccgaggagacggtgaccgcggaggcccagaggcgggaagctgaccggcgagaagccgtggaccgcctccgggaagccgaggaggctgcccaggaggccgtccgggttcgccaggctgaggaggccgctcgggaggaggccagactccgccgggccggggagtccgtccgggaggcagaggcggcgcgcgcatgccaggcggcctgccaagcccccgacccgactccgcccgaggcgacgacgacttccgaggccacccacgatgaggccgcgggcgcgccgctcgggcccgacccctcgggcgacgcttgggacgagccagcttcgggggacgcccccaagtccggcacgtcgatcggcgggccgagccgcgcggcacccacatcgaggcgactctcccctctgccttccgctgccccactgagcacggagcccctcctgcaggtcttggccaccgcgaacagcacggtgctggacgggttaactgcccagatggaggccctgcaggcggagcgggcgcagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcaccaccgccgtgctcgacgaggcgcgggacgacctccgcctaccatacgggagccgggcggcggagctagaggagaagctcgacaccgcccggggagtccttgacgccgccgcttcccgggaacggcgggcggcggagaacgaggcggcgtcccggcagcgcgatgaggcccttgagactagcgccacggcgctggaggagcgcgcccgcgccctggacgcgaaggagagagacttggcggaccgtgaggccgccgttgccacccgggaggcaacactggcggcgcacgaggccacctgcgccgaagaggagtccgcactccgcctccgtgaggacgcggtcaccgagcgggggtgagctctcgaggaggccgaggccgcggcgcagcgggtggcggacagcctgttcctccgcgaggcagcgcgggaggagcaggcgcgccgcaatctggaaggcgtccgcgccgagagggccacactggatcagcgggccgctgagctcgaggcgtgggcgaaggagctggacgcgagagcgcacagcggcggggcggccacgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacaccgtctcccgtctagaccgcgccgggcggcaggtgggcctctggggcgggcggtacgcgaagtacgccgccaaccaggggggcctcgcccagcgcctctcagagatggccggggtcctcaagcggctccccgaggagctcgaggagacgatcaagtcatcctcgagggacctcgcccggggggcagtggagctcgtactagcaagctaccaggccagggaccctaacttctccccgtgggcagcgctggaagagttccctcccgaaaccgaggacggcgcgcgcgcaggtccgggacgccgccgaccacatcgtctacagcttcgagggtacggcccctcggctcgcgttcgccctcgactccgacgaggagggcggtgacgacggtgcggacgacagcgacgacgaggccggcgacccgggcgcatcggagtgatcccccaggcccccgccaatcttaataacttttccttctttttccgaggccttcgggcccccttcttgtatagactgatttaatctgtaatcaaataaagaggaaatttctacgtcagttatgtttgttgtgtgtatgagacgaggatggtctgtgccgcggtccttctgtgtcttggcttgaacgagggctcgtgcctaggtcccagcctcaagcggcgcgggtcggggctagtgcctggggagatccgcgtgtcgagactggccaggccgggagcgtggtgatcgagggttatggatgaccctattgtgggcctttgccgatttccccccggagttcaccacgccccggggcacggctcggttctgggccccgtttggcgattttagccggcccgggccactgagggcagggttgagcacgagcgtgctaattcaagccaagattcttcaaaaggaaacgatggcacagacacagtcctcaggaaatcgaaagtgcttttattgaaatacggaagggagaaaggattagtatatgcatgtggtagcccccggccaaccctgcacgcccggggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgtggcgtaggacgaggtcgtcgacgcagagtgatcgggcccggacgtggcgctgatgatagcgccgcaggctctgctggtagcgcgcggctcggagggccgcgcgccgcctttgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgccctgagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaacttaagcgcggagtgcttatcgatcttgatgaccggataagcctcgggccacttagtgaacttgttgacagcgacatacagatactcgaacccgcccggggcccgcctgaacggacccaggatatcgagcccccagacagcaaacggccacgaaagaggtatggtctgcagggcctgggccggctggtgggtttgcctggcgtggaactggcacgccctgcaccgccggaccaggtcgaccgcatcgttgagagccgtcggccaatagaaaccctgacgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggaactgggagcgctcccctcgggtcccgaggcctggactccgacgggcctcgagggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgtacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaaaagacagggagccgtcgaactgcatcacccagtaggcggtgtgaggcagctgcgaggggcccgagctggcctcgagggcggagacgggctcgggagctggggtccactccgccacaaagtcggcgagggcctggctcttgatcgcgtggcgtggttcaaagcgcaaatcaaattcagagagttcgattgcccatcccgccaccctggagcgcgcaggagcgcgcccgcagcctggagcgcgccctggggcgtgccgccattgccgtagacgaggcggcgacgcgccccgtctcgccgtcctcccccgtcgcccgcgggcggcgaagtcacggatcctccgacctccccgagcgcctccccacgcccaagatttcggcgagagggggacggtggggtgcgagcccgacggcgcgggttctgctccccgtcgtcaccgctagcgctcggagagaggctgtgggccactgcccgttcggccattgggctgagcggaagaagcttggcgcacacgaaagaggacgagggctcagaaagacacgcgcgccccctacctggcgcgccagatgacggagcttggggctcctcaccgggagaccgcgcaggcccccctttgccggttcggccgggggcgctatgtgaggttcttcgccctcgatctaaggaacgtcagcgagaagaatcgcacaagacacgtgcgacgtagacaggttcgggccgctgagaagcgtaataccctactcctgtgttctggtggatctgagtgtgaaggaatacagagagctggagagcgagagagagttcaggctttcgcctccattcgccagcctccctcctctcctaggcctgggcctcctttttatctggttaggggtcaccacatgggcctcaagctgcctaaaaaaagaaacattccttttacaatgagggctaatctacagccggaagtgacctctgacaagcacagcacacgccttctgctccgctcgtcagctctcccggtggacacccctttcaaccttcattcaatggccagcgactttcttgccatgcttgcgctgaagcctggcatggatctgaccgggactgacataccaactccaggagtcagcacgccggctccggctagggacgagagccaggaagctctcatcattccgacgggacggggcgaggcgtgtgacaggccgcctgttgccacctaacccacgatctgaccggtctgtgaccggtcacataccgcgactggtcacggaccggataagcatgcgctgcgccgcattgaatacggcgcggcgcgctcgtctaacccgctataaatgcggttaggtgagcgccgctgtgctcacctaacccacacacgtggcgcccacaccacaggggatcggggcgccccagccctcggggccgaaacgggagcggcccgacccctcggggagacagagggaggggtggccacgtgggtgatcgcggttacccaagcctcttgtcacgatacccccggccctatgtcaccgacatacttctaaattgtatttctatatttgtatttctatattgaccttaaatttttcttcccatgtttttcttaatttcgaattttagttatttgaaaattatatttttatacggactctaaactcttcttttaattttattatgtttattccaaattttagttagttttaaattcctatatggactctatactctacttctaatattccttattttttaattccgaatttctttttttttcttaattgtatttctatacggactctatactctacttctaatattccttatttttaattctgaatttcagttatttcctaattgtatttctatatggactctatactctacttctaatattccttattttcaattccgaatttcagttatttcctaattatatttctatacagactctagtctactattctaatattccttattttttaattccgaatttcaactatttctaaattgtatttctatatagactctagtcttctcttctagtattccttattttttaattccgaatttcagctatttctaaattatatttctatatggactctgttttttcttttttctaattaatgtgagaatatctaggccatgagagcgatcgtggagactcctttttctattcctttaataatataatagattaaagatgcttccgccgtccgtcatccgtgtttgaatcagttataaaaactaaagatatttccacggtttgtcatccatgtttgagtcagttttgcaaaaaaaaaaaagctaaaaaaacaaccgagaaaaaaagtccgactcccctacgaaagcggtgaaaaaaaagaaaaagaataaacgtagatccaattccaaaactggaaaactaaacaacgaaaagtcgggaaaaaaagcgcggcctctactaccagtccaaataaaaaacaacctagaaaaaaagagtccgattaaaaaaagaaaaggaaaaccgtagatacgattgcccttaaaaacagggaaaaagaaaagagaaaagtcggaaaaagagcgcggcaaaaaggaccgattttaatttgttttagtagtatgtatatactattctctatctctaatctaatctaatcttactatgtacaaaaataagttttcatcgtacatttaaaaagaaaaatacgtgacaaaatgaaagcggttaaaaaaatatgtgagaaaaaaatgtcaattaaaagcgcaaaagaaaatgtgttggaaaaaaaggtttccttcatccgtaaaaacaaaaaaaagaacgagaacaaaaaagggtttccttcatccttaaaaaagcaaaaaaaaacatgcaaggaaaaaactatcagaaaaacacgccatttcttaaaaaatggtttgaaaaaatcgcgcaagaaaaaaaataccatttataaaaatacaatccgctctaagaaaacggttagaaaaaaaagataaattgatgaacgcttgggtcggataggatccatcgggttttttccatctcctctacgatcgtcatttattctcatgtattggagaccctgcgtatctctgtaggcaattatcaaactatttttgttaagtatagctactattcttgataacatattatatggaaataatattaaaaaataaacatatttttaattgttatttagagaagagtgctcaatgactctattttgtgtagacttggtcatgcgagacagggtaggatttaattggtcctattattggttgcaggaatgagattgaaagagtattttagattatatgtatgttgccacatgaataatccaattattttagataaagcaaacatcggtaaagttgccatcgtcgaggttgggctattatattgaagatgttccaattttctgattgtcttagctacaaacgatctatacaaacattgccattgacatggttatgcatgaaaaatgtatattatcattagaaatttttcacctgttgcaacgcacgggtatttttgctagtctaaaaaaacgaacctagaacttgatgtgccacatcatactataacgaatctggataaatatatgttcaaattcatagtactagaaaatgtcacatctagtactggggtgtagtactggggtgtatttagttcacgcaaaattagaagtctagttgaaattggaacgatgtgacgaaaaagttgaagtttgtgtgtgtaggaaagttttgatgtgatggaaaagttggaagtttaaaaataaaagtttggacctaaacaaggactaggttggtttttttaataggacggagggagtactctgtaggtttcaaaataagtttatttttcgccaattcaacacataccaatataaaactatacgaaccaaaatattcttactttatcaaatcgtattgcaataatcttttaatttatttacttcctgatatatttatctccaaattttataaacttcgatgtaatgattacttaaaacaaatttattttataacaaacgagagagagaaaaaaattaaacttagggcccctttgaatcaaaagatttatgtgcgaatttcataggattcaaatcctataggaaatttttctatttagccctttgattcaaaggattgaagatgtccaaatcctataaaattcctatgaaatgacacattgcatgtggattttagagaaaatgtagcaagaacttcaacctcttggaaaatttcctttgagtctatcgctctcctccgatttctacatttttcccgcgctccaatcaaatgacccgttcatgtgttttgcaattctctgttttgcacttcaattcttattagaattctgtattttttttctatttctctattttttcgaccctatgattcaaatggccccttattatgatacgaagggagtactaccagcttccttacatttgacatgaccattcttgccctgcttggagtgcagcacaactgcacaaggcaaatactactggggctctattggagtatagacttctactcctacttgagttaaatctaccacattattcttttctctgtggttctgatcacagatcaaatttaacattgttcgctactactaatgtatcagaatcctgttgagctcatggattcagtacgatttcaagtctgggtattaatttgattgtagataaaattcatcacaagaatacaagataatgcaggactctggaagggtggatcgttgagggaaaaaaaaggctgagaataaagtatgagggcgttcacagcgcaagtacgtggtgtttagccccacatcaagaaaccgaatattcgatgtcatatcgctaatatgtggagccaaaacaagacactcgttcttcgccttgctcgagggcttgcgagttgcaacacagggaggaacgcgcgcagccgcgttgtgaagggcggagccttacgcagcatggctttgcacatgcgtcggcgagtgaccccctccccccggctcaccgacgtggaacctgtattttagacccgtatctctagcctatgtggcactgtgaggctcctcaaactaatgtgactgtactgtgaacatcgtctagttaaatatatacaaacatatatatttttttcagaaacttttgggtattcacgtgatacccaagaaccctctggatctgcccaagcagcttgccaaggagctgatttgattgattttgccaacgtaatcttcatcgctacctaggaaaaaccgacttcttcgctggaaagaagcagcagctttgctcaacaaatggcaccaaactcaagaaaagtttcattctgaagacaatttttgaccgacgaaaatgcagcaagcaaagcataattaagcatcctctagtcatcagtcaaacgtatgctaccatgctgtcaggaaacttcggagttttgtaagtaaaccaacaactttggatcataacaggaagatggagtatgaaagagtactaaacagatgaagcatatcctcttcagtgatacttttcttgtgtctgaaacaacttggaattagacgaatggcccacaaattcccttttttttacttgatttgctagtcttactcgatcataataaatatagcaacatcaactacaaccggtcaatcgaggtttttgggcactgatcataataaacataatgtcaatcgagtaacatttagtttaaaataaaatactgctaacatttactagtacctggacaaggtatgcagaaagcaagcctgaaatctgaaatctgtactcctactggcctaccttatttaccacactgcttcccaagttctctgttcatgagggccctactatttattctccaggatctgggcccaccagccaggatagcatcaaaacaccctgtccatgatccaaattcatgcttctttgtactagcaaaacaccaatgtcgccttcatgtcctagacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcctagacaactgagacacaacttatcttccttggctgttcatgttcttgcagtttgcttcgtcagatacagtcatacagaacttaaatctttttttcttcacaagctgtgagtgttgtctttagctgtggatgcaagctttgtctgaaccttgtgtcctccttggtcattcatccattcattcatggtcatgcactatattccaagcttcaagctggtcttgtcagtggcctgcaacattaaatgcactttgccatgttagcttcagcatatccctgctgggagagaaaggtgaatccaccattgctgcctgcaccttcttgttgcttgctgcttgcattggccatgttcattcagtgagaaaatcagaaagagaaaaataagggacagttgaaagttgaaacccagttagttcattcatggcttcttttgttctcttctccgaatggaaacaaacggcaaaagggtttaccaacttgtgtgttcataatcaaggttaataatggaagttgcatagcattttggtggcaattagcatcacaagggatctgaatgcacttgtctgaaggaaaactgtatactacaggaatggatgcaggtttcttgcaagacctgcactgcattcagttgagttagatttgactataacagtacaacctcttgaatggatctggtaattagcacataattgataattgcatcgagttcgacagtttcaattggttaacttgaccagaactataattgcatatcattccatctctttcggagtttcggtctttcctagccaaatgattattgtcctccagtcttctctgaaatgatctcatatgcagtatttttttctgctgaacttcactcaaatctcatatgaagtataggctgtgtttagatccaaagtttagatccaaactttactccttttccatcacatcaacctttcatacaaacacaacttttcaatcacatcatatctaattttaaccaaaatccaaactttgcgctgaactaaatacagccaaagcataactgtattacccaaatctacataaagtgataaaagatcatgaatcgaaaaataattcaagaacctgttgttctagttgcaaatagtcatcaaaagctcaggcatgtcaccttacaaaatgttactacaacaagacctgccttttgctcaacatctcaagtgagagaatcatctgacaacaactaatacaacagctacctttgaaattaatttctacattagtagcaatacgacttaaacctgcttataatactagataagtttagcaagtctaaacatgtaatctgaattaattttttcgagcttggtttcacatgacgctgcaagagttggcgttgtcgtcgctgaaaaggtcgccgtaggagttcctcgccggcgaggccgcgctcctctgcggcgtcctctggccgccgccaccgccgccgccgccgccgccgtagtagtagtagctgtagtagccgccgtagcggtaaggcgacggctgagactgcgagtagtacggcgagtacgcgtacgagtgctcctgcggcggcgccggcggcaatggaggtggaggcctcgcggcggatgcaggacgcgcggcggcgtagtacgccgcgctcgagctcggccgcgccacgttgtagctcatgacgtgcaccggctgctgctgcaatggcgccgccgggaagtggtggctcgtgtggttgccctgcgttgatgccgccgccgccgccgccgtggccatggtggcttcacctgccttctcctctttctgctgctgcggcggctgctgcttccttctcctcttgggctcactgggctgctgcgccttgaccgtctcgacgccgccgccgccgccgccgccgtcgccggcgctctcactgacattggcgtcggtgatctccgtgccaccgtcttcagccggcgccacggcggcggcgccctcgccggcgaccttcttgggttcttcatgcgtcacctttgggtcgcttggctccgcggcgtcgccggacgccggcttctccggctcagccggctcgccggacatgcccggctcggcagcttggttcttggtttcttcttggcactgaccaccattgggttgctgctgctgctgctcctccggccattgctcggcgtgcttcccggccctcctcagcttccttacgagagtgtcggcgctgaccttgccggtgacggtgaccgtcgccttgttgctccggccatcgacgtcgcatctgtacacgccttcggaatcaacagagcacattattctgtcagttttagtcacgtttttctctgcttttttgaagtgaaaagagaagggaaaaaaaatctgtttccacagatgcttcgccgatgaaactactaactgcagcatcaaaaaatggggagctaaaaatgcatcaaaatgcaggtgatttgatttgatttgatacaaacgcacacaccttcaactctctggagcaccttcttcaccttcttcttgcatccctcgcagtggatggacactctgagagccaaaacctgcagcatgaatcaaatcataatcaatcatttaaaatatctctgattgagatgaaaaataaatgttctctctcattctcaacctcccagtggatgtgaatgcatgcagaaggaagacaaagtagtgagattgtgagtgagaatgtgtcgatgttggtagtctggtaattggtaccttgcattgcagagattctgaagccatggaggaagggaaggtatagcggtggaagaagggaaagtggccaatgagtgtgtactgcactgtcaacggcgcatggacgagggaggagaggttttatagcggcacggagtacctacctgtagttcagaacgccataaagaatcaccactgtttcatgtaaaattcgtggtacaaattttgtaagaaacttctttttttttattttacatattacgtgaaagacacgtacacaacaaaaaacaatgctgttttaaatggactctttgccgataaccgattatgtaacactagtttatatagcggttaactttataactcttttgaaacacattcatatgaaaatataggaatgtgccgcgtgtgtaaaatagaaacacgaaaaggtataaaaaacatttgactgattttttaatggttggtagggaaaaaataggaatactgagtattaagttaatagtagatctcaatgccttgatccatacaacttgaggccaaatatacttttagagaatgctgttgatcgggcgctcgggggagcgcagcaaaaatcgtcccccccccccacccgacgcgcgtggacgcccctaggaccccaccacccacactgccacgtgtccccaccacatactctattgtaataaatcacccacatattttagaaaaacctctattaggagatttcgtttaattttttgtttcgcctagtgtactcacaatgtttcactatgtatagatctaatgttgcaatgaactgaaatattttttttcaacaaatcactcacatattttggaaaccctctattaagggaattcgttttattttttgttccacaaaaaatgtttcatctagtgtactcacaatgtttcattatgtatagattaatgttgcagtgaactgaaatatttttttgctatttgctgaaacattgtttttatataaggtgaaacaacgtccgatttaaacgattaaaacattttcgatctacttagtgaaacaattccgatatacttagtagaacattgtgcaatattttaaaataattcaataataagctaaaaaaatcgtcggaatatatccttgtgtggtcttgtcttgaagatttaattgtaacgaatttaatggtgcaatcggatcataatttggataaataatttaagagaaaaattaatttaaagcggttttgtatgtatgcgtggcgctgatgtcatgctaatattagcgtccgatttttgccaatccggatcgggcgaccgatccgtagtctcctcctatatttatgtcatgacaacctattcctatattttttttagttcccacgtgtttttaaatcatgtgttctaaaagaaccctaaagaatttggcaatttccaaccttagtattccaaacaaccctcataggaaaataaatcctccatatttctcataataataatatttgcctccacccaacacgagctgggaaaaacatgagcgtggagtgggtttaacgggtctggatcccctggagttgagtataactctaccgggtggagttggccaaatctgtgacatccattgtttcctacagctgagatcattcctcatcaatttcacctaataaattaactccttaaattaatggttatgactttcgaggaaactttttttcatgcattttctctataaatagcgatttgattaaattctcaccaaaaaaaaaataatagaccagtgttttgttattgcccaaacaatagatataatcgatcaactctaaagcttcaagcagtctataccaacatgtatagtgctttcacatacagtgaaccatatcaatattaatgtgtgtgattttttatataatagatgaagcattaaattttttgctaattatacagtaaaaatgatctcatgacaagttgttgatgcaagtttatttgttgcatggtcagttactggtttttaagtacaaattaatgtggcttaatctcaacccttgaagtataccgaatggcacatgtttaaccaactacaaattaatgtggcttaatctcaacccttgaagtataccgaatggcacatgtttaaccaactccaccctgtagagttatatctaactctagggaatctggactcgggtttaacatttcctttatttttcctccggaatcacagggaaaggaaaattttatagcttttcttgtgttcattcctacgagaccagacagtcagacaatgccaacaaaaaaaaaagaagactaagaatgttggttatgtttcctgggattgttttatattccagagtttccattaagattgtgttagctgtagtgaatttcctcggtgtttcattatctgtcttccgcgtcatgccgttttgtctgtcatcacgggaaccggaatatccaactgtacaccaaaatatttaactatttatcacttttacacgtgatgtttaacaaatttacgactgaacttacatgtcatatacagtacataaaaccaatgccatatgaatgataaattattaaacatcaaatctaaaaagtgataattagttaatgctccgtccaagataggagatgatatatagggctgcagtgtggagcgtttccagcccacggacttgtttgctttgggaagcccatgaaatgtacaggcttctcctttggtgaatgcgcactctttctaagctggtagagttttgattttatataaaaaactaacatattaatttttaaatactttttgaaataatctttgaactttgtaataatttattccttttttactctcaaataattatcacaaatcattgtcttaaaaaacaaaaagaactcatcagaacctagtatttacgtacttctcatggagtttcctaaaacagaacagcttttcattcgattacccataagacattgattaattaatattgttgtaaccagctttgatatagtgatagttccagaagcttacccgaatattctttttttttttgcttatatactttctccgtttcacaatgtaagtcattctaactttttccacattcatattgatgttaatgaatctagatagagatatatgtctaggttcattaacatcgatgttaatgaatctagatagagatatatgtctaggttcattaacatcgatatgaatgtgagaaatgtaagaatgacttacattgtgaaatggagggagtagttcactaatccgttcgacaataagaccagcagtaggataagaaatccagacctccaaacgaaaattgctatacatatacgacctaactgttcgacttatatattactaaatttgatcaacggttgtaaatgactacagtgtatatggatatgctattctttcattaatctatggttacatgtttcgttgtatatgagttgtacaactagatcctatgtaattaccaaaataaacgaacaatgaaaatgaaaaaggttggaacttgttgctgattgctcataggatcatccataactaagtcagtctgattctttatactcttttttcaggccttgaggggagtcagagaccaacagcagcttctcatttcaagaatgcctacagataatgctgccattatctgttgagagtgggaggtgaactgaaacattgagtagcgatttggcgcatcaaaggaaagaataaatctaaacaagtgcttatcggattcattctcagaagctggttttttcttcggatttgatataaatgtgttgccatatttttcatgaaaaaaaatactccatcctttccaaattgatcatcatataatggaatccaaaatttctcaaattgattatcatataaccacatgaacacggatttcattaaaatacaattaatgccgcataagagaatatgtgcatgctagggtgtaattgacatgatgttttaattgatgcatgtattgcaggagaatgtgtgcatggtgtcttgattgatgtgatttaaattatccttagtcttgatgcataaacatatattccctccgtctctaaatatttgacgccgttgacttttttaaacatgtttgattgtttatcttattcaaaaacttttgtgaaatatgtaaaactatatgtatacataaaagtatatttaacaatgaatacaatgataggaaaagaattaataattacttaaattttttgaataaaacgaacggtcaaacatgtttaaaaagtcaacggtgttaaatatttagggacggagggagtatgattatcattttgggatggagggagtagtcagtatgtatttatattgtactaagtccctaaattatatatgtaattattaattatagtgtatctagaatataagttcctaaattatatgtgtaagttccaaaattacgtatgtaactctctaaattacatatatgtaattaattacacttgatttataatataattatatttgacatatttttacaaaaacctgtggccgtagatagttttctttgaaggagggtacacaagcatatggcacacacataccaaacctaacagatgcagttactgatatgatccatccacaccttctgcaagttcacgatttcaaggatgcatctcccatgtatcctgggatcacgcatactttgcagggccatgtatattcctgtagcaaaaaacaaaataatccaaccaaattacaggtttaatttcgagagcatatataaacatgggatcactcacgctaaattaatttttgtgctgtgcacgtacacgattgcattgctactgccatggctcacatgatgacgtcatcacccactgcctgcgttgtccttgctcttgcctttgtcctcctcgcagtgacgccgacgctctgctacgtcactgacggcgcgacgcggcggcgaggcgcgagcacgagccggcgccatggcgaagctcggacttacatcgtgctcgtcgagccaccggatgccgacggcgatgacgacgaggccgcgcaccgccggtggcacgagtcattcttgcctggcggtggcggtggcggtggcggcgaggagcgggcgtcgccgacgcgcatccgccactcgtacacgggggtggtgtctggcttcgccgcgacgctgacgcgcggcgaggtcgccgccgtgtcgaggaggcgcgggttcgtgcgcgcgttcccggagcggaggttgccgctcctgacgacgcgctcgccggggttcctcgggctgacgccggagcggggcgtgtggaaggcggccgggtacggcgagggcgtggtcgtcggcctgctcgacaccggcatcgacgcggcgcacccgtcgttccgcggcgagggcatgccgccgccgccggccaggtggaagggcgcgtgcacgcctcccgcgcggtgcaacaacaagctcgtcggcgcggcgtcgttcgtctacggcaacgagaccggcgacgaggtggggcacgggacgcacacggcggccacggcggccgggcgcttcgtcgacggcgtctcggcgttcggcctcgccgcgggcaccgcctccgggatggcccccggtgcgcacctcgccatgtacaaggtctgcaacgaccaggggtgcttcgagtccgacgtgctcgccgggatggacgcggcggtgaaggacggcgtcgacgtgctgtccatctccctcggtggcccgtccttgccgttcgacaaggacccgatcgccatcggcgcgttcggggcgatgtccaagggcatcgccgtcgtgtgcgccggcggcaacagcgggccgacgcacttcacgctgtccaacgaggcgccgtggatgctcaccgtggcggccgggtcggtggaccggagcttccgcgccacagtgcggctcggcgacggcgaggcgttcgacggcgagtcgctcagccaggacaagcgcttcagctccaaggagtacccactgtactactcccagggcaccaactactgcgacttcttcgacgtcaacgtcaccggcgcggtggtcgtgtgcgacaccgagacgccgctgcctccgacgagctcaatcaacgcggtcaaggaggccggcggcgccggcgtggtgttcatcaacgaggcggacttcgggtacaccatcgtcgtcgagaagtactacggcctccccatgtcgcaggtgaccgccggcgacggcgccaagatcatgggatacgccgcggtggggtcgccggccgcgtcccacaacgcgacgatcgtgttcaacagcacggtggtcggcgtcaagccggctccggtggtcgccgccttctcgtcgcgcgggccgagcgcggcgagccccggcgtgccgaagccggacatcatggcgccggggctgaacatcctctccgcgtggccgtcgcaggtgcccgtcggcgagggcggcggcgagtcctacgacttcaacgtcgtctccggcacgtccatggcgacgccgcacgtcaccggcgtcgtggcgctcatcaagaagctccacccggactggtcgccggcgatgatcaagtcggcgatcatgacgacgtccagcgccgtggacaacgacggccacgccatcatggacgaggagcaccggaaggcgaggctctactccgtcggcgccggccacgtcgacccggcgaaggccatcgacccgggcctggtctacgacctcgccgccggcgactacgccgcctacatctgcgcgctcctcggcgaggcgtcgctgcgggtcatcaccggggacgccgccgcgacgtgcgcggcggcgggctccgtcgcggaggcgcagctgaactacccggcgatactggtgccgctgcgcggcccgggggtggaggtgacggtgaaccggacggtgacgaacgtcgggccggcgagggcgaggtacgcggcgcacgtggacgcgccggggtcggggacgacgacgacgacgacggtgaaggtggagccggcggagctggtgttcgaggaggcgatggagaggaagacgttcgcggtgacggtcacggcgagcggcggcggcggcgcgggcggcggcgggcatgtggtggcggaggggagcctccggtgggtgtcgcgacgtcacgtggtgcggagcccgatcgtggcggacagtagcgtcggcggccccagccgcaggtcggcacaagatgcttaattagttgccgccttcggtttgatcaacactacatttatatactatcgtcaattaacccatgtcatcgatatttatacatttcaagaggtaaagtttacagcaaattgtctcgaagtttacggtcgacggtagttcgtttacagtgatatggtgccttgaatttttttttttcacaagacggtttgaagttccattgatagagcatgaaaatccttgaagaccgtaaccaggaaaaacgaaaaaattataccacctcccacacaccgatagcgctaacacacaagtctagaagaaggctagcactggaccagccgatgctgagcatgaccgaccaccgctaggccaacaacagaacacagtcgagatcgtccaaaactcgacccttaaatccaacacacagcctaactctatccatgtattcaggatttagggagagagggtgagagagaagttagaacacctcgaccccctaggccctccgacgtggttaacttgtagaaattaggacgctgccacaggaggatgagaatctagagtgtgcttgcatcaattgtttgggtggtttcggcaaggggatgcctggacgacctctccaaggagagaagcgacggaaaaccgccgtcgccatccgtcaaggtctcaatagagccgagactgggttttctcccggcaaccacccttgagggggtgagacggcacaacaacgccctcaggagggaggaatgacactcgagcgccattgttgtcggtccgaccaaggttgggctgggttttcacccgccatccaccacctgccaatctactacaaatgcaccaatgctccatctccatctaatcctccgccaccaatgttgcaccggcaccccccgccggcccgtcgtcacgtgttgccacctcaccgggctccaactccagtgacatcacctcccgctgcggcctcgatgctgctggccgcaactcctccgccgtgccagatgccggccgagtctcccagcctcaccggccatccacagccaccggcgcccgcgcatgccgccacctccgccactcacccaacacctcgaggaccatgggcagatgaaacacaacgaagaactttattgatttttgctatacaggacatgagctattggaagggaagatggtcatcacgggctcacagacaaatcaggagagaaaggaagagagaaaggaagagagagaaccagatgaatggggaataaaatattagtatttacattagctgatgttagaggctgtttattgtactactatgagcaggtacaatagcaggctataagccagctacaaacatattttaaggagataaatgaggagagagaagagaagcgggctacagatttgtagccagctgtagcacagactttaagacacagtgtgtgtatgacaggtgggatcaagtattaatagtgtagtatgtaactattgtatgaatgagctattagattggctatagataaattggagctagtagttgactatactattgaacttgctctacatgttaactactctgttgcctgttggcggtaaatgaggggtccatgcataggattgcaagtgggatgggttgtgggccgtcccgccccaccccacaccagccgcaaactgcatgtgcgggcaaacggcagcccgccccgcacggcttggcgggattgctcagcccgacgggcaccgctggacagcccacaatgtgcacatctctgtttaattaggttcatcaatcacacaagcacataactactccatatcccaaatttagcacatgaaaactgtattattttcatgtgaaagtattctttttcaatgacataacaagtatagtactgaataagaacaccattcttttccttcaacatcatgactaaagttagagtgatgatgatgcattttctcttcatgataaaccaactgtcccaattgacaaagtgacaaacaactgcttccagctccatgagctcttccggtctttttctatattaccttcaacacattaaatttaataaagttggagtggagaaactactaatcgaaaattagaaatgaattcatcaaccgactgatcacaacgttattccatattgtagaatggagtaaatatgtactaagtttcatcaattaagaatgcatccaaaatatgaattaaaggacataattgacaataacaagcagttatcgaggatagtgagatatataacctgctgctggttgttgtgctggtactgcatgttactagaggtgtataggcattttcacctgtataggaagaaacaatggagttaataaaaaagagtacatgctggactgttggatgttaataaaaaagaaacaatgatgttagtggtgtagtatacaactatacaaaaatatagaatagccaagttaattcaaacgaatctcaatttaaatacctgaatgttgcacattttggtcatcactctcagcaagatcacgtgcaaagaaatcacccaaaccttctgccctcatccaatcttgaaggcaaatcaatgcctctacagtactgcttgaaagtctacttctatagtcactaatgatcctttctccagttgaaaatgctgcctctgatgccactgatgttgctggaatagccaaaacatcacgtgccattcgtgaaatcacagggtactttgttttgtttaccatccaccagttcaagatatcaaaatcatacccatcttggaaatcaccttcctgaggcatatcagcaagatatcgaataagctcactctttactttgctcctgcttttgtcatgtagaaactgtctccaatcagcgaattgattacttgcatcaacattctgctcaacacttgtttcgggctgagaattgatgttgtttgagcccccatacttggcagaatattcatcaaacaatttctgcatattactcttgatttccttaaggtaaggagttacagcagctccaaatgcagacttcaaacgaaactcaatgaatttgtacttataccttggatcaaaaataatcgggaaacatatttgcaagtattgagcgtcccagtacttcttaaatttttctttcatttccttgacaatagatgcaatggtgacatcttcatttgtagcctccttgtccaaaaccatctttatcttccaaagttcatgaaaatagcaagttgaagttgggtacaacgtaccagatactgcaacagtagcttcatagaaaactttcaacaaagcacaaagcttctcagccattgtccattgataatcgaagggttgatgcaaataatttatgtcatgccgatccaaggcttcaaaggccattctgtgtcatgcatgtggttcgactttttgtgctcctagatggttgaagggaggcggcgctgcgggcgttgcaggaggaatgtgcgagcgtgctgctagctggccatggcggtcaatttgttggactaatcagcatagcacacaccaaatccgagaagaggaggagcagcactgcgtaaaaaaaatactccatctgcgaagaagagctagcacctaacgcagataggagcatctcgcaagcgatcgagacttcgagagcatggagccacagctgccgaccgtgatatcgatggagtgggatagcaccaccgagccggccaaatcgtcgccgccgtcacagaggtacggctacctggagaggatccgtaacttgtccgtcgtctcggccgaggccggccggtggtggtggccatgctcgtcgtcgtcgacggcgagatccagctactacagcagcagcatgtcaagcagcgtgtccggtactggctctcagaatcaacggtacgtctcttactcttcgccgaggatggtaagactcgacgtccatggtcctcgagacattgcgaggcagatggtgcacgatgcatgggttcatggtgaacttgatcagagacttcgaccgggagcccgaccatgcgctggagaggtggttctccgagctcgacgtcggttgggtactccggtcggcggcggagaaggagctagccgccaagctcggcttggatgatcttgtgcagcggtggacgcgaggatatgccgtgatggtcgaagcactcgtagctacgcagcaaaatatgaaatttcaggatcataccaatatggagctagaagacgacctccgacctctccaagtcactcggttcgtggaggcgaccgtatccaagatgcttgcctttgctgatgccctcgccgctgataacacttggcggccaattgacaagctctcgcggtcgcggctcatgtgcctgtgcacctcgatcaacgagtgcggcatacgaatcttgtcagaaataatagtatttgagtttgattgcatattcagcaaaatgaatggtgctttctcagccatatacaggatggccaaggatgctgaagccatcacttgaaagaccaagaacgactatagagggggggggggtgaatatagcaattcaaaacttgtccccaaaaatactcatcaagccggatttctcaaaattcttactagaactgtggctattagagaagccggatctagaaaagaagagagatggaattcccgaaactagaagtgaggtgaggagaagatagcaaaacttgtcatcgcaaaattcaaatcgcaagcgaaatttaaattgcggaatttaaaaggcgaagacaaaacgaaatgcttcaaatcatttcattcatcagtgttgcaaaataacagctcaactaggagcaaacatacaccttcagaggaacattaacacaaacttaaaaatcactcggacaaacacactccaaactaatcctaatacaaaagcctctcgggcaaacacactccaaactcacaccgaaactctctcaccgagcatctcaaaaggattacaaaaggagcaacctccacccttgcatccacctctctatttatagcctaagaccccctaaaacattgtcacaaatgcccttagggcgaaatcctaactcacatgcaatctgggccatacgttgttccttacatcctaaggaagtagcctggatggaagccacgtcgcttgccacaccaggatcctcttttcacaaagaatccgcaccaaattcctcccatgtgcgtgcccgcgtgctcctcaacgtgagccccgtgatccgtgagaaggctcctccgagccaatcagcatgcaccgatcgggagatcgatccgcgtcgtctccgtcttgccgaatcaaaacttgccacgttgctcagtagtgctgtgcacgtcccgtctccttttcctcagcgcgcgcgcacgctcgcgcccagtccggagccgccacgtgtctcgccgagccgctccgcgcgtgctcgcgaaaaccgcgtgggtcccacgcccgtgcgcgccgaattgcttgccgccgcgtgtccactgtgcgcgcatgcctcgtgcaatctcccgcgcttgcccgcgcatggtgccgatgccgtgggccgtcgtcttgtcttgggcctgctcggcctggcctccctgccagctgatccatccatcatcttgagccacgaggaagggctagattggcttggcctccctgccaaccaatcacaacacacatgcacccatgggctagcaagctcctcatgcacacatgcatgtcttgagcccgtgcatggcattcggccatgtgcacgcatgcataaccgaagcaccactccccatgcttgcatatgcacatgccagtgcatgtatgcaagctcctcttctattctccattttcttcgcgaacccggcacttgcacttgaccttgcgaactccgttgcgaagacctcctcacacggtgtccgtccaccgtgtgcaaccttgtgtccaatcttgtcacccagcatccttgatcgctctggacctcaacttctccctgagtctagtcccgatccgccgttgaccaagatcgaccccgatcacctgcacacacatgaaccaaacaaccgttgtcttggcacatatgtcgcaacctgaccaatgttagtccacacacatacttcttgcacttccggtacttgtcaatttcccatcactaaagaactataaccacacatggtttcacaatctccccgttgatgagaacaatgacaatctcaagcaacattttgaaaatttaattttgattcacaaagcaaaccattttgcaaaagtcgaactttggtcattttgaaatcgcgaaaaatcaagaccaagtgacaagaagaaaagggatgcaaatgcaaatgcaaaaatgctcccccttgtgccaaaactccccctttcaccaagatctaaagcaagttttaattttcaataagtgcaaatttctctccctctttgtcaatgatgccatcaagatcaaaagagacaaaaatgagatgaaacttgcaaattttagtgttttgagagctttgagagttatctaaaggcatcaaaaggtagacatggatcacacagatataaacatgtgctcaagcctagctaagcatgtgcataagaagtatgaaacatgtcatggatatcaagatagtatcggcagcaagcaaaaagctttcaagtgaattagtaatttagtgtgcaaagctatttctagaagaagcttaaaaggaagcaaaccagctcataatcaagcaagatttacataaccaaagcaatgaacccatgctaatgtgctaatgcccagttcataaagagtatcaacatgataacaaaacatagaacatgagcttttaaacttttctcataacttttatttttatgtttttttaatttctttaaagacaatagcacaatcacgacggtccacctgatcttatcagtcagcaagtcatggttgtgccaaacactgccgtctgacctcaatcaagttttccagctagagttcccattacaggctgtctcagtgctatcttcggtactactcatgcgtaaacgcactcagtagcccgaacaaaaacagagataaagcttgtaaaacatgattgatacaaagtatgaacacataagcatgagcattcatgagcatgtactgacagttattgcaaaaagaatgtaaacatggcatgagtatgagatggatactttaacttaaacaaacttctagagcaaccattgcacattgattaagttcaaatgaatagtcaatttaagcaggtttcaacaagcttgaacagcataacatgatcacacaagctacttaagaaaatgaaagctagacaagagatcaaactagcataagagtgatacatgcatagcatagtgatgaccaagagataacaagcaaagctcaattgaagagtgtataatacaatgcataaagtaaacatgatgcaatatgttacaaatgcatgcaaaagaaaaacaattccccctcaaatcaagccataggggtggatcacccctaactcactccgcaagaactcaaaacgagagcgatcaagtggttttgtaaaaatgtctgccaattgtttttcagattcaacaaactctagcacaatggtacctttctcaacattgtctcggagaaagtggtaccgtatctcaatgtgctggtcctggagtgttgaactggattttttgcaatattgattgcacttgtattatcacaaagcagaggaacaccagagaaagacagaccataatctttcagagttaaaatcatccaaagaacttgactacatgcactagcagcagctacgtactcagcctcagctgttgattgagcaacagaagactgcttacgagaggaccaagaaatcaaagaagtgccaagaaaatgacaagtgccagaagtactttttcgatcaatcttacacccagcaaaatcagcatatgaaaaagctcgaactgaaagggcagaagagcaggagtaccaaataccgtactcaagtgtagacttgatgtagcggaagatgcgcggaagatgcgcttgactgcttggcgatgtgatgctcttggagaagcctgaaacctcgcgcataggcacacggagaagtggatgtctggccttgacgcggtcaggtagaggagggagccgatcatgcttctgtactcgcgttggtcaacttcttcaccgtcctcatcaggaccaagcgatgaagtagttgccatgggagtggcgattggcttgcagtcggccatgtcgaacttcttcaggagctctttggagtacttggtctgaggtacaaagattccttccttagtttgcttgatttgaagtccaaggaagaaagtcagctctcccatcatgctcatttcgaattccctactcatcacatcagaaaactgggcaacaagtgcacgagaagagccaccaaatatgatgtcatcaacatatatctggacaagaagaaaatcaatgccactatgaagagtaaagagagttttatcaatggcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaggttttttcaaaatccaagccctcaacttgggtgaaaccctgtgcaaccagtctggctttgtttcgaccaattgaaccatcttcacctattttgtttttgaaaacccattttgttccaatcacattaaaacccaagggtggttctaccaaagaccaacaaactttgtttctttcaaaattttctaactcttcatgcatggcattaacccaattctcatcagataaagcatggcaaacatttttgggctcaaaataggcaacaaatgctaaattgacaagttcataagaccgatttctagttaccctttcacccaggcctccgatcatcaagtctggcggatgtcggttctggatgtatcggggagctgtcggtcctgatgtgccaccatcaatctcctcagctgctgaagatgatgtagttggtgcatctcctgaaggcgatgtagtcgaaggagaaccggtttcttgcactggtggtgaactgtctagaggtggaggaatggaatcatcgtcatcttcatctgaatcatcttctacaaagatagtctcatctgaaacacctgaaatttccggtctagctcttgggctagcctcttcaaaagtgacttcacaagtctccacaattttgttagttgaaagaacatacactcgataagcccgagaatgagtagcatagccaagaaaaatgccatccacagatcgagattcaaacttgtccaaatttccaggtttaagaa

SEQ ID NO: 75226 - DNA, 1643 bp, Oryza sativa
ttgttgctcaagcatctgctccgatttcgcgactgtctccttgaactccttttcctgctctttcagctcatcaaactttttcttaagcgactgctcaaggccatggaaatggtcctcaagttgcttccactttaagttcaatgaaacagcactctggctctcaagctcggcaaatgcacgctgaagcagctgcagcttggagcctgtagactccataagggctgtcatggactccatgtcggacatggcggcagctcctgcaaatgagtaaacaacggaagctgttggttcgcgcaacccaaatagcactgcaaacaaatccccgcacagtacagcaaaaacttcatcgaaactacgcaatatctcactaaaatggttcggttaatttcttcctgcgcatggatgaaggaacattgaagggaattttatacgctattgcacacaaatcggagaacatagcaacatcatctacccatggacggatctaacgtgggacatggtatactgtgatgtaaatttttttgggggaacaaacaaactgttatttgtaaggtgatcaaaattgagagaaaagaagcttccagatctggaagagaagctagaattaacgcagggaaattcaaggaaaaaagtgggtgggtagagatgaacgagaaagaggatggatactcaccaggatgcggcggaagcagcaggacaaccgacggggatggagatcggcgcagggcagcggcggccgaactcgcgacacgggactccacctccacgcccagccgacgggatgggatggggacaccctcaggcgaggacacaatgattttggccagcagatatttcctcttttcttttttttttcactactgttcaatcgcctaatccctactacgtctctgtttctttccttatccctaagttataaaaaaataaaaacatttccgtccgaaatttccatacattttccgtatttgatttgattattggtcgacatttctgattcgaggtgagtctagaataaatattataccagcccaacctaaccagtccacaccatctcgtcacctcatcctcatcctcacccccacttggcgccgcactagcccctccctcgatcggcatctttttctctttccatttttcttttttctcccaatcatcctaattctcttccgatcctttcaatctcgtctattttctcatttttcttttctcttccgaatttctcttctcataaatatttttcttttgaaattataattgttaaggtgtgtatgcggcaagtttattactttgcaaatactttccatttacagtaaaataatttcactaattgaataatcaaaattacaatcttcggtcaatgaggtatagcaaaatacacgtgtcaaataatagaatagccacccgatcaatttgtgaggccttaaaatttgcggaaagtgtacatgaaggatccttcatatgatgatgcatgaagctagtgtgctcaatacttatatatgatttctgactttgttttgccatggttttgtttgtcttgtttcggtttgtcgtttaaattggtagagtttttatcaatcgtgaaattgtctttacctgttgtaacgcacatgcatctttgttgctccctccgtataagatgtttt

SEQ ID NO: 75227 - DNA, 1318 bp, Oryza sativa
attcaacgggccaaatcttcttgtccatttggaagcctacaaggtgggaatttatggccaatccgcacagaatcgtgaggtcaagaaaatttcctctagctcgatacattgcgccaccgcttctccatctcgcgattgcgagcagacgatgccaccgagcctcctccagcgagatgctctcaccggtcctccttattcggtctacccctaccgctctatccctctctccttagatcttgggtatgcccttcttctttcccctcttctcctagagtttccgggtttcctatttgacaaagttggtgatgagccgctctgtcctaaagtgaacaagagttatgttatggttggcatgtctctatcttaagaggatttttccattggaatgggttagtttatctcttagatttagggtattttatataaatagatggccatattgaaagggtcttgagaatcgttaattttgcctagaggaggggtgaacgggtgctttgtgatatttcaaaacttgcagcgagattagaactaactagacaaaccgacacaacttccggtagtccaactatagatgagttggatagttcgactgctgtaggacaatccgattagtgcaacgataggaaaaatgataggttttgggaactccgattgtccaattgctgcaggacaatctggttaacacaaggatagaaacttaagtgatatagtaagaaacaaactagaaggtccacttaagcatgctttctacaagggcaagtgttgacggtcattatcgatcagttgcgaccgtcaatattaccaaaatagaggagaactagttatgcttgcaatacatatacaagttagaataataatattccactagtattgggtgtactaaccttttgcagagaataaccataaagtggaggagaatcgacatcagcacatacgataaatcaatcggacgatgtcgagaatcaaacttatgcatgaatgggccaagaactcagaattgacataatgaattgggccaaaattcacaagtctaagaagtgaagtaatggaggaggccacctaccgaattcggccgaaccccctagcaccgttggatgcagggtttcttctggatggcgtggatcactccccaatgacggttggagagcaattctgaccattccaactgccaccgaccatccccaaggagttcactctcttcacttcaacacacacctcaagcaagagctctctcatattctctcaagttagtttagtattcttaagctagtggaataggaatatagtagaaattaggtatggctctagtggctttcct

SEQ ID NO: 75228 - DNA, 654 bp, Oryza sativa
tatgcagcaagacctggtatactaccaccatttaggggtgttcgataccacctgaaagagtacgaaggcgggaaatcaccagaaacacctcaagaattattcaatcttcgacattcctcccttcgcacatctgttgagagagcatttggaaccttaaaaaaccgtttcaaagttcttgctagcaagcctttctttccatataaagtccaagtgaagatagtaatagcgtgttgtgtactgcataattggatccttgataatggtcctgataacatcatatatgatgaagctcgttggtatagtaagctacctagatcagctagagtagcgacagattatggcgaggagcaccaacagtgggtagaatttcgagaaaatctagctaatattatgtgggaggaacattaacagtggtgttgtatggcatggatattgttctatgactgttagctatttctaatgaattcttctttcagctcttcatattatagcattttctactttatgtttttttgttggatgccattattacctactgtgcattgctttgtagttcataacatggatataggaggaagcaacaaacatggcaagggaaaaagtaaggcacgcaaaggagttgggggatcaggtgtgaggtcaaaacccataaat

SEQ ID NO: 75229 - DNA, 987 bp, Oryza sativa
gcgttatatttttcatcaaaaatagtcggtatgtatttatattgtaagttcctaaattacatatttaattttagtgtatttataatgtagctctcatatttatatacataagtcgcaaaattacatatgtaagtcccaaataaatttacatatgtaatcagtatgtaattatagtgtaagtacgatgtaattagtatgaataatttatccactagtgatatagtttaatctccaagtataaaagcaaatactagcacaaatcttgaagataatctgttgagttgtgatacaaattcatttgcacttaataaatgctagcttctaccgtagtaaagcggaggcccgtcgccgggaggcttgggccggagcgtagcggacgaaatgacagtgggcttgctttccgttcccctattcctaatttgaagagctaatttgcgggattaacaagaggatggtagtggacgttcgacgcctcaagtcctcaacgcccgcatggattcaatgcaagtaacaaaaatggggtcctcctatctgttggactgggggccatatgtcatacaattagtgatatacctggcgccagtaatttttgagtggggtccagggcccccacaccttgtatggtaaatccgcccatgcgcacaaccattgctagtggactagattgctttctgtcgcctacgtataatatccttttaggtggccatcataacctagccgttgcgaaaacattcttcattagtgactgctttacgacaaccgccaacgaatatattgcattttctgtgaccttcggtcgctggcgtatgagattctcgccacttaaaacatgaaatggatgccaaggattaacggttatcctttttatagtagtgaaatgtagcctctactctatacaaactgtagagaatagcgtggattgagagcaaagtgtattttttttgaattgagagcaaagtgtataggggttatataatagagataatt

SEQ ID NO: 75230 - DNA, 20774 bp, Oryza sativa
  unsure (1)..(20774): unsure at all n locations
ccgggactaaagatcccgggggggcctgacagggcctgacagcattcgaaccgatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtgatattaccaaatttggttgttaacacaaccaaacagaataattaatagcatcatccctctaaactctcaatctctcctaaaaactcccccaaccaaatgacccgagaggggttgctgaatttttttatatataatagtccctccgtcacagaatatagacagttttagagttggacacggttattaaaaaaatagatagcattaaatagaaagagattgtgattggttgagcagtggaggtaggtgggaaaagtgaagggttgtgattggttaggaaggaaatgctgatgaagaagttatattttgggacaaatcctaagagcatgtacaatagcaggctataagtcaactataaacatattttaaagagataaaggaagagagagaaaagtagcgggctacagatctgtagccagctgcagcacggactacaagacataatgtgtgtatgacaggtgggaccaggtattaatagtatagtaagcaactattgtatgaattggctgttacattggctatagatgattttgagctaacggtgggctatactattaaaattgctctaagtgctaaaaattgttatattttgggacgaggagtaattaactagcataatgcctgtgggttgcaacggtttctaaataatatttattgacataaattaaaatccaaaatcatatattatagttgggataaacgacgaaggaaatacaaacatacaaataacttttgtccggaacgataattcaatatcatgaaaattacataacttaatccctattttttcatttacctataaagaattcaatacaaagaaaaatataaattatgataatttttaatggatcaaatagtgctaaaactaatactgtgaaaaaacaacttaaattagttagaaattgaaaaaacttattttagcccacaaatgaaaaatccaatacattaattctaaaacggtgcatgtttcattgacataaattagaattttattgttctattcatagtcctatggtctgtgagtgttccatgagcatctttgggctagaccaagaaggaattgtgtcaaaaaaaaacattgttcattgccttccctagctgaagacgagaaacaaaagaggaggggaaatgggtgtcggtgctcctatgaccaaacagtggcgaggaagatggtaggatgtgtctcacgatgtgactcgtccatagatggtggtggtcggcaatgaagaaaaccaaaacagcaggaattgggcaagcaatgtcatggtcttggtagagggagaaacgataatgacgagctctggtggcgaacacgaccggataagtgcgtcaaaacacattcctgaacgagaggattctgttttccttgaactcgcggaaagaatgaaagatggagatgtgtattggtcgctaaggtacaacgtaacgtcttgtacggttgtagtcgggtcatcaacgtttcttctaaatcgtagttatctaaactcatcgaaagattgggccaacaacagtcttgagtgtcgagtggaactcagggttcatcagtgccatgagggagagagggaggcgggagaggagaggcgcaagggagaagagggccgcgagggtgggggagcgtgcagcaacgaagagatgggggcgtcggaaggaagggagagaggcggaagcggagatgcatgggagggctggcggcgtgggggcagggggggtggggggacggactaaagcggagggaggaagccttccgtattttttaattaggtatatagataaccatgaaattgtttcctatatataataattaataaccatgaaattaaatcattagtaattcattggcattatttagcaaaatagtaaggacgctatttggaagatcgtccaggtgtggtcactgttacgagcagcgtctgggtatagacgtagcaaaacggcgtccaccaggcaaatgctgcccgataagctcccgcccaacttagaaggtttctaggtttctcgacaaaaggataccagcgctgctctgctttcttttcctcaattgttgcagcggtgtagccgcgattgcctgttgtagcggcgaagcttgatgtcgtcttggttgcttgttagctgcgctgcggcggagtagcctcctccagagtttgtaaactccacaccacctcttctatttgcggcgcgcaccatccaccccggtcgatgtttgactccaaaccacgaggcgaggtgacgtcgtctagctccacgactccacacgcaggtagacaaggtcgcctttgaccggccgcctccacagaatttgcaccacagcccacaaggctatggccaaagcctctgcctactatggatccttttttttttgggaaaattggaactatgccattataattttgcaaaatttgagatatgccatcctgacccacatgtcattgactcatgtgggtcctacatgttattgagataccgatggcatatctcaaacttgcaaaattataatggcatggttctaaattacccgttttttttctagttctatgggtccacatgtcaaagaatttaatgtcatctgacttaaggaagaggatctcaatccaaaagagagtggccccagaccatgcacgcggcatgattccttcacttattttttagataatggaatagataacatcccggcctttgctaaacagagctgcagccaattattacaatctaacactcgaacaagagtgtagttcaaatagaattaaacacacctaaacattataaaagtgaccagaccaagataaggaatacacaattattcaagtctatttttaaacctccatccatggttggtaaaaagttgcataaccgtcgtctcaatccaaaagagagtggccccacaccatacatgcggcctgattccttcacacgtgacgagtaggggttgggcacaaatttccccaaaaatcagccatagaaccaaacaagcattcactcctggggaagggagctttactcccggttgccaacccttcgtagtcctagttgaaataagcgggactaaagatgcataccacgtcaaaaaaacgcgtcggatgtgggattcaaactcaagatctctccctcaaccctcacgcgtgttacgaaaacggtatgaaaatttcccgacggtattgataccgtttccacaaaactaatataataatactatttttaccgatggttaccgttttcaaaatttagttttttttaatttctgtcagcatggcattgaagttgacactaaggccttgtttgtttcagcttaaagattattgtaatctagattattaaattagattactctaagctgaattataataatgacataaaataagctacgagttgtttatttctctggattattagagccatccaagggtagtaggtctttagccactcaatatttgaaaaaaagctctctagagaggattaatggattatagtaatccgggcttatagattataatattctagcataataatctacttgtttgtttcagcttactcntataatctagattataataatcctaagctgaatcaaacagggtctaaatagatgaattcataaatatggaaatttttcgaccgtttccgttcgttttcgaaaaataataaaataatgataccgtttccgaccgttttcatctctagtatacacatctgacttggatagagatgctttatttttaaactaaccctggaggcatctttactccgggttggtaacaccaagtggagctaaaaatatctttagtctgggttggtttatgaaccgggactaatgatcaatgtttagtccggattggtgttaccagccaggatgaaagatcctcctattttagtctgggttggtaacagcaactgggactaaagtgatgatctttagtccttgttgggggcctgacacggcctgacaattattgaaccgtggctaaaaatgatcttaaatcccagttagtgttcgaaccgggataactgtgatttttgtcgtggctaaagatattctttagtctcggatcctattcgaacttgggcaactgtgatttttgccgtccaagcaaagattagtgttgatatttcttaaacggcattactagaaatataattcccagcaatgacgaagaaatattcatggtatatttatggtcacaaatatgatccgtaagcgcacggatataccattttagcatttcaccccggagtattccaagtatcatatttgtttaatcccaagggaagatatgataagagagtactatgctaatagtttatatattacttgtatacatcaaggtctatgttggggttaagtaatttaaagggtaggtgacacacagaagaaagaactatgatactctcgctaaatataatctaagctaagtggaggaagaataagaaaagaattcattcttgtacttctaatatacaaacatctttagtctaccacttgttagtatacagtcgtacaaccaatactccctaatagtgccctcctggtgtttcgagagaccaccctgtattgtcgagttccttacgacaacctgtcatggccgtctaaccggggctaaatacggaggagtatcctccccaggaatttgtcttaggaatatatactaacatggaggaatacatgtactgagttgtcaccatcagcggcccacctctactgtcccgcagcatatatgcccagatagtgatacttaataatttagacaccacatctacattattaaatactactatatatcccccgagatgacatagatcaactgagtaatcggacactaaacccacaccattgcacctctctggtaggctagctacacaactatattgatacaagtataaaatgaagccggcactcagataatataaatggaataaaataccgaagatgtataaagaagaatattctattaattccataagtcttacaaaagaagagaggaaagctactagagacataccaaaattctcctgaagacccgaggactaagaatacttttataatttctactccactagcactaggatactactaaacttgagagagggagagagctcttcttcttgagtgtgtgcagagagtgaggatgtgaggtccttacatagggcagttatgacggttaggtgatgcaaaatgttcattctgccctccaactgtcgttgagggaggcatcctggacatccacaccccaaaacctgggatcaacggcggagatggggaggctggcccaaacagcccaattttcggcaggccgtctccctgttgtctcgtcagtccagaaggcctagtggatcgtgtgaattctgtgttctttgcgcattcatccataagtctggatctcgacagcgtatgattgattgaccatttactttctgtcgattcttctccatttatatgtgcttctcctacatctatgttagtagtatagtatatagtggaagttgatattttatttgcaaattatgcattgcaagcatagctagtctttattaattgagtaatattgatggtcgaaattggtcgataacgaccgtcaacaatcagttctctagtagtgattcttttcggtgttcgcctgcacgcagtaagctcgggttatcttttgggtattactttctccgtccaagaaaaatattaatcctatctatcaatccgaatgcatgcgtatctaggtcggtagttaggattaagtttttttttataggatggaaggtgtagatcagtgtttggcaatcagctcggtttttgtttcttgttgttttaacactttttctgttactagctaattaaatgaggatagtgttggagacctaatgaaggccgacgggttaggggtgaagaagggatactgtcacataagatttatccgtgtactccctccatgctaaaataagttaatgtaggtgtgttaacttattttgcacagaaaattccctgtgtacccctgaaagttcgcccaatcccttctatgcctctgagatttgctcattctctttcatacccctaaatttcagtttgaatcccttctataccccttttgttagttgaccattaaattcctatcataaagttcattttgccctttggtattattggtatttcttaacgacattactagaaatattcattcctagcaatgacgcagaaatggtcctggtatattttctggttacagatgttatccacaagcgcaccgatataccattgtagtatttcacccaaaaatattccaaggtatcgtatttttgatcccaagggaagataatatgagtagactatgctaatactctttatacatatattacttgtatttatcaaagtctaagcaggggttaagtttaatatacgggcacagtgacacgaagctaagctatagtttaacatctaccctatagttgaacaaatggttttactcattacacattcatcatgtcacacatccaacagcctaaaatcatctgagttacatccaacgtctcccagatcgcgccctccctcccagatccctccctctctcgcgcacctccctctcccttctacaactgccgcatccccccaacgcatcgccccacaaatcacgccgccgtcgccaccccttcctttccaatagcattccctttgcctcgccatcctgctgctcgtgcccctccgcccatcacactgatccgcaccggagtcgcagtcgccacccccgagcctctgcccatcgcatcgatccccgccgtccctccacccattgcacctatccgtgccgccaccgatgacgatctcgtccgcaccgcccctccgcccatcgcaccgatccgcgctgccaggccagtttgccctcgccgcccccgatgtacgccagggcgcccgcctccacgcccccatatcaccgtcggccggagtcgccgggctcgtcctcaccaagccgatcccctccgccaccgatagaaggtacaaaaatcctcctcccctaccagatgatttgtcttgctttgtattaatgggtgcatggactggtggtggtgcggctgtcaggctcttctattagttgcttgcaaatcagctattaagtttgaagatgtacacattttgtgattagtctcttgtgattaagagaaaattatggtgatttgccactgacactttaacagaaaattatggaggggattcttttgcagtaccagtgacatgagaaacttcagttggttcatgagatggagctgcctgactcccttctgctgggctggttttgaccctgaacctgttgtttctctgaaaaatgtgtcattttatttttagaatgaggggttgccatatttgcttgttatgccgatgtggacaagcttgtcctgttttatgcacaggaattattggtttatatactaagagcaaaattaaaatattttctacaattatatatacatagagaggctcgatttatgggcacaaacgtcctaataggtcaatttaatctctttttgggttaagcaagaactttgtattgatgggtgcatggactggtggtggtgcagccgtcagctcgctctgaactctgaggtggtttgtttttttttctcaggcgcttgcaacactacatcatttccagaacgccttcaccaaaattcactgcatgcaatcaggcgcaagggttgtgttagtgatatgccctaggggcaatcatagagatgattgtattacatactatgtttacatatttatccaactttgttccttgaaatagataactcattattagttaatgaatatgtgattctttcatgagactctttatgttgtttgttactatttctaaaagatccctgatcaaacatcatatatggaacaaatatggttaaatgatcagcacatatattaattgatgatcatgtctcatagatcatagtatctttactacttaaaaaatacgtggtggtgttggtgagtcctgtataatccaagggccgatattcctcgcaggatcctcccacagatcgaagggatcaaataacctcctgctgtcccgcaccacccccacctccgtatcgcactgtcctcacactgccccctccatcgcacgcccccgtcactcctccttcgtaccgccttcgccgctttcccagcgccgccgtcgcgccctcggcggctcctccgccgcgctgccgccacatcagtcgcgaccccggcagctcctccgccgcactgccgccacctcggtcgtgaaccccggcgcctcatccgccgcgctgctgccacctccgtcgtgaaccccggcgcctactccattgcctcatagcccctctcctcctccaaccctacggctttctcctccgtccggtgcaccgcctcttccatccccatatcctattcctacttcatctctccctaccgctgtcactgctcaaaccctaagatccgaagggagggaagagaacctaagatcggaaggggagggaagagaagagcgcataggcggtggcaacggcaacctcagcaggcatgctgtcgacttccatcatccctgtcatcctccaggtaattgattctatttttatttgatttgttggattgtctgtagaagatcgagctgctgctaactcaggatacatacacaaaaaaaacttatgccccaatcaagcatttgggtgcttggctgctattgtgctattgacggaattgaccattcttttttctcgctttgctgttcaaggatccaaacatatgttgatgaaaccggcatcacaggccaagcccaaggcaacagtggggtttgaacttcgaagacgatttaatccctgtctttggtgaaaacacaaatcatcatgattcaccatggtattaggaggtcttgattctgaaatttccaattttgcttttgttactactttatttacatagtttctgtgtagcttaccttatcgttgttaagtatggttgaactagccattttagatgctaaaattctagaagttggaggcttatccatgcagttttagatttggttggatggaatttggattcttcgaacattcttaaactatggctctttttccattaaaactttacattttccatattgtcttcgactgcttgtagacgaacaactacaggggaatatctcatgcttttatggaaccagctaatgtgagagtatcaaggggagtcttggccgaatccgttgctcatggctggtaggagtgaggagtacataggattccacactacgaggtaatctacatgcatgattcatgtgcctgttggtctctttgtctaaaatgatagttcattttggtataccacctgttggaataaatgggctaagcccaatttaattcaattaaaatctcaagaacccacaagtaatgttagagagaataatactaccttgaaaaattaggtgaaagaacctcaacttaaatatggtgatattggagattccctgttgaccggttgaggtgatggttggactgccacacacatgcgcgcgcgccgagtcggcctcggccgtaggcgtagcgaggcgaggcggccgaccgagccgagcctgcctgctgctcttccgttttgtaacagatgagaataaagtcaccattaacaaatgaaattcattgtgttgtagcctccacaacaaatgagagattcattgtgttgtaacctccacaacaaatgagagattcattgtgttgtaacatccacaacaaatgagatttatttgtgtggtaatggagatctctctctctatatatataaggatgtgactacacagctagtggtagctgtattgtctaaaccagctgagaccctatccacctatgcttcaaataaaaatttatcttaaactacttatccgatctacgatccgattacaccgttgtgttcgtaacaattaaatctttataacaagatctcacatgattatattttgatgaaaaaacataaattacttttatagtatatctaaattacttttaaatttcactaaattacttcttagacatataaaaataaattcaataaaacctaaaattaatttgcatatattatagaagtaacttataacaaaaaagagtgtaactttaatgtatgtcttttttcattggacgtgactacacagctagtggtagctggtttgtactccatctagtctctcctttgaacttgaaaaatgcaatagtatgtatccttttttaatctctttaataacttatatcttttaaaaaaggtacactgtgggcaaatgtctggtagtattcatttcaaaaaaaagcttatatcttttagatcacatattacttctaatgtcgtgacaaagttacttccattttgttttaagttacttttataatatatgtaaattacttttagaccttattgaatttacttttatatgactaagaaataatttagtcatatctaaaagtaacttatatatatatgataaaagtaacttacatatataataaaagtaatttataaatataaatattttttcatcgtaatataatcatgtaagatcttgttgtgaagatttaattgtaacgaacacaatggtgtaatcggattatagatcggataagtaatttaagagaaaactttatttgaataggaaaaagatatacatgtctattgagaaacaaggcacacactgtgtcaatccttctcattgtgccattacagcgcggccacgtggatggacgataggcgcgatcgatcggctatgagatgcgtcgcgtgatacgactaaagcgagaagcctctcagtttagattttacgtatatataacgcaaggcagaggctctcaaagtgtgtgtcttcctcctgcattgttccttggcgatactctccttctgttcctgcgctgtctctctgtttccccggttctgttcatcccgcgcacatgggtgattggaacgagcaggtgcctccgaaactccgtccgcttgagaacctgcacgggtaggcgggcgatcaagtttttgagtagcgcttcaagcgcgactactctgcatcatcttcaccaacatgtcgacaaccggcgacaacaacaacactagagacaaggaggagcctcccgtcaacaccaacggaggcaatactgtctcaaactccagcggagggccattttcggggtataacgtttcactcttaccgttcgttcttcgtttcctacaactgtcggtcgcaatattattgcgttctcttgtctatgttgatgcttattctatattaagcacactcaagttgtatacatctagcactgtcactagatctactcatattgcaaatgtcatgtttattgtcttaatattttggattaaaatatgtcgaattatgaccaaatttccaacaatccaaaaacttgataggtctttttcggtagttggctttgctgcatcactaaaaccacatgctttcgatggttcaaattataaaagatggaaagcacgtgcacttttgtggttgacggcgatgcaatgtttctttgcttcacgaggcaaaccgagtgaaccgcctctctccctgaggaggaggctaagttcgaggctgcggattgcttgttccgtggagcattgatcagtgtgcacgccgacagtattgtggacgtttatatgcacatgccttcagggaaggacatgtgggattctcttgaggccaagttcggggtttccgacgccgacagcgagctgtatgtcatggagcagttctatgactacaacatggtcgatgaccgttctgtagtggaacatgctcatgaaattcagatgctggcaaaggaacttgagaacaacaactgcgagttgccggacaagtttgtggcgggtggcattattgccaaattgccaccttcttggtcagactttggtacttctctaaaacacaagaggcaagagttcagcgttactgatctcattggctctttgggtgttgaggagaagacgagggcaaaggacaaccgggacaaaaagatcgagggaggttctagcgctaatttggtacagaagaagaaccctcacgcatcccacaacaagaacaagaaagtcaaacctgacgtcaaacccaaggctacaatcaattttaagaataaagacaagggaaaggcaaaaggagattgctttgtgtgtggcaagcctaggcattgggccaaggactgtcctgagtgcatggacaagaagtctgcaaacatggttattagtgagggcggaggaacatcggggtatggtaaattttatctacagttctctctgtctgtcactcccctgattggtgggttgatactggtgctaatattcatgtgtgtgctgacatttccctgttttcttcttatcaggtcgggagaggttcctccttgttgatgggaaacggatcgtttgcggttgttcatggtgtaggtacgatcgatctgaagtttacttcgggaaagatcgtgcagctgaagaacgtgcagcatgtcccttcaataaagaagaatctagttagcggctctctactgtgtagagatggttttagacttgtgtttgaatccaataaatgtgtcgtatctaaatatggcacgtttattggaaaaggttatgacagcggaggcttgttccgctttatcttggatgatatgtgtaataaagttgtgaaccatgtaagcgatgatgatgatgagtccaatgtgtggcattcgcgactttgtcatgtgaactttggttgtatgacacgcttagccaacatgagtttaattccaaaattcactttagtcaaaggctctaagtgccatacttgtgttcaatcgaaacaacctcgcaagcctcacaaggcatctgaggtgaggaatttggtaccactagaacttgttcattccgatctgtgcgaaatgaacaacgtgttgactaagggggaaagaaatatttcatgacactgatatatgattgcactagattctgctatgtgtacctattgaaaacaaaggacgaagcattacattactttaagatctataaggctgaggtagaaaaccaactagaaaggaaaatcaaacggttgaggtctggtaggggtggagagtatttttccaatgagtttacttctttatgcgaagagtatggaattattcatgagaggacgcctccctattcaccccagtcaaacggggtagccgaaaagaagaaccgcactctaactgaaatggtgaatgccatgttagacactgcaagactttccaaggaatggtggggtgaggcaatattgactgcgtgtcatgtcctgaatagaattcctactatgcataaagaactaacaccattcgaggaatgggaaaggaagaaattaaatctccctcacctgcgcacatggggctgtttggccaaggtaaatgtatctatagccaaaaagcgtaaacttggaccaaagaccgtagattgtgtgttccttggttatgctatccatagtgtgggatataggttcttaacagtaaattctggagtacccgacatgcgtgttggtataattactgagtccagagatgccacattttttgagaatgaatttcctatgaaaaatgcacctagcacttctagtcaagaacctattttatcccctgagcactttgtgccgatagaacacattgatcaaatgcttgaggaaaattctgaggaggataacattgtagcaactcaaaagagtaagagacaaaggactgcaaagtcttttggagatgactacgttgtatatcttgtggatgatactccaagaaccattgaagaggcatattcatctcctgacactgactattggaaggaagcggtatgaagtgagatggactcaattatgtctaatggtacttgggaagtcatcgagcattcatatcggtgcaagcctgtaggatgcaaatgagttttcaagaaaaagcttaggcctgatggtacaattgaaaagtacaaggcaaggcttgtggccaagggttgttgtcacaccctgaagttttcccccttttgcttgctttaaaaattggttaaataaattgcttgaagaaattatcttaattaacctagagctaaatccctagttaataaatgcacttaataatcggaaatagtgtggtggaatttttcttgagttccccatgctccaatgcattaacaggatttttagtggaattttcagagccttggaaataattttaaccaattaaaaatcactaaagtgcaattttaaatcccaggaaaaatcctttcttctttttcttttttttcttttccctccttttcctttcttgggccgtcggcccatccctctcccgctcggccttcctcttgttgggccggcccatgcgcccctccctcctctctctgggatgccgacaggtgggccccacctgtcggtcgtctcccacctccagccgttggagctggagctctaactgctgccgtcgaaaccgcccatgccgccgccgccgtttcccgccgttctccacgccccactccgcccgtgccgcgcgcccacgtcgccgccccactcctccgcccttcccgcccgcgcgcatgcacgaagtgggcgggattcattttgaatcccacctcaccgtctctctctcctccccatgtcgccggcggtttcggccatctccccggccacgtccgcccctctctcgcccataaaaaccctcccccgagtcccctccctcgtttcccccatttgccgtcctctcccacgccccctaccgcgcccgcgccgtcacacccgagctccgccgcttgccgccgccttcggccatgagccgccgccgctagagtcgccgccgcgccaaaccgccgccgccgttagcttcgccgccgcaagagctttcccggccgccgcctcgcgtcgccggaatcccactggagcgcctctcccctcgcgagccggtgagtttttccctcccctccatctccggccggcaattcaagctgccgtggtcgtcgtctcctctcctaacgcctctccatcttctcctagggtgtcgccgccgcccgtccgtgcctccgcgtcgccggtcatcgccgccgtcttcatccttcgcgccggccgccgtgctcacagtgaggagctcctctcctccctccttccctctgtcccgcacgcgctgccgctccctgcgctcgccatcgccttcgtccgccgccgccggtctgtgcgccgcccgccgccgcctcccacgccgctggttgccgtcaccggcgaccgcatgccgccgccgttcgccatgcttgccggccggcttgaagccgaggccgagcccggtggctgctcccttcaccgtccgatcggcttgggccgatccggacccttggtcccgtggaccggccgccttgagccgctgacatgcgggccccgcttgccggcgcccccttcctctcccctttaagccgctgacccgtgggccccacctgtcggcgccgccccccccttcgctgacgtcagccctgggctttattgcgcaataattaattaaggactttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgcgtgctttgtttgtcgcgtaggtttcggccgtttcgtcgatccgcggtctctcgaagacgttgctgaggtctcatcagttcgagagcaaggcaagtcatgcaatacgtttgatcatattgtacccaatttacaaatatcccgcatttctatgtaatgttgcattcttttacaatgtaatgtgggatgggtcctattcctcagccacatattggttaccctatgccattaataacttgggtatcaaaatgactagatgttggctaaggaaatgcttagccatgcttagttcaactagtacacaaatggggatcacattattacatagactttgtcttttggcatagctttagattggtgccaccgcaatggtattagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgtggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttcggcctgttgcaacgtggtgtagcgttggacagtgattggttaatattgattaattactacaactgttttactgccttcaactactacttttgaatgctagctttatgcaaaagaacctctagcctcctttggttatatcctgcatcatacctcctcttccggtatgacttgctgagtacagtgggtagtactcagtcttgctctcttttcccccacaccagagttgaagttcttctcagttggagccgtctcagagaggttggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatctgtatgtcaacaattatcgtttgtgtaccctggctggtcctggacaggggtttaatacacattcagcttagaaattctggttcgtgaatttctgggcgtgacaagttggtatcagagccgaccttgaccgtaggacaagccaactggaaacctaagagccctctgaacccctttttttttcatatgcatatgcccttttgcgcttggatttgtttcaggaaaatttggggttttgcctctttggcttgtgggaaaaatcttggtcgttcattcggatcggttttttttagctcagtgtagggttttagaaaaaaaaatctatttggggtttattcgacggtcagtcgggaatttgtcaggtgatatgcactaagtcgtgtctaggttgatgggggcaatttcatgcgtatcattatagctatgcatttattttatgcattaatttattgattagccagttgcatcagtatcctcatttgagttcatgaaaaatgttctatgcataaaaatcatcatgctcgagtatttatttgagtcatttgttgctttgtttaatttggatttgagcatgaattggttcctatcccttgtctactttagatgtcagtcctattcctcgatcgcaagcgccgctccgagcttcagagtcgccgcccttagctttattgccttcttagtctgtttgcttgctagttttctgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctatccccttcagatggagacaaggaatggttcacgcgactccaacaatgccagtggcagcgaagagccgatcgatggagcacgtgccaacggtgcatctgacaacaatccgtccccaccgcctaagaacccaacaattgctcaggtgttggacaatcagactcagatgatgacaatgatgatgcaacagatgcagcaacagtaccatcaggtgttgcaacaggtgcagcagcaagcacagcagcagcaacagaacctgcagtttggtcctccacctcctcagtccaaactattagaatttcttcgtgtcaagccgcccactttctcaagcaccaccaacccaatcgaggcccatgactggcttcatgccattgagaagaagctgaatcttttgcaatgcaatgagcaggagaaggttgcttttgctacacaccagctacaaggtcccgcttctatttggtgggacaactacatggtgacccgtccaactggggcagaagttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccaagaggcaggagaagtttctgtctggtcttgatgatgaattgattaaccagttgatctctagagattatgaggactttgagaagctggtggataaggctatccgtcaggaggagcactgtaacaaagtaaaccgtaagaggaaggcagctcagttcaggactccccaggggaagagtcagaagcctcgttccacgatgggacatcacggtggaccttccaccatgattatccggcagtaccgtccctaccacccgggtagcttcaacaagaaccaccatagtggcagtcacaacaaccgtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgctcgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttgacaagacacagaggagtgattgattgcgccagccgcaccatcaagttgaccaatgcaaaaggagaggtggtaaccttccagtctccagtgccgcagaagtcagggatcagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccaacgagttggcggaagtcaagaagcaagtcgatgaacagttacagaagggatacatccgcccgagcacatcgccttggggtgctccggttatctttgtggagaagaaagacaaaaccaagaggatgtgcgttgactaccgcgcactcaatgaggtcaccatcaagaacaaatatcctttgccaaggattgatgatctgtttgatcagttgaaaggagctactgtgttctctaagatagacctgcgatcagactatcaccagttgaggatccgcgaggaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaagttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtccgcaccagtcttaatcctgcctgatcagacgaaagatttccaggtctattgtgatgcatctcgccaggggct

SEQ ID NO: 75231 - DNA, 9004 bp, Oryza sativa
aaaaatattttttaaatgatggtctaaaacaaaatattaataataaaaaagtgaggccgaaagtaaaatttactctttcttttactatatattcccaagagcttccacttcccacctatagtattcaaagtaaaaaaaaaaacttcttacgtgctggtcaaccaatccatatagagaggagcgcgagatattgatatagtaaaaaaattactagcacgctaggccaaatgcgctacgtgactagatgacacttagtgtgctgtatttgtctgtatatacttcatatacattcgtataaactttatatatgcatacaaatatatgtatagagaactaaggggccctaattaaccgtgcgcagtggctcaacattgaatttaggtggtgcacaggaaccccttaaactcataattccacacttaaaaacactaaaatatacagttttgcatagaatatttttatattttcagtggtactacaccactcttgttttgacgctagctccgctctaactgcgcatgcgcagatgcagccccgtgcgactggtcactggtgatcacccattagcaccaccacctctggttgccctatattacttgttctttttattatctttaatgtttgcctcgagataatgatgttaacagactcttttttaaaaatattccttcagcagataattatgcaatttaagtactatttccatgattttttcctgagctttttacattttccttttaaatttgaagtcagatgaaatttatcaaaacataccgccggttacccttaacggacccccacggtaattgaggtaaccagccagcggtattgcaaaccctcttgatacatccatctctcgaccgttagatcaacattgaacgactcacgccacctcacacacattgcgcttctttcctcacacgggtgcgccgctgcacggagggtggaattaggtgggactactaactacaaggaccgcatcacaagacaacacggcatgcattaatctcctctacgaaatgtaagtcctttaacattttgtgcaagcttcaagaaagtagcttaaatgactaaggtgtgtacgaatggacaatctggttggtattttcagagaacagaaaacgaaaaaaaaatcatcagcgcttagttaaataagtattaattattataaacttaaaaaaaaagtttacttgattctttttgaatttttttttcgaaaaaacaaactgtttagcaacttggaaaatgtgctaacaaaaaataaaaattataattacaaaaggagcttaattgacccttttcccgattatgcgcagaacatgcacacgcacctcatttatagacccatggacccacaaatgtatctcttaatacaaactcaaagagacctaacttgactaaattcttactatatatatatccacttgtatttattatactgtgttgcaaaagatcacacatttatttggcatgagtgaacataactgaaagaatgcataggtattctagaatgacttatatgtaaaaggcattcatttaagtgtaaaaaatgaaatgacaaatgattttgcattaaaaagaacaatatttgatgcagagacctgttcttatctacactttactaacttctctattccttgtttcatgtgcacgcttttcaaactgttaaatagttttttttaaaaaagaaaatctatagaaagattgcttttaaaaaaacatattaatcctttttattttttagttaatactaaattagtaaagtgctaatgatccactttgttatacgtgtgagaggaaaattgtgttcccattcgtgcaccttcaaatagaaccctagttgggcacttgggcaaaaacgctatgctatctggcttgctcttaaggcaatgctttttttttttcttatcaaatggagctacttgttcgcttactgtgaacaaactttctaaaatatttaacatggtatatttttttttgcaaaatatagatatttctttagaaaatcaaataattttatttttcaagtttacagtagctaatttttaattaatcatacattaattatcttgattattttgcgggtggcttctaaacttacatcgtttgtccaaaaaaaaatgaaactgttgcacaacggtctaaaatgaatttagacaagaggtggagtccagattcatagtaatagaaaatattgtatctcatataaattttgtttattttaggacggagagagtaagctaaataatttttttaaacttctttaatttttagttttaagaataaactttcttatacttatttttaatatctgaacattttgatcagactgtcgtggcaaaataatactgccacactgatctaaatagcatgtcaacgttatttagtcatgctggtctggtgggcgtggcagcgttgtcctaccacgccaccgtggctaatgtggtcggacacaaaattgtcacgttgtgggtggcgtgacagtgtcacgccagacatcctagcatgcataaaagattcggatttggaaaataagttttagaagtatttttttaaaaaatttaaaagttttttaaaaaaactccaagccacaatctccctatcgaacggggctcctatttcccggtacgcgaccagctcataaattagctcacaggcaccatttctttggaagaagaaaattgcacccaactcatcatggtcattgactgttcttgaggttgggccagaaatctactttgattgggctcagcccaagttcaagctaacttggctcctataccaagcagtagggatggcaatgggccaggtcaggcttagtccaagcaagctgaactcgaggcctcgagcttactctgtagctcgcgactcgtgagtgaaagtgtgaaacgtgctcaacctgagcttggctcacgagcaactcattgcctcatttgacagtcaactcatcaatttggaatgaagacgaaccataggagtatgtttcatgtttatggtccgtataatgcactaaccattaagtgtaagatactaatgattttgtcttctagttatctggtctagtcagagttaaataccgtagagcccctacaatacttctttattgggtagcatcattttattccaaaattgtgccttcgttagcagttaatttttcactaggagacagtggcgtattgactgttacaatcactcctaccagttccttttaataaatcagatacatatttctcttgagttaataatattccattagaaatctttgttacctctgtaccaagaaaatagtgcagatctccaagatccttaagtgctaactctttctggagatactgcaataaggctggtactgcatcctttcttaaacttacaataattatatcatcaacataaatgagcagaaacatggttaagtctgctttgttataaaagaataacgatgtatctgccttagatcctctaaaaccaagatcatataacttacttcttagtctggagtactaggccctaggtgcttgcttcaaatcacataaatttttatccagtttgcaaacataatcgggattagaagaattttcataacttggtggctgcttcatatagacttcttcttcaagaactccatgaagaaaggcattctgtatatcaagttgtcttagactccatccccttttgagactgcaacagacaagataattctgatagcagatgccttaacaataggactaaatgtttcctcatagtctatgccatagtgttgcttaaatccctttgcaactagacgtgctttacatctatctaggctaccatcttgtttcctcttaatttaataaacccatttacagtcaataatattcgtgcccttctgaggaggaactaaataccaagttttatttttgaataatgccatatattctgcatccagtgcatctttccagtttttattgctcaaagcttcctgtaaattttgtggctcaccagttgagattgaaaggccccattttactgtaccatcagtgtagaccttctcctttctgattccacacacttgtgcgaggacgaggaggaccatcatcatcatcatcatcatcatcattattctgagctgatgatggatcttctgtggtgctcatcagctcgtgtgaccagaagatcctgacgtggaatctaccgcagcagagtgagacgatgacatgaatgcgccaacgccagactggggtcccgaggacgctgaagaacgtgtgggtgaagacgtggcagcatgcgattgctcgggcggtgaagtcggagctgacggcacggaagaagtaggcgaatgcaacgacaccgatcccgaggacagcatcacggcagacgaggcagattcggtcgccgttcccgcatgttgttgtgaaccactgtcctcattgtcatatgtggctaaatcatcatgtatttgctgtaaaacttcaggattttcatcaaaactttcaggagaattaatcacatgacaacgctgttgttgacccagggatactagtgatgatgcatcgggaagaagattaattttggcgcggagacgtgcactagcatttggatgtaatttggcaaaaggaaatttgttttcatcaaatactacatcgcgagagatataaactctcccagtagaggaatcaaggcacttgaaccctttgtgaaagatgctataaccaaggaacgtgaattctttggaacgaaattggagtttgtgtttattataaggacgtaaatttggcgaacaagagcaaccaaagatacgaagggctgtatagttaggttatttggtaaaaagtttttccaatggagatatgtcatcgagaactctactaggggtgcgattaatcaaatagagtgcagaaagaaaagcttcatctagttaggttatttggtaaaaagtttttccaatggagatatgtcatcgagaactctactaggggtgcgattaatcaaatagagtgcagaaagaaaagcttcatcccaaaattttagtggcataaaagaatgagctaataaagaaagacacacttcaactatgtgacggtgctttctttcagcagacccattctgttggtgagtatgtggacaggaaatatgatgggtggtaccagctttttgaaaaggagtgaagtttttgatattccccaccccagtaagtttgaatggctataattttcctatcaaaaagtctttcaactagttgttgaaaatcatgaaacttctaaaagacatcagacttatacttaagcaaatatatccatgtaaatttgctattatcatcaatgaaactcacataatatttaaaaccaccaacagattgtggagcagcaccccaaacatcagaaaaaattagttccaaaggatatttaggctcactagaagacctaggaaaatgtaattgatgactttttgctcattgacatgcatcacatacaacaattttattggacacatctagacaagacaacttatgacttttaatgaccttttctacgacagtgtaggaagaatgaccaagatgactatgccacctctcgaaggatggcgtgaagactttatttggtgttggcttggcgatgcaggaggaagagcatatagtcctttatgacatcgacccctaagcagagttctcttcgtggctagttccttatacagaaaaatttacgatataattctatgaaggcaaaattatcacaagtaagacgataagctgaaacaagatttttgtttgccttgggagcatagagaacattatcctatatacctatacaaatcatccccactactaggaattctctgcatcttagtgcttccacgccatccttttttctctatccgttggtttctaatcaaacgatcaggatcactgccgcatcacacatccactcgcttctcctcctgccgctgctcgcgcttcacctccgtgggacctccaggcaaagcgctcgcttctcctcccccatcggctgcgcatgccatcagcgggcccgccagctcagctgcgttcgcttctcctcgccccacggcgctgcctcccccattccctgcacgctccagccgcattgcgccgcttctcctcccctcacgcaaggacgagctctttaatttccgctaacagtcacacacttatttactttgcctcttcctcttcccatgttcatgtgcatgtgcatgtgaaagatgcacatgccgatgccggtgattgctgctatataatgacatgctcggtgttgttgctcgctcgctaaatgtctccgtctctctctcaccaattctgattttcatagattaatcgctctaattaatttccttgcagttttgcttgaggttctatttgactttcataatacattcccattatcctttccttttgtctccagtatgtatttgaattaatattttaattattctcttaatttttcgcatgataacataaatttcataattgtttagtgccctgtgttgttgaataatatttgaagccgttttcattttatatgctattagaaacccttttttcattgttggttacacttcttatgatgttgtattttcagctgatctttttagcattagcataatatggttattcctatgtccagcaactttaaaaaggtttttgatactctgtattgttctgtattgtacaggaaacaagaaaggtgggagctttcttcattgaaccactgcacaaataattcctttgacggtacgccattaaaatcctcttttccccttgatcatgtctaccactgtagactgactaagttgttttgcattaattttagtagcggttgctgcaaccttggaattatcttaacttaatagtgagacaagaaaaggaagtgagttgaattgcatatgtttttcaataatttgaactgtgagtttgaaagttcaacacattatgcatattcggttgtgatgttatatttattggagtctctactcctatctgatgttatatttattggagtctcggctcctatctttattcttttattcttttatttgattgaatagaataaaatgaagggtgtaatatcctaactatttctttttttatacttaaaacggtaggagatttgccggatatattagaacgagaaaagaagtagtaaaccagagccttacatatctctattaaaaagaaaaaaaaacatctagggaatatatgaggatttatttacataaaaaaagagagtgactgattgaaggatcatgaaacagacagatccttgattgttctattaggctaatattttccttcgctagaaaagcgacttggaattcattcttcaacaattgttggaaaattcttctattgtgtaccagccatatgttccaccacattgtcaacaaagcacacaatatcctttttttaggtatgaaattacaggagctcactccaccaatctgtgatggtttggatcgcttgctgttgtggggcttggaagttcatccaattgggctttatcctaactatttctacatttatattgtaaacttcatctataggaatgtgctatttgacttaacatgtcactgtggcctgtgggccatgtgatatttcattttaggttgtctggcagcgccgacccaactttcactatgctgtactgtatttttcaagtaaacactacacaaataatttttattcatttgttttaaataagccgacatctcgagtgacaactaaaagtaccgcagcaacgcgcggggtgtattctagtttagatagagattgcgactaggggtcttaacaacagaattgccaatgtgactaattttcatacctgcttcgcttgctgtgtgaatttggtcattgccatggtacttgtcatgcactgttagcttctccaactcgccagtggcgtgatccgttgcaccggtgtcgaggtaccaattggtatctacaccgtatgaaatagcagaacttgcaaacctttcatctagaacaaagttttcatcataacggaaccaacaatcctttactgtatgtcctctcttgtagcagagttggcacttgggcctattgtcgacacctcctggattgccgcgggcaccgctagggttcccacgacctcttccgccgcggttgccgttgccgacgttgttgctgccgccgcgggtacggttgttgctgccgccaccaattgtgttgtgtgactgtcctcggttggctgaggcttgtccttcttctccacgacacagcagtagcctgtgctcaaagcttagaagctgaaaaaaggcctcactgacggtgacttgatctggacgcccgacgatagattggatcacatgttcataatcctcttcgagactggcgatgatgtagctgatgagttcgtcgttgtcgacgaacttgccggagaccacgagctcgtctgccagcgcccgcatcttgccgacgtagttcgccaccgtcatgtctcctttcttcagggtagtgagggagaggcgtgtgttgattcactgcgcccttgttatcgaggagaacatcccctcaatcatgctccatgctgtcgctgccgtggtgcacgcagccaattggatgagcatgtctcttgtcatggaggataggaggtaggagaggacttcctgatcaacagcaattcattcctcataatcggggttgctgacgacgacctccgcatcgccttccttcctcctgatggtggcggccggaacccttgtcgctccggtgaggtgcccttccagcttggcacccctcacagccgctaaaacctgcgccttccatatggcgtggttcgattttcctaacttctccaagaaaaattggccgaccagaggattcccggtatgggtcttcgaggaacttgccacggtgcggctgggagaatggattagattagatctcgctctgataccatgtagaaaaatgacgtgggaagcgttgaacccttctcagggccgcatctctattgatataggtgagaatagccctcgcagtggcgcatacatcgcg

SEQ ID NO: 75232 - DNA, 10575 bp, Oryza sativa
cccccccatcccaatagttctgtcttttgcaatcaagcaaaggaaacgatcgaccacattttgttgggctgccatgagtcccgctagctttggtggctggtattgcaagcatgcacgccgttgggcagccaccattttttccgttacccgatggtgagcaagcagcaagaaagaaagtgaggccaagcaatattgttatcaccctggacatgcggaagcggaacgagcgcaacaactgcgtcttccatcagtagtcacgttcctggaccaaagtgatgcgcgtggccacttacgaggtagcgctcgtgaagcgctttctggccttggtgaatgtgttaatatggtcactcttttgatgccgtgggaaatagccttctgtacccccatccttttccttttttcctttgattctcttttttgtcttttggttttgggttagctttgtgaaattgtgaggcacattactcctgaatcttaatataaacatacacatgacgcatgataaaaaaaaagctacatagattaaacaaaacatgatgcacatgcagatatggatttgttcatgttgagaactacttcctccgtcctaaaatataagtatttttagaatagttccaaatcaaaatctttgtaactttgactattaatagcgaacaaataaaaaagatcaattgcgtaaattgatgttaatagatttatcatcaaataaactatcataatatgcaaaaaattttatttaaaacatattacttttataaatattattgatcaatgtatcatttcaaaaactgtgtcgaaatctaaaaatacatgtattttaggactgagggagtagctggtatgattaattaggagcgagtggattagctgtcagattggtttgttccttcgtagagctagtagcatcaatgtcaattaacaattacagttcataaagctaaatgccactaaagtcaggatgcttgtagattagagcaggtaaaatagcaggctataagccagctgtaaacatattttaagcagataaataaggagagagaagagcagcgggctacagatttatagccagctgtagcacggactccaagacgcagtgtgtatatgacaggtgggaccagatattaatagtgtagtatgtaactattgtatgaataagctattagattggttataaatgaattggagctagtagttggctatactattaaacttgctcttatacatcagctcataaagctacagttcattccccgaaaaaaaaaagctacagttcatgatgctgtctcaggtttcatgcacctttgttatcatgtagctaatgatcttagaagacacatatcgttctcggttttttgttttcattgggtaataaaatggagctaggtacaacgcatcatgctcttattttacaaatgtgcaggcatggtctttagcagcaggaatatgatacttggcttggcgcacaccggggtgggttaggcccgcaatgcagagggatgagaaggagaagaacaggatggatccgataataagagaaaataaaaaaaaacaaagaaagggaatggaaagaagagaaaggtataatctttttgcaattacaagaaagacgcaaatgcacacacctacacataagggtgtaagtggggcgggttgtgccgccaacccattgggtacacatgctcacaccacgaatatgcccggtgtctctgtaacacatgctcgaagggaagaggccaaccgcaaatctcttaccttactgaaaatttatctatttaaagcacatacacatgcgtatgcttaatatttgtcacctctgggatttgaacatggtttagaaaaggaaaaaaaatccaaatgccctactaaactaactttggatgaaagtttgtttatcgccctgaaatttgaaacggatattcaaccacccaaatttttacttatgtaaccctcagattgtttcgcagaatggtttttatctaattgtatataagttcgatgagtttgatcacgtggcctacacattggacatatctatgaaaatctccactaaaatatttctttttccctttattagttctcagttacgaacaagtacaatcataatagtagtatggtaataattgtgtaaggataaattgatgacttactaccgatgatatgttaatatgttatattaattattcaaaattattcgtttaagcttccaaaatatgcaaaactaccattaagaactccttagggggtaatatagattatattgcaaagtttagggggttggatgttaaagtttaggatgttaaactgacttattcaaagtttaagagggtatttggacctttttctgtaaagaaaggttggataatttaacagtttcatattaacactgaagtgggaaagaatatcaccaaagactgtcatacatgacgggtcaaaaatggttttttttctcgtgtaagaagaagagatttggcaaagattgtgaggaaaccaggtcaaaaatattacaactacacgattaattgaaagggaaccgggaaaaaaatcccccgaagaacaaaaacaacttaggtagcacagcaccagaacacaatgaccggaaagaaacccgttactactcattgttgctcagctcatagccaaaaacgaccagcggctccaacttctggtgacgatcttcaacctgaaagcttgacgtcgctgctaacaataaggctgagtttgggaccgcacgggaaaccgtattgccaattaacgtgtgattgattaagtatgcttaaaaatacttgaaaataaattaatataatttttaaagcaactttcctataaaaacacttttgtaaaaaacacaccatttagcaatttaaaaaacgtgcacatgaaaaatgagggaggtgagttgggaaagaagagggaagaacacaacctaattaaggggatgtggccactggccaccacccaatcatagagcgtgatcttcttgacaaagccttcaaggagaacaccacaccaaaagacattgtcaatgctcatccagagcaccggaactaggttttcaagtgaagtaaagagagaaacaacacggctaggaccacaaggagggggaatggtgtcacaggtgtcaccatgtgaagaccgggacaagtctttcgcccaaagctcatcataccaaccacgacctttgctagtaccttctccacaaagataaatgtaaggaggcaagtgtaatcattgccaagcttatcataccagtagcagctccgacttcaccccgaacacataagcacttgacgatgccatagttgatgctacaaccaacattagaggagatggcacgatggatagtatatcagctgcatcctaggctcctagcaatgacggactggtttataaaggagtagagatttttaaaaactacaaaaaatggaacccaaagcgaacagcttcgatttttaaaatccaaataataaacaaaataaggatgacatgcgggccataatgagtaaggtggtagcggttgacgagacttctaaaaattataaaaatataacccaacgatgatcatgtttgattcataaaatcctaatgccaacaaatagaaggggcgaagggcgggtcgtaaatgagtatgtgatggtgtttgacgagacttctaaaaactataaaggggaacccaacgatgatcaagtttgatttttaaatcttaatgacattaaagaggaggggtggtggccgtaccataaaggagtagagtggtaacagttgatcggacttctaaaaactataaaaactaaactccaacgatgatcaggtttggtttttaaaatcccaataccaataaaaaggaggagcagtgggagggctgttaaggagtagggctgttaaggagtaaaggagtaggatgatgaaaattaacttgacttcaaagaattataaaaacggaacccaaaagatgaccatgttcgagtaattctaatgataataaaataaaatggagggcattgggcgggctgttaagagtagggtggtggaaattgacttgacctctaaaaactatgaaaacggaacctcaaaagatgaccatgttcgattaattcttataataataaagagaagggatgataggtggaatataaagaagtaggatggttgcggtcaatggtacgtttaaaactataagaaaatataaatcgatgagataaaaaaaattataaagtcccgaagatgatgaatagaagcggagatgagcaagtagaggaggagcgacagaggagtatagggaggcacgtgtgtaacttttaaaaactaaataattgtaaacttgataatataaggttcattttttaaaaatcacgtacgtgacaatgagttgaatatttaataaatatttttaaaaaatcatatgtaaaaaaaatagataattttatgacggtgttacccctgcaattgcgcgagccaacatactagttggagtttaatttgttatttttgttacaacttataaagttaaattgagtttacacttgcatgtttgagtgatgtattactccctccatcccataatataaaagattttatcttttctactagttccataatataagagattttgctatactacttgtcacatccatcatctctcattcaaatttctacctatttcaacctccaactacccgctcaccacaaccgaaatcacatttaatagggatattgtagtgttttcttttcatcagtaatctttacctaaagggaataatcccttatattatacaatggagggagtacatattaatttattatatcaatttgtcttgaaattttatcataatcatttagttgacatactcactctgtttcaggctacaagacattttgacttttgccaaagtcaaactgctttaagtttgactaactctataaaaaaaaaattttaagaaatttttttttatagagttagtcaaacttaaagtagtttgacttgactaaagttaaaacgtgtattgtaatctaaaatggagggagtaaaataaatgagtggatatttagtttcccagcttgttggctactctctcaaggtgtgatttcaggctttccgcatataaatagggtggtatgcatgtagtacattgtatttgtgcatcagctggccttttgtgacttttgtccatcaatcatacagtcacgctccttcctcggaaatttataatcttcgaatcagagatcgatgtcgcggcggccgtccgtagcaccggagccggctccgcggctggtctgcaatgcaaccacgggtgatctaccggcaggctgcaacctcggcctgctggcccgtatcgaactcctggtgctcttctgctccgccatcctcgcgctcctcgtcttcctcggctcctccaggcgccggagcagcagcgccaccgtccgcctcgtcgtgtggggcgccttcacggtgtcctacccggtggcggcctacaccatcggcctcatgcagtcgtcccctttccaccacgagctcttcgtggtctggtcctgcttcttcctcttcgtcctcgccagctccgactccatcaccgcctacaccctcgccgacatcaagagcccggccaccgtgctgctcaaccgaggcctccaggtcatctacgtctccgtgctcctccactactacgcctccgtgctctccccgaagctcaagatctacctcttcatcgtttggctcgtgagcttggggaagatcgcgttgagcgccctcggctaccggctggcgctgcgctccgacaggttggaggcggacaacaagctcgtcgctgattacatgacctacgagcacgacctgagccggcagggcggcagcgacggagatccggtgaccatggaagggtacaagtacatagtcagaggggaggagacggacgtcatggagctaacggcgccggactacgtcaagaagatcaaggtggacggcgcgcgtgcgctggtgacggtcgagagcgtctggcggtgcaaggggcggttgctgatgggcagctccgtcgccgacgccagcgccgccgcgcgacgggatctttgcctctcctttgccctgttcaagctgctccggcggaggtgcagcaactatcccctggccgagtccggccaacccaagacgagggactttgtcctcaggggcctcctcggacagggaaaagacgacgacgacgacggcgacggcgaccggagatcaagacgagacggcagagctttccgggtgatcgaagtggagctcggcttcctctacgacctgttctacacgaggtatcccttcatctgccacgccgcggtgagcacggcaccgcacctcgccatgtgcgccctcgtgatgaccatcggcgtgctcaccctctcctcccactcgctgcgacactaccaccctactcaccatagaagcatcgaggtcaatggcgtcaacctcgacgtcgccctcaccatgttcatcatagcgctagtcatcgtcctcgaggcgtaccagttcgtcgccgtgctcttctccgactggcagaaggtgaagatgctgtgcaggtacgtcctccggccgtcatggcaggggaacccgttcttcgaggcggtgttgcgcgtgctgtgctactgcggcagtggcgtgtactggaagaagacgatgagccagtactccatcgtccgccacgcctctcctggccacgccgtgaaggactggctgtcgcgggcgactcgccggtggctggacaggctcatgttcaacggcggcaaggcgcgatcggtgaaggtgtcggccgcggtggagagcgcgctcgcgtctgcactgagggatcgcgacgacgatgacggcgtcctcggcggcggcggccgcgccgcgctgcggcaacacaggctagactgggcgtggggaggcgcgacgtggcgcacgtgcgcgcacgccattctcatctggcacatcgccacttgcctctgtgacatgcagatgccggcggcaataacccacaagaagacgcggccgcgagcgagaaaggccgccggcggcggcgacggcgacggcgaccgtgcagtggcgacgagcctgtcgaggtactgcgcttacctggtgtcgtcggcgccggagctgttgccggagcaccagtacaccacccggacgatcgccgaggcggtgctcctcgagctccgggtctgcctccgtggctgcgcgtcggacaaggaggtcttggacaggttgaaggcggtggcggagacggcgaccgcgagctcgccggagagcggcatccatgtgcacggtgcgaggctttggacacagctgatggtgatcccggaccaggagatgacgtggaagctcctggccagggtgtgggcggagctgatgctgttcgtcaccccggcggacaatgcgacggcgcacgtccagcatttgacgatgggcggcgagcacattacccacctctgggcactgctgacacacgctggcatcgtcgaccggcctaattctccgtccccacacccacatccggcgccgtaaattggcaccactgtatatcggtcattatattcctccttattgctgctatatttaattgtgttcctccttattactgttgtattttgtgtccgctgagtacttctgtttttgagttaaatgttcatgtttgttttggtgctcagttagctttaatttggtgtcttagtagagaccttaattctagctcaagcaactttctttaaaggttgttttccacttttactctactagcacttttcgcgctaatgtaatctctttactcatgcttgatctccattgttataaaaactagctaggtggcccatgcaatcgcacgactagtacccatataaaattatctatttttacatatgattttacataaaatttgttaaattgttatctcattatcttacgactttgaaagacaactttatcaatgcccgtgttattaattttatagtttttaaaagccacgtcagttgctacctcttacttcctcatcaccgctccttgcttgcttgatctaccaatgtttctattcatcctccttggaagaacctttaagaataagaccatgcagtttttagagttcattatctcgttgggtttcgttttataatttgtagaagtcctctttattgtcattgagattttaaaagtcgaacatgattatcattggggtttatttttactggttgaaagtccctccttccgttgtgactgttctaattaatggcatgcccattgtccctactcttaatcatcattaggattctatttaaggttttatttatagattttagatgtccaatcaaccgccaccacactactcttatatgggtctgttgtttctcccctcttcaattttacttttgaaaattccatatttttcattccgatcggcggctggatctggctaccttgagatcatggcaaaggagagaggcaaggctacaagttgggactacgagtggacccctgagcccgtttagccactgtggggtggccgctggccgtagaggagaggtcgtgccatcatcaagactgccataaagggaggttaggccatcgttgaggggatcgcctgtcatgcgccactatggggaggctgcccgtagcgtcctcaccggatggggaagagaggatggggatggatcgagagaagagaaagggccgagaagatagagaagagaggatggggatggattgagagaaaagaaagggctaagaaggtagagaagagaggatggggatgatgtcgacaggttgtacccgtctacagtatttgtagagtatgcggatcgttggtgacgacagactatacccgaagacggtatttgtagagtatggaaatcattggtgtcgacggactatacccaaagatggtgtttgtagaatatggggatcgttggaaccaaggtatacgcgagatcggatcaagtagacaatggacaaagatttatactggttcgggccctcaagatgagtaataaccctactccagtttatacgtattatagatggaaataccacacatagtacaatgagggataggatgactagacgaatccgccgactagaagctgtcgagaatggccgacaagatctattcgccaattaaggtgctagcttcctttggattgcttctggatgtggctttggctacggcctgtaattcgatgcccatgcctggatgaggaggtcttgtatttatggcgtagatcatcttcttcttcaagtaggactcggataaataaaccggaatatgggcctaaggaatcctcatcttccccaactagggactctgacaccttctaatccgggaagataattgccaacattatttcccgtatttccttaattgtaggatatcttcctctatactattaggtatatggtattgtcatattccgttaactcatgtatagaaggtatgtcatatccttgacacttacagtcggtactaaggtatatgcgagattatagtaagaagatggtggacaaagatttttatataggtttgaaccccacttattacaggtaatagctctactcttgttagccgaagttggtgtagtcattatatctcaatatcatactgattacaataggagagcaagttagctattctaacgggctgacctaaatccgtcgaatacgtcctagcgagtagatatcagcaactaaggcttatcttactcatggttgttttccaatgtggcattggctatggcttgtattgatcgcgttggcttgtattattgtgtattggttgtcttctcttgtcctctctgctcctctagggtcttatatttataccctcgggtatcctctgtccgaatagaattatggaatcatatatgtatacgatccgactagtctcgcagtgtccaaataggactatttctcttttattatctgaaacaccttacatgcatgtatgaggccttgttctgcaaaaaattttacaatttgaccctttacaaaaactatttttacaaatgaactgtcaccaaaacttatttcaaaaataacccttggcgctgaccaaaagagtcatttttgaaataagttttggcagcagtttatttgtaaaaatagtttttgcaaagggtcaaattgtgaaaatttcagcttgttctgtgtaggacttgatatacggtatatttgtatgtcatgaattgatgtatagaggaaatgccttatctgtaatagtgatagattggtcggtgtcagttgctggtcagataaaaaatccttaacccatcagctcggcttggaccgtttattatggatgccggttaattaaaaaatcggcattgttggttaattaaaaaacttgtactcataggtgctgggtttttaaaaaagtcacaattttatttgcaactagatggataccccgtacattgctgcgggagaattgtgtgataatataatagatatgagttctaaaattttctttcttacctactatacaattttttatgtgtttatctatttttatactttcatcaattatccaaaggttataaatgattaagttgtatggtgtgccttttagaggaagagatgca

SEQ ID NO: 75233 - DNA, 1882 bp, Oryza sativa
ttagcattaactacacttagtgggggataaactttatagatatataggattggtacctatagttgctcaaatgctatatttttatcccgtggaaacaggaaacagttcatagatatcagttttaaatgaaccagtatttatgagccgttaccgatgagaggttttataggtacaccatcctagaatatactaatattttttagttacgattttttagctatgtatatggatatgattattcaagtttatagctaagaattgtaataatttttatgtatatggatatgattatctaagtttgtactaagaattgtaatattttaggatggacggagtagctgttaacttttttttttccaaggaagctgtatctctgaaatctccttgaagttctaccctgcatacgtattgtggagctaaattaagcatttggggaacgaaggcaaaggtaaagaacagttaaaataacggaatgaacacagacaattgtgcgggagattaattaattttatctctcaagggatatcctctcgttccttaggcctgtttagttggcaaaaaaaaaattttgggtgtcacatcggatatttgaccagatgtcggaaggggttttcggacacgaataaaaaaactaatttcataacacgcctggaaaccacgagacgaatcttttgaacctaattaattcgtcattagcacatgtaggttactgtagcacttatggctaatcatggactaattaggctcaaaagatccgtctcacgatttcccccctaactgtgcaattagttttttttaatctatatttaatgctccatgcatgtgtccaaagattcgatgtgatattttcggaaaaacttttggggaactaaatggggccttaatgtatctgaacgttgctattgtaggaggagcatctccagcaggggtcctaaacacagccgctaaacaatttttgagagttgagaaaaaaaatcaggtccaacaaagcccgtactaaaggccctaaaataggaaggcctctaaattatcttctcaagcccccaggcctaggaactttctcgctggcccctattccacatgcgggagagatctcccaccgccgcgcgctgatcttttttcgcacgaaaaattttgctagcaccgccgctaaagcctctcctccgcatgcgcgtcgcctggatcagcgccctcctctccggctgaccacctccttcctcgccgcactcctccatggctggcgacttcctcccctgccggccacctccctacccggtggcctcctccctagcgccctcctgccctactggccacctccctgcagggcagcctcctccctggcggttggcgccctccctctcggctgccagcccgcccgacgccctcctcccctgtaaaccacctccacgtctggcacccttttcctcgccggcaatagtcgaaggtagttttttttctttttccaatggatttgtcgatgcaattagataaggcttgttctttgttgagatttagcttgtgaaagaagagagatggaaggaagtccatctctcttctttcactttagtttctttctctttggcgtcaagcaaatctttctgttataaaaccggccccgaaatcacatcgaaaacaaaacgcggaagaaaacgccataggagatccaaacatgatgacgacaccgaggcacgatatttgataatggagttcagccgaggcctacatctccggggcactgattacgggcgctcctccccgatccagcatattacagcgtatcagagttacaacgactcacggccggtcgccgccggctaccgctccctctcgctatgctaagtcgccatgcggttacaataggcacacccctctatttatgata

SEQ ID NO: 75234 - DNA, 2985 bp, Oryza sativa
  unsure (1)..(2985): unsure at all n locations
agtaatgggcataatcaatcttaaactgataaaaattgcctgatgatatcagcgatgtaacaatgacactagttcattcaaaatgcaaatcacatctcctttatcaataaatcccgtgtatacatttccccaagggcacaacaaatcaacaatcccggcacagcaattttgaataacaatctaaacacatgacactataaaagttcccgtgtatacacttccccaagggcacaacaaatcaacaatcccggcacagcagttttgaataacaatctcaaacacaacacgaaatcatttacgtcatttcagctcttcttttctagatgaatttacagtttcagtataaattttcctacaagtcatgtaccaacaatgcaatccaaatacacccgtgttgatctgaacacatcatcaagctgttaccaggagccgagtgccattcaaaacatgcaaacaaagtgtaatgcatattggggcgataaccatagacttatcagtcatgtattgcatcgcgcgcagtccgctatccatcactgtgttgccacccttcttcgccccagcgtgcattttccacagtgcgaactcaaggaacgacctcactgtctcaaatgtaactctaccagtaacatcaagcacaaacttcctgttgcttggaactgccaatgtgctcgacactgtctcgacccacccttccccagcaccattgctgccactgccaaccgatttataattggcattggacataacatggtgagtggccttcaccatagtctccactgccccgttgcataccgaaacaagcaattctttaaccttagcatcatggcttgcattggtaaggccttggaatagctgatcataggtattgatgtggattgtcttgtcaacgaacacccccacggctgtgctcacgaacacctcaacccaattactaatcgccttctggccctttccagtggcaatcaagttgacccacttcatcggcgaggaggtctccccgggagtcgaagaggcggagtagatagcagctacgagatggcgggcgaagctcccggcgatggcagccgcaaggcgctccccggactccgagaagagcctgtcgacgaggcgatcggagagggccacgccaccgccggagccgggcccggagtcggatccgactccgcggagtatcccggcggtgatggcctccgagatcgcggagacggtcgcggagacctcgggggacgcggcgagcttggccagctgcgtgacgctgcgggggagctcgtccgagccggagcggacgaagtctgagaggtcggaggccaccaaggccgccgcgtcggcggaggccgcggcggcgtctaggaaggccgcgaccgcgccggccagccgccgaggcggcggcggcgggccgccacggccgggtggtggtagatcttgtacgccgccgaacanccgcctgccgccccgcccgccgcgaggaggatccagcgccggcggcggtgggagaaggcacaggcggctgtccatggcggcggcggctcgccggagctagggtttcggattggttcgtgtggtgcggtgcgcgtaccgtgccggtctccctctctctggttttttttcttttttttttggccctttttttttcccttcgcgtgtttttcgtggggactccggcgagcgaccggcggataatggcgatggggaattgtggggcctacacggagttggttgagtttgtggtccgcacgaagaaatctcgcgtaatccgaacgggatttgtagcccacgtgaggcctatattaaaacaggccggaactggatcatagcccacgtgcgtaccaaattaagatgggctgattgtagcatacgtgcggtctgtgtttagtaggcccggaaaggtatagtcggctacgtgcggcctatcctaagatgggccggaagttgaatgcagcccatgtttgttgggtctaaacggtgttgtaggctgtagcacacatgtttattgggtctgaaccgtcgattgtaccatacttagttcactttcaatcccttatctcgagttttaatcacatccctgaatcgcaatactagatacgtgttcctcgacttgcaaaaccaaagcaccttagggtccttaggtcctaaaacagtattgtgttcggttttcgctgacatgaagaatctattatattattaaagaaatagaaaaaagagcctccacgttcgctctcatggcctagaaattctcacattaatcggagaaaaagaaaaggcagagtgcatatagaaatacaatttagaaatagttgaaattcgtaattaaaaaataaggaatattagaagaggagactagagtccatatagaaatacaatttagaaatagttgaaattcggaattaaaaaaaaggaatactagaagtagagtatatagtccatatagaaatacaattagaaaataactgaaatttgaaattaaaaataagggatattagaagtagagtatagagtccatatataaatacaattaggaaataatagaaatttaaaattaaaaataaggaatatttgaagtagattatagattccatatagaaatacaattaagaaaaaaaattcgaaattaaaaaataaggaatattggaagtagagtatagagtccatattggaatttaaaactaactaaaatttggaataaacataataaaattaaaagtagagtttagagtccgtataaaaatatcatttacaaataactaaaattcaaaattaagaaaaacatgggaataagagtttaaagtcaatataggaatacaatttagaagtaactgaaattcgaaattaaaaattaaagaatattgaaagatgagtagagcccacgttgaaattcaattagaataataaaattcaaaaataaaaataaataatattggcacaagagcatagagtctatatagaaatacaatttccagaaaatcggcattataaaaatatattaaa

SEQ ID NO: 75235 - DNA, 4258 bp, Oryza sativa
acaccagtttacaagttgagagacacatcagttcgaatgattttaaggtggacataaagtgaacctattcctagcatacttgaggactacattcagtgggctaaacgcgattaaaacatatgtggcggtccaattagggcgcctttggaatggagagttgttttataaactagaaatgcgagcgcggcgccacgccgcgcacgctaacacttgcgtaggtagaagtgtacgtaatcaagttcagttagaccttacgctatggtatattatatgtatattaatttgattgaacaacacagtatgatatggggcttttttgtttaacagaaattgggaaagattttttttatgaagtaagggcaggtgaaaatggggcagtttgaaaaagcaaatggtaacatgtgatgtaaggacaacagagattggtcaaaaaagcagagtttagttgtaaatgggtttgataacgagaaccaataggtttattatgcagaacgtatattaaataaaattgcaacgagtaattaatatttgtctaatggtttgtgcatttatccatgatgctaatagagacaaacttagagccaacctaaggttcagctcagcctgtgaagagtacaattcaccagcctatgtacgtgttgaaaagttattttatcggtgggctattagttctgggctttacgcttaagttaactttgcctttccgggtttagatacgtatgtcaatgagtggagatgatataatgaagaggaaggtgtgtttcgtgtggaattagccgagtagatatctaaaattcttcactaaacagttgcaagggcaggtagcatgtctgtaaaacagagaatgcaacacttggcgagcatgcaaattgtttacatggattaaaaaaacgcacagttaaaatggttagtgtacaggttgcaagtaaacagagtcggcttatacggatgcattttatttgttcatagtataagttgtttatcatataatcaacaacatacttattaatgcctaatttgcttgcataaaaagaggatttgatgcagaaaatatgcttccttagctgggagatgagtcttcttgtaaactttgacactctccaccggcttctgtggcccaccaagattatataaatagtgaatagtgtactgttaccgtcataattcatgctacatgtatgacgtgtgtctcatgaaacatggagaggcccggtacgtgtcagtgaattgtttacgaccctatagcctcgttgcagttgcttatatatatgaccgtgtttagttccaaaatattactactgctactactattgaagtagtatcaatagctaaagcagtagtgaactctgtagcgttctatatccatatagacgacgactactactgctactactatcgaagtagtatcaatgtatcgcctccggaaaaaagagggttgctgccatttctttggtttcttctccccctgatcccctcctccggagaatcttctgatttagtataacaagttaattacaaggcaatgaaatagagttaattccctgttagcaatatcttacccgaggcgacaattcacctggtaggtaaaatagggactaaagatcaatcaaatagaagtcttgttcaagcttttaaacaacctttaataaggccagtcccttaaaaacggaaatgaaacagacatgtgaaacaatgaggatgcaaaggagccatttcaacaaaggtacaccaatgagctccttccacttcaacaaagcaaaaaaaaaaaaggaatctttcagatagcaaagaaacaaaaaaaaactccttggaggaggatcacaacatgaactggatcagtagttcatccatttttttgtaggaagtaaacaaattcagctagagcatacaacatagttctgaattttcttacacgtcgtactatattatccccaaaattaagcatagtaagcacgtactaaacacatctatacagtaggtaggctcgggttaaagatgtaccagtggatagcaaacattctatatatgctacagagctcgcctatgtcactctttcatcctcttcttgtcaaacatttgtaggctaaaaaataaacaaaaaaaacactgcattattgttacgtctaatatagacgaatctttggatcacctctagatcgaacaattatttaggcacaccatggataacaatcatttaggcagaactcatagaagttttttaaaaaatgtaactcttcaaattttgtatatcatgttaagtgcctcttgagaaaaataaaagatagagcctaaatacctgcagtgaaagtaaatagtactgcattgttttgcattactatcagatgcatgataatacgttatgtatatgtgtcttagtttggccatgtgacctaaatgaccctcgtttagcctatcttctaaaaataagcaaatcttataccctacagttttgtaagtagtggaattagaatacatcgcaatatagtcatatagtttacttcagcatctaattaatggatggcttaatctggcacatactctggtaagtacagtattcttccttgattatataaaggttgttccattatgcaagaaaggaagcaaaacaaataaatacatagacttgcaattcctaaatatagttgaagcagagtatgcacaaccaaggcaaacaattgaacactactattgctattgctccattgtcaaccaatttgtccagaacatttcacagccagacacacaaaaggcaaaccagtttgatagtatatccctgcatgcttttgctcaccttctgttttgggaaccagaccttgatcttctgcttgggctcgatgttggcgaggatggataactcgcagagtaactgctggcggcgagagaatctgggcttggggcactcggcgtacacccgctccagcgcctccacctgacccggcgtgtagtgcacgtacttgccggagtccatcccggccttgtcgtacccgctgccgtcactgccgctgccgctccgcatcgggcatcgccaccgctgccgccatcctccactccggccaccaccaccaccaaagtttcccccttcgccaccttcaacacaacaacaacctgagagatttcgagcaaaagtgaaatcatccggagaggatgaggagaaaaaataacctgacatgtgagagggggaaacgaaagaaagaaagaagaaagagaaggaagggagaaatcgatagatggttgtgcgattgcaagcttgcttcctcctctcctctccgtcaggggatgcgtcgacctcggcggcgacggtcatggtgttccacgtagagaggagaggtcgagagttgagaggggaacggttgggaagctgcggaggagaggacggagaggcaacgcggcgacgggggaagacgtacggcagtcctgcgcaggcggccggtccgacgccgccatgagggaagggcatcggcggcagacgcgcagccggctctgccgccaacgtaggtaccctcgccactgccgccacaagggaagggagggggcacgacggcggatccgccggcgtcgggcgccggatctgccctccccccgccaccaccgccgccgccggcctaagtggagggagaacaaggagggaaggagaaccggtggcggattcagcgggcgtccctccacccgccgccgccgtcaccacaagtggatggagaaggaggaggggagcaccggcggcagctcgggcgggtgccgcctcctccctccccccgtggacgcaaccacaaggtcgaggaggccatcatggtagaggagggcagcacaggaggcatggtggagggcggcaatgttgtcgtccccttgctccgtcgtctttgtaaacgccggcgccgtccttgcccccggccgggaggaggaggccgcatggattggccggggatggggatggcggattggccgggaggaggattgggcagagagatgttgcgtgttggggatgggttggcagcagagaaagaggagggattggattaggatctgtttttttagaatgccctcgtactttttgggattacagcgctgtccctaaaatccgaattttctcttcttcacattgtatttcatataaaggtaaggcttttttagtaaaaattagaataaggatgaatctccaggaggactgcttcgttgtttcctagaggattgagagtttttttgaaaaaacgcatagagcatacgtgccttgcatgcacggcataaacatccaacacccggt

SEQ ID NO: 75236 - DNA, 41504 bp, Oryza sativa
ccccccccccccaccctccctcaaaaaacatccatcgtctttctgtcaagtccgtcgcggcacgaggcacaggcggccaccgcggcgcagctcggactttaactgtagtctatgtaataaaaactaatttgcgagacaaattttttaagcctaattaatttataattagagaatgtctactttagcatcacataggctaattaggctaattatggattaattaggctcaatagatttgtctcataaattagtctaagattatggatgaatttttattaatagtttatgtttaatatttataattaatgtccaaactagatctaaacaggtctcagcctcggcgtgccgtgccgtcgcgtctgccggtgctcgcgcccgcggggtctctcccgtctctcgcctcggtcgccgcgaaaggcgacagcgccgaggccaccccacccacgaacgtacgcgcgtggatagcgtcggtgccatctcgtcacggcgggcgcgaggcgacgacgccgcgggcggcggtgcgtgacgggtggccggcctctgcccggccggtggcatgggtgcttcggtgcgcgcgcacgtacgcttgcgggttggcgcgacgcgtagctgggcatattgctactactacgactcactagcgtactggagtacactactaccgcccgtgtaaatacagccactgcactgcagcatgggagtgtatgcacacactgtatacgcacatacgtacaacacgggcggtacgtgacagaagctacactacgtaccagcctactacgacgtggcgtcgacacgccccggagttactgcggcctgcgtcggcattgattcgggaagtggatctacggcgccggctgttagagcatgtacaatagtatacttattaaccagctgcaaatatattttaataagataaaagataagagagaaaagcagcggactatagatctgtagccagctgcagcacggactctaagacctaatgtgcgtataacaggtaggactatatattaataatatagtaagcaaatattgtgtaaatttgacggagcgtggagctcctcaccgggagaccgcgcaggcccccctttgccggttcggccgggggcgctaagtgaggttcttcgccctcgatcgatcacaagacacgggcgatgtagacaggttcgggccgctgagaagcgtaataccctactcctgtgttctggtggatatgtgtgtgaaggagttacaaagagccggagagccagagagttcaggctccagaacccctctagcctccttttttctttttttttctctccccttttggtgggcaaggtcctccttttatatctcaaagggataccacatgcaccacttctacctacttttcttttgggtggggacctaccctatcttgaccaaaacttggctcgcgccttcgcctggaagctaaatcacagcttgtccttgagtgaggcccagcgccatcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgccgatgacgtgaccggcgtcagaccagtcacagaccggtcattcttgtccaccgcatgtcagtttagcatgccgcacgtctacccttcttcatacaatgacttccttgccatggttgcgatgaagcctggaatgaatctggccgggactgacataccaactccaggagttagcacaccggctctggctagggacgagtgcctggaggctctcatcattccgacgggacggggcgaggcgtgtgtcaggccgcatgttgccacctaacccgtgatctgaccggtctgtgaccggtcacacactgtgacctgtcacggaccgaacgagtgtgctgtgctgcattaaatgcggcgtggggcgctcgtccaacccgcaataaacgcggttaggtgagcgccgttgtgctcacctaacccacacacgtggcgccaaacccacagggggtcggggcgccccagtcctcggggccgaaacgggagcggcccgacccctcggggagacagagggaggggcggccacaccacccttgggcccgacccccccccccccccgagggggtcaggccacgtgggtgactgcagctgccccaaacctctagtcaagatacccccggtcccatgtcaccgacaaaattagctatagatgaattagaacctagtgagctatactattaaacttgctcttaagcctttttggacgtaccatacgtcttcaccctccctcggaagcttgcacattcgttgccgtgggccatgtccgtcagcctgacgcaggcatccactcgctcattaaccgcattgactttcttagatctctagtagatgagtgaagcatagactaatcactgcactttagataatgtcagaatagcataaacgtgaaccgtatccaccgatccacgagtcggggaatccaatgccgcgagcaacgcaagcgctagccttcctagtccgtgtccaccgatgatggagtggttatctgtttcaccgctcgtccgatccgagccgaagttaaagctgctgcagcaccggccagttgagcatttaccacagcacgtccaccgcaattcattccgtcgccatggccgtgggctccgtgcatccaccatccacccgtctcgctcagaggacgcgtgattttattccatccctcttgcattgcaccaatcaagcgcctaataaacactgttagtagacaagcgccgcgtcggtcccagcgggagaatattattagcgggcgatgcatacggccaaggtaggcacacagatgagacgagcacggtacgtacgtgagggagacccgacggcctggtggtggctcgccgccgcggctggaccagctgatagcgcgcgtgcctgctggtgccaaggccggaggcgcgtacgtacccgcctgaatcatttgctactacaggcgaataggcgatcgaccggtagtcgtcgtgtgtgcccctcttggcatgtgatgtgttcgccgcgtcgagctccttggttggcatgcatggcgcgcgcgcgcgcgatgggtggttacggcacggtgtgtgtgtgtgtgcgcgcgtgcagtacgcgcgcgccgcggggagggaccgagggagggagggagggacgcgtacgaaggctaaagccaagacggcaacgacgacacgacgacgcgttggaaagcatgccgggaatgccgtgacgggatggtttgattataactagctgggtggcccgagtaattacgcggctagcacccatataaaattatatatatttttaatatgattttacttaaaatttattaaatagttctctcgttgtcttaagattttaaaataccaaaccttattatcctcgtggttctaattttgtagtttttaaaagacacatcagttgctacccttgcttctgttatattattttctattagctttctcgatctaccattctccttataaccttcatctaaaaacttatattttttagagtttattgtcctgttgggattcttttttataatttttagaagtctcgtcaaacgctgctattatactcctctacaaccgtccactgtatcttctctttattgttattgttattttaaaaatcgaacataattattgtttagcttcatttttttactttctagaagttccgccaaaatgttagcgactttgtctatctactcctctacagctcgctcgctgccgcctttctttaatgtcattgagattttaaaatcaaacatcattatcgttggggattttttttactttttagaagcctgaacttttaaaaattgaaccttatagtttttagagttttattgtcttgttgggttttatgttttttataatttttagaaatcccgtcaaacgctgccactttactcctctagaagacccaccaaccatcagcggtctaccattatactcctatacgacccgcccgctgcgtctcatttttaccgtaattgagattttaaaaatcaaatatgattatcattagagtttatttttttactttctagaagtccccgccaaccgccttgacagatagcttcacgacctacccgtcgtccttccttttaatcgtcattagaattctatttggtcatttattaatagttttttagatgtctcatcaaccgccacctctctgctcctttataggcctgttatttaattaatctcgtcatgtgttttagatggtcttttctttcatttgtcttattttttatcaccgattttagttatttataaattgtattcctagttgaaatctttttttttctaatttcagaatttattttatttattattatgttcttttgatattcttattttttattttttatttaattgtttcaaaattgtattcctactttaactctctttttaatttgcctaatttcggattttattttatttttattccgaattttaattaatctattattgggttcttatatgtactctcatttcaatatttcttatatttaattctgaatttaagttaattttaaattgtatttctacttgagctcttattttcttttattttttctaatttcgatttttttatttttttattgtgaattttaattaatttggtattggattcttgtatggactcttctttcaatattccttatttctaattccgaatttcagctatttataaattttattcctactcgaaatcttcttttttcctttttataattttgaaatttatttattattattccgaattttaattaatcacgtattgggttataaaaatattcgataaattgtatttatttttatcccaaattttagttatttataaattgtattcctaattgaaattttatttttctttttctaatttcagaatttttttgaaaaaaaaaagttaatactgtattgtgttcttttattgtttttattttttattttcaatttcagttgtttcaaaattgtattcctacttgaactctcttttagtttttctaattttagatattattttattttttattctaaattttaattaatctcgtattgggttcttatatggattcttctttcaatattgcttatttttaatttcgaattttatctaattttaaattgtatttctacttgaactcttcttttattttcttttgctaatttcagatttatttatttttattctgaattttaattaatctcgtatttggttcttatatggactcttcttttaatatttcttatttttaatttcgaatttcagctatttttaaattgtattcctacttggactctcatttccttttctaattttagattttattttatttttattttgaattttgattaatctcgtattgggtttttatatggaaacttctttcaatattgcttatttttaattccaaatttcagctatttttaaattgtatttctacttggactctccttccttttctagttttagattttattttattattattctgaattttaattaaccacgtattgggttcctacatgaactcctctttccatattgcttatttttaattccgaattttagctatttttagattgtacttctacttgtactctctttttcttttttttcttgtaggaatttctagtctccacggcgaacgtggtgcctatttttaaggctattttaataatataatagatagattacttgattggcgtggcgctgatgacaaggaggcgggaggaaatcaaatcatatctctcctcgctgtcaacgtaccatgcgggtcagatcagctcacagagtcatcgtttatgagaattgagggcttgcaaaactgccactggtggcaaaactgcggtcacatactgaacggcatgagagttactgccactgtttggtggccgcttcatgagagagcttgatcgatcatgataagctattttcagggatggaatgctcctggtggctactaaatgtatactaatataaggtgggggctcggctctgattgatgatttgatggtgactctgccgccttgctccaaactgctaatgatttcagagaaacaaaaagggtcccaggatgctggatttgtctctaagaggttataaaattctcagcctttatctcttactacttactccgtatcaaaatataagcatttttagctataaataactgtatgtttagatttataactaaaaattgttatattttggaacgaggtagtagtagctgctcaatagtcaagagtctccttcctgtttcagaatacagtatccggtacagattttaattgttgctcctgaaggtgcaatatcatgctactattagtaacgctgtgctcaggcgtcagaggagattacaacagtaggaaacacagtagtaatattaggccattaaaaatgtacagtcccccctatgggacccataactttcattcacattaagttctgatgtgctatcacctaaacctcctcctagttaacgagcactgtgcctgctctgccctgcagctttgtaatgctactgtactagcgtacagtacgtgtgtgctcggacgacatgtgctaactggcaggaacagagaacagatgaacttgctctatcagatgatgggattctgatttgcatgcatgtgcattgtttactttgatctgggaatgatcagccgagttgcactgagattgacaaagatacatggacgcagtacacacctcaacgagttagagtaaccttaaggacagatggcatatggagtggctatggctgtgtttagtttgtgtgctgatttttttttatatacgaacacatatttgaagtattaaatgtagactaataataaaataaattacagattctgcttgtaaactgcgagacgaatcttttaaacctaattaatttatcattagcaaatgtttactgtagcaccacattgtcaaatcatggcgcaattaggctcaaaagattcatctcgcaatttacaatcggactgtgcaattggttttttcctccacatttgatgctccatacatgtgtctaaacatttaatgtgacggaaaagttagaagttcgaagaaaaaaagttagaatctaaacacggcctataccgatcttggactgttgtacataattgttttagccattaagatcagatcaagaaatgagcaagtttaatagtatagcccactactagctccaaatcatatatagccaatgtaatagctaattcatacaatagttgcttactatactattaatatctggtctcacctgtcatacacacattacgtcttgtagtctgtgctgcagctggctacagatctgtagtccgctgctcttctctctctttattttatctctttaaaatatgtttatagctagcttatagccaactcttactctctctgtttaccaaacacatgggaagagtatagaccttgcttttatcacttactccgatccttctattttagaaaaaaaaacaacttttatacacaaatttgatcatgacctaagtctagatataaaagttgttttttttctaccccagagagtaagaaacatcaatattcttttgtgatttaataggtacaaatatcttatctctctataaagagacacatatacattatggctaacattatacgatgcacttatatatcccaccttaccactagcaccggcaagtactataccacatgcctctttcaatccactcttcctccaaccctactacttaaattgatccttcattttgccttttcttgcttgtttgcgttggatgtgcccattgcctcctaaccactctaaatacgatgtcctcgatcacacctacatccatggtcctcctctagcttgtggctagctatatgcaaacattgtcatattgctgtcaacgctgctctcgacccggcatatataaaacatttcggctatttagtgtcatggagttgctaagtatgtgattttacaagtactattatagcatcttagtccacatcatctttgtgattttgtaattcgttgccattcatcttacaacctctctaataattgatataactttctttaagcaaatgccgaaatgaattcattatctaaaaaaaattgcttcatgtagccatttcaaccgtcatgcacgtatatatgtgtgggataaatcatagttaaggtaagattgtttggtatcttggtttagggcatcatcaatgtatatggcaaaagtggtctatatagataggatccacataaataaactttacctatagcaatcctcacaatgtatatggatacaatgtgacattaggagaagagagagaagtagagatagataatattatttatgttatatgggtagtccatatgcatatagataccttttgctattttctttatatggactagttgcacaatgttactagatggctgaatggaatagtttatttcctatggactacttttgtagtacattgtggatgcccttatatcccacaagaatacaatatttatgtgtgctagcttacttgtgctgccaatcttgactttaatttagatcacttgccaaatatcatacctaaagctaacttggataacaaaaggcatgatgaaactaagggtgtgtttgaggagaaggggattgaggagattgggaagatacgcagaacgaggtgagccattaactcatgattaattgagtattaactattttaaatttcaaaaatggattaatatgattttttaaaacaactttcatatagaattttttttgcaaaaaacacaccgtttagtagtttgggaagcgtgcgcgcggaaaacgatgtgcattcttactccctatcacccaaacgaacacatcctaagtatatatagacaacattaatgggtgagtttgaggaataggggattgagaagattgagaagatacgcaaaacgaggtgagtcattagcatgtgattaattgagtattaactattttaaattgtaaaaatggattaatatgattttttaaagcaactttcctatagaatttttttttgaaaaaacacaccgtttaatagtttgggaagcgtgcgcgcggaaaacgatatgctatctcacttattgtccatgtaacgaacacaccctaaaaatagacttgactcaaaatcctgaaggccgaatctgtgaggaagaatgcccagcacacaccgatatgtaaaaaccttttctcatcaggcggattttgtgcttatatgcgtgagaggcggaggagacttcaaaagtctatgtggaggagacaagtattgtgcatgcgcgggtaaaccggggaccggagcgtacgtgagtacttgcaccaggtactaaggagccatgcaagatgcaacagtagtactcctacagtagcagtagtactggcgtcacacgtgaggtctctcgccggtttcagcgactgcacatggatggcgcgggaatctctctggtcagctcagctcagcttgctgctctgctcttacactacacgcaagtgagcacaggtacagcgtcgcggcatgcgtctcacggattcaccaccattgcaacgcgacgccgtcatgcacacaacgatactctccgtccaaaaaaaaatcaacctagggtatatttagttcacgtcaaaattagaagtttagttaaaattggaacgatgtgatggaaaagttaaaagtttgaagaaaaattttgaaactaaacttggccctagaagacggtatgaccactcctaatacagtgaatctaaactatactttatctatatttgttgttttaggaaggaccaaatccggttctaaatttagttttttttaaggacggagcgagtactcgacagccacatgataccgcgctgttgaaaaaaaaagatactatacccttttctttccccctttcactagcacttgttaataaagttattacggccatttgcatggagagaacagcagacgagaacttaaaccatgtttattggagatggagtagtacgtactacgtagtagcaagagtgcaatactatcaagtaccaaccggtgtaagttgaactctgcttgagttgaaacttactcgctccatcccaaaatatttgacgccattaatttttttaaaaatatttgaccgttcgtcttattttaaaaaattaagtaattattaattctttttctatcatttgatttattgttaaatatacttttatgtatacatatagttttacacatttcacaaaaaattttgaataagacaaatggttaaacatatttaaaaaaaaatcaacggtgtcaaacatttagggaagaagggagtagtatttttttgggttcagatcttgccacctaccttgggggagcttcacgtactcgatcacttcggattcctgtttggcgttggcatcaatccacttccagaacagtaagtaattaactaacctttcttcgctttgtacgttggtgtgctcgatcgtatcacgtgcaggctcaagttgagcaatttagcaagtactccacttcagatgaagacaacagtgctacgactaccatgaacaagcaaagctccttactcttctctattctgaactcttctaatcaatcaatttactataccgatacgagtagtatatggtaactgttgggtgactcgatctgtcagatatcttgatacgtttttacaggaagatgttaattacactgcctgcccagcttctcctccatctggtaagtggtagcgacattttcgagtggatcgatcagatccggtgaaagttcagtgcacacgcacgtactacgccgtgaatgggcagcagtgactcgtcccggatcggagtcggggagccatgtgcgaggcaccctttttcgaaggccgctgctgccattctgcacgcagcggcagaggctgtctcgcccggcgccctgttctcggctagctgcttgctcgcactgaccgatctctgcaggagacatgttctgtccggtgtccggaaacgccatggatctagctcggacagcgcgccgtacgtgggcgcttcacggggcaccaacagtggcaatcttgatagccggaaaagctctgaaaaatcttatccatggagctgaggttgcaatcaacagagcttggtggagaggaagagaagatcactgtacctggacaacgaagctatagccatccatccatgcatgcacgagtgcatgatatgatgctgtagagcagagcacgaggaagacgatacagggaatgaatcaaattttatatccgggtgtatatatatctagcagggggaaagattcagcagtagatcttgtcgctaaatctcttgcgatccacgctaactgacgcgttaacaaagggaagtgggcaatttgaattggaggggcgctcccggtttcaaaatctgacggggtcccgtctgtcttctgctaacattggtgaccgcattgcaacagatttgctcctgtatcagagggataggtgtctgtccacgttttgttctttcggctcgcagtacatgcatgtgtgcagttaaatactgctatatggtaagttgttcattggtaaacaatgtagtggacgtgttgaagttcaccccacacgactagtttcgaaagaaggataagatatataataaccacagggaagcacacgaagaacaattatctttatcaactctctgttcttcgttcataatcttgaggcagcatgcggcttgcagggatgaataaacatagcaagactgcaagagtgagtcaccccatctaagcagcggggagaaggtgaatagttcatgggccttgaagttaccaggccggtgcccatggcaaaagcatgggcctgcatttaggcccagtctagaaagcagagcacacgatttcactgcggagtaagttcaccggaagtccctcaacttaacagcgagatttttttgaggtctctcaaccacaaaaccaaaaatgtttgaccctaaactcattcaaaccgttcacaggaggtcccttggcagtataggtgggtggcttcgcttacgtggcatcctagtcagcaaaaaaaaattaaaaaaaattcgtggggcccatatgtcagttgcactttatttttttcttctcttttatctcctcttctctttcttctcctctctctttgccggcggcgggtggcgatgggcgagcgtgcgactggagtaggtggaggggcggcgtcagtgcgctcgagcaggcggagcggcggtgtctccgggtgagcgcggctgcggcgacggcaagcggcgggcgagcgtgacggcaggcaagcggcagctccgagtgtgggcggtgcgcggccggagcaggtggagcggcggcgtctccgggcgcgggcggagcagaggggcagggggcgcggcgggcgagcggcggcgaggcgtcgcctctttccccctctcccaccagcctcatcttccccaactccgtccgctcccgctgctgcggcgcgccaccacgctgggctccttcgatgagtgcgacggcggcggcgggaaccagcggcaagacgacgtgctcgttcgctctgtccgctttgcgcgccgctctcgccgcccccgccgaggcgactagcggagtaggccgccacgctcctccttcggccacctccgccgttgcggccccctcatccgcctgcagtgctcatcggctcgcccgacgcccgccgtccgctctgcccgcagctcgccgcgcttgccttccgctcgcccgccgccgtccaacgccgctccgcgtgccgccatgccgcccgcctccgttctgcccacaggccgcgctcggtggacagcgctgctcaaggatgacctcgtgttcggggaccccaacgcgccgcggttccgcctccacctcccggatcccgccccaacctcctgccgaggtcgcccgcagtccgtcgccgctctcgccggccatcgccccgctcctgcctgcttcgcctgccgcggccgcgctcgccctccgccgccgccgccgctcttgccggccgttgccccgcccgtctcaactcgtcgaagaagacgagagaagagaagaaagggaaaaaaaaggaagggatgtggggcccgcaccgttttctctcacttacatgtggtccccacgtactttatttttttttgctgactaggatgccacgccagcgaaaccacccacctatactgccaagggacctcctgtgaacggtttgaatgagtttaggggcgaacatttctggttttgtggttgagggacctaaaaaatctcgctgttaagttgagggacctccggtgaacttattcctttcactgctgcactgcaccggcctacccctccaggctctaccccaccccacacatctaagcatagaggaataagttcacattgtatctcatcttaatgtgacgtttgaatgacatccttaaactgcaatataaaaacattgaaccccatcttttgaaacaagattaaataatatcctaagatagtatagatgactattttggccaacatggcaacctagtaaaaaaaacatatgagatccatatgtacgcaagtaggtggacttccacctctcccacatatcccctctcttcctcctgagctgaccagataggaagaggggcacgaccagtgagcgcgtctgcgggagacgataacggcggttggaggtcgatgacgagggaggtgtcagtggtctgtggcggcggagcacggctgctgacgacggtggtgtcccctttcgaccccgtacatcaatgacgcgcagccggaagtggcaggtggccgggacttcaactccaccagctgggaggagacgtgctcctcgtcactaacgtacgaacacgatgtgttggctctacaactcgataatcaggggcggatccagcgtgggtgctggggggactcgagtcccctctaccccactggatcaaccattgatagaagggaatataaaagggaaagaatagtgaaaaaatgaagagtagggaggactaaagaagaaagagataaatccttaaatcttgttctggatccgcccctatcgataatactatattgccacccctactgtcgtcctagactcaaggtttgctcacgcaaccaattacattggcatatttagcttgtgagttaggtggctcgttatactcctttcttcccaaattgaccatcatatatgtttatgcaccaaaaccaaaaataatttaaatcacatcaattaagacaacatgcacacattctactataatgcatacatcgattaaaacaccatgccaatcacaccttagcatgcacacattctcccatgctgtatcaattgtattctgatgaatctgtgtccatgtggttatatgacgatcgatttgagaaattttgaatttcattatatgatgatcaatttgggaaggagggaatatctataacgagataaaatcttgtcttagcacgttaacaattttaaaaggaataagttcactttgggtccctctatttgtcgcctagtccgattttcgtcccttaaccgcaaaactgggtatgacccgtcccccaacttacgaaaaccgggtaaacgtggtccctcggctgttttgaagacggttttggcttacgttgcgcctacgtggcttgtttgtcttggtcttcgtcccacgtggcattgacgtggtgtttacatggcaattatatctcggaaaaataataaaaagcgtggcctcacatgtcagctgcacaaacaaaaatagtttttaaatggtggggcccacgtgggccccacatgtcagcctcactcatctcttcttccctttcccctctccctctctctctccttcccaggcaggggacggagcgggtgggtggcggagcaggcgagctccggcgacggcggcggctgacggcgggagcgctaggcgggcagatgaatagggcggcagcgcgaagccgaaggggcgccagcctcgtcgtcatcttcttccggtgcacagcgatgcgaagccggtggggcggggcggggtagggcagcggggacgacatgatgcccggcttgttcgggttccatgatcatcggaggtccttcgatgggctcgccgcgcccttctcggagttcttgggtactgcgaggacggcgaggatgccaccatgtcacgtcctgatttttcgctttctgttctgctcgcctatttgcgaaaattcacatttggtttattcgtctaaaatagcttaatgaaaatttcgttaaatcaaaagggttttaatgtgattaattaattaatacgttgtttgctttgtggttcttaattggagttagttggatttaattcgtatttcggaagtggagctcaatccctaattcaaattccatccaaatccaatattctaattcaaatcctaaatcctttccaaaaattccaaatactttataattggaattttccagagaagtccctgttttttttccctttttcctttctctctttctctattctgccctttttcagtttagcccttattcttctctctttttcctttttccccaccttctacctccagctctctctctccttcttgagccgcaggcccggggagaccaagccccgagcccacgtgccgcctcggcccggcctcctcctcctctctgcatcgccggcccaagccgccgccgaccgagcccgcgccggccgcgccacaagcccaatcggccgccgctaaaccccgcaagaaccggcgccgcccttccataaatcgaagccgtgcgtcgccctaaccctagctactccctcctctataaatagcgctggtcgccgccctctttttcccctccttcgtccaaagccgccgccgccatctccaccgtgagcagccgccatcgccgctgctgttctgtgccgccgccgggagccgcgccgtcgtcgccgccatctccttcccgtgccgccgccgctggtaaagccccgaggctgagccctctctccctttcgcgccgccgtttctctctccacctcaactccggcgtccgcctctcgtcgccgtgcgccatctccacgccgtcccggagctcggtgctgcgccaccgcgttggcctcgacctcctctgcctccgccgctgtttgccgcagccgccgtgcgccgtcgccgacgaacgccgccgacgccgccgcgctggagccgccatggcgccatggccagagcacgccatgccgtgtgatggagcagctgctccttgtccttttctctatgccactgacagtgggcccacatatattttcctatccaaaattaattcaatttccgaaattaaatatccagagaatattctcggaatattcctttttcttttaccctcggattttccctgaattcaaacttccggaggccataacttttccgtttgaactccgattcgatccattcttcttcctaaattcttctaaaatcgagctctaccttctggtttaattggttatttcatttgatgttatttagttagtttttctttgtgtttatttgttttcgtgtgcaatcgtgtagacgttggagcggaagagcagtttgcttcagaagacgctgtgcaaggacaatactgggaacaaggcaagtgcactctttgaatatattgaacccatttgtgaaatgttttgttttgaatacatgcattgttttgtttataaactatcgatgggtagcgtgacctaattgttaatattatcctacctttgataattattgattgcccataataccttgtcaccctagtctttgtgagttgaacattgggctcaactcatggtagagtagttatgcttagcccgctcaaggttgttttacaagcaaaatataattttgattaatcatatatttataatcatttttatatgaattgtgtggctgtgtgctatcttttcggtagtatgtgttgcaccgtgtaaaacaacagtgacggagcgtggggctcctcaccgggagaccgcacaggcccccctttgccggttcggccgggggccctgggtgagattctaagctcctggtctgagtgtggaaggttcgcgagagtgaaacacacaagacacgggcgatgtatacaggttcgggccgctgagaagcgtaataccctactcctgtgtttaggtggatctgtgtatgaagaagctacaaaagagctggagaaccagagagctcttactttctccctctctgatctttctggatccgaaaatcccccccttctaagtgggcaaggtcctccttttatacctcaaggggataccacatgcaccatctctctcttttttgtggggacttatcctatcttttcataaacagacggagacttgtatggttgtcgtccgaatgaccttctgatgggacagcccatacctacctccacttccgccggaatcaggcgcgacgtgggaaaatggctgtctgctgacgacatgaccagtgtcagaccggtcacaaatcggtcattcttgtccaccacgcgtcagtctataaatctgcatgttcgcccttcttcattcaatatcttgcttgtaatggttaggatgaagcctggcatatatctgaccggaaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaatcgcaataaatgtggttaggtgagccccgctatgctcacctaccccatatacgcggcgcaaaacccacaaggggtcggggcgcctcggccctcggggccgagacgggagcggtccaacccctcggggagacaaagagaagggcggtcgtatcaccctcgggcccgacccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggtgtgacgccacttcctaaggcctggtgacatggtggggccggtctaaaaatcgggacaatccggttcatttttcctggagatatggtgatggcgctttggttggcgagcgtaattaacgcgcgcacgagatgttccatctcgactgccacagccgcatgtccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcactcttaaacatctcttcctccggcgtcatggcacggggctccgctttgcttgatggtagcgtgctgccgccttcccgcatcgtgagcgagaggcaggccgggctgccgcgccgcttcatgccggaatctgccaccggccgggagatagttacgctgggcgagggacgcccagcgccatgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttgctgttccggtggttcttcaccgtacagtcggtgtcgccgccgtcggtggttggtggctgctacttccaaccgcgggggccggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgcctggcgggcctgcgatccctggggctcacaggggccatggtgtacggcgactatcttcgtcgccggatcgcgccactccagcggcgcacccggggtgcctgggagtacaccgggtccgaggactgtatgaggactcaccagggagtcagatgggactgggctcctgaggacttcaagatagtggtccaacgggtgctgaatctcagctccgtggaggcatccctcattcctcaaggagtcctccccctctgcagcgatccagaccgcgccttcatcctgaccattatgcaggcggtcggggcgtcggaggagcgggctcctcgaggccacgatggcgcgggcgggagccgcaggggggaacaatctaccccgggagggggtcgtgcttctgggccccgcgacaggggcccggggagcggccgccctgccgacgcccgggggaagaggaagcaggaaggaacccctcccccatctcctccccgagggggcggggcggcacgtgccagcagcaggcgcccggaggggccacgccgacgtcgcagcccgagggggagcggaagaagaaacggccccgcaagatgggggggacagaaccatctcggggaaaccttatttcccctccaaggtggtcgtttaaccgacctcctcgcaggttcgtcccacgcccatcgtggccgtattcattccctcaacgcgagttttcactcatccatcttgtttgtcttctggtctttcttctgtttcagcgagatcccgtcgcgtccctcccgccatcccaagtccggccagtctgcgaccacagaggctcggaggcgggaatctgaccggcgagaagccgcggatcgcctacgggaagccgaggaggccgcccaggtggccgtccgagctcgccaagctgaagaagccactcgggaggaggccagacttcgccaggccgaggagacgacatcctccgaggcgacccgtgaaactgaccggcaagaggccgcggatcgccttcgagaagccgaggaagctgctcaggtggtcgtccgagctggccaagctgaagaagccgctcgggaggaggccagacttcgccaggccgaggcgacgacgacttccgaagcagctcgcgacgaggccgcgggcgcatcgctcgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaacctcttctgcaggccttggccgtcgctaacaccacggtgttggacgggttaagtgcccagatggaggccttgcaagcagagcgggtggagctcgacgccgcatgggcacgtgtcgaagaggggcgccgctcggtggaggccatggtggaggtgggccgcaaggcacaccgccggcacgtctcagagctcgaagttcgtcagaaggtgctgggggagatcgccaaggaggtggaggaggagcggggggctgccctcatcgccaccaccatgatgaacgaggcgcaggacaccctccgccttcaatacgggagctgggaggcggagttagggaaaaagctcgacgccgcccggggggtccttgacgctgccgctgcccgagaacggcgggcggcggagaccgaggtggcatcccggcggcgcgaagaagcccttgaggcccgtgccatggcgctagaagagcgtgcctgcgccgtggagagggacctggcggatcgcgaggccgtcgttgctattcgggaggtcacactggcggtgcacgaagccgcctgtgccgaagaagagtccgcgctccgcctccgcgaggacgcgctcaccgagcgggagcgagctctcgaggaggccgaggccgcgtcgcaacggctggtggacagcctgtccctccgcgaggctgcgcaagaggaacaagcgcgccgtaatctggaaggtgcccgcgccgagagggccgcgctgaaccagcgggccgctgagctcgaggcgcgggaggagctggacgcgagggcgcgcagctgcggggcggccgcgggcgaaagcgacttaaccgcccgcctcgcagctgccgaacacaccatcgccgatttgcagggcgcgctagactcgtccgccggggaggttgagccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctctcggagatagccgggactctccaacggctccccgaggagctcgagaggacgattaagtcatcctcgagggatctcgcccgaggagcggtggagctcgtactggcgagttaccaagccagggatcccgacttctccccatggacggcgctggacgagttccctcccgggaccgaggatggcgcgcgcacgcaggtccgggacgccgccgaccatattgtccacagcttcgagggttcggcccctcggctcgcgtttgccctcaacttcgacgaggaggacgatgacggcggagtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagagaaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctacttcaagtcaagatccttcaaaaggaaacaacagcacagatacaacctttaggaaatcgaaaatgcttttattgaaatacagatataagagaaataagaatatgcatatgtggtagcccccggccaaccttgcacgcccgaggggggtgcggggttggcccgagcccgaaacctgacacccgatccccttttaggggtagaagcgacgaaggtgttcgatgttccacgggttaggcaactctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccaccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctctacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggatccgcattcgccttcatggatatcagcaagaagctcgacgccttgttcccgaggaatgcatttcaggaggattccgttagccgcgcgccgatagagggtcccttctaccagcacatagcgtttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcttcgggggcctgtcaggcgcgtccgtctcccctaaggggtcgggtcgcgccgacggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagcagccaccctgagtcccgcaaggagtccctcgtactctgccatattattggtcgcccgaaagtcaaggcgaactaaatatctgaggacgtctccgctcggcgaggtcaacgtgacccccgcaccggcgccctgaagagacagggagccgtcgaactgcatcacccagtgggcggtgtgaggcagctgtgaggggcccgagctgacctcggggactgagacgggctcgggagctggggtccactctgccacaaaatcggcgagggcctggctcttgatagcgtgacgtggttcaaagtgcaaatcaaactcagaaagttcgattgcccatttcaccacccgtccagtaccctctcgattatgcaggatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggtgctctttgtccaagcggcctcgcggggtgcactcgtcttctgtgccgacgacctcggggccggaggacgacaggggcggccttcccacagtggcctcgaggccgtcctgggggtcgggggctcttggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcctgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctacgcttgttgggggggcgcatccgctctatagttcgtatcttctcaaggttggcctcgatgcttcgggcagagaccaaaaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtgcgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcaccagccactccggatggatgacctcgcggatgaatccggcttccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgtcggtctccatgcgaagacgtcagcgtttgcccgcaggaaagagacgcgcgtcttcctatttgtcgtccagaagaccaccgatccgtgtggtcttggacgggccgtcgcccagggcaacctccttgaccgggacctcgtcgcatgtgactatccgctgcctcggggcagcgggggcggaggtgccaagcctctcgtcgcctccctcgggcttggacgcggcggtgaggtggtccgcgcgctgctccatacaagcaagcgcgactttgaggtcgccatggacagagttggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctgggacggccggagcaccatccctggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaagcctaggtcatcatcgccgtcatcgatgtcctcggcgggggccttctgcttggcctcacttcgccgattgccggaaggaaccgccggggacttgccctcttggcgctcctgcctcctctcctcctcccacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggccttccctttcgggtggcccgcgaagcgccctcgacggcgaggacatgaccctcgtcgtcggaatgggctgacctcttcttcctcctcctgtcacgccgccctgtccgagcagcggatccggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatagtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaaaaaatttgccatgaccctgtcgtcacccccggcggcctcgatcccggtcgtgtagacctggagaaactcggcggggttgacgctcccgtcatatttttcggtgatggtgggccggaaccttgggggccaacggacgttccgaaggctcgcatgaaggctctacagccgacaccaccaaccgggggcacggagggctgatccccgcgtccgtgttgatgtgacactctggacgaggaggcgccctccgttgcgtgggcagcacgccggccattacgccggcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagtgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagtgcgccctggggcgtgctgccgtcgccgtagacgaggaggcgacgctccccatctcgccgcccttccctatcacccgtggatgtcgaagtcgcggatccttcgaccctctcgagcgcctcctcccgcctaggactttggcgtggagggggcggtggagtacgagctcgacggcgtgggttctgctccccgtcgtcaccgctaacactcggagagaggttgtgcgcctttgcttgttcggccattgggctgaacaggaaaagcttggcgcacacgaaagaatgcgagagcttagaaaaacacacgcaaagccccctacctggcgcgccagatgacggagcgtggggctcctcaccgggagaccgcacaggcccccctttgccggttcggccgggggccctgggtgagattctaagctcctggtctgagtgtggaaggttcgcgagagtggaaacacacaagacacgggcgatgtatacaggttcgggccgctgagaagcgtaataccctacttctgtgtttaggtggatctgtgtatgaagaagctacaaaagagctggagaaccagagagctcttactttctccctctctgatctttctggatccgaaaatccccccttctaagtgggcaaggtcctccttttatacctcaaggggataccacatgcaccatctctctcttttttgtggggacttatcctatcttttcataaacagacggagacttgtatggttgtcgtccgaatgaccttctgatgggacagcccatacctacctccacttccgccggaagcaggcgcgacgtgggaaaatggctgtctgctgacgacatgaccagtgtcagaccggtcacaaatcggtcattcttgtccaccacgcgtcagtctataaatctgcatgttcgcccttcttcattcaatatcttgcctgtaatggttaggatgaagcctggcatatatctgaccggaacctgcttgccatctccagtatctaacacacttgctcctggtcgggcccactgcttgacaggctctcattctgacgggatggggctaggtgtgcgtcagaccgcctgtcgccacctaacccacgatctgatcggtctgtgactggtcactgaccggataaacgagcgcgttgcactgcgttacatgcggcgtgacgcgctcgaccaaaccgcaataaatgtggttaggtgagccccgctatgctcacctaccccatatacgcggcgcaaaacccacaaggggtcggggcgcctcggccctcggggccgagacgggagcggtccaacccctcggggagataaagagaagggcggtcgtatcaccctcgggcccgacccccccccccgagggggttaggccacgtgggtgatcgtgtctgcctcaagtctctaagtcatgatactcccggtcccatgtcaccgacaaacaggcggataaaacctttttgaccggggtgatgggtggttctgtgtgaacctggttaggtggtaatgtatctgtgtgatcgttgccgggtacggtctctgtgtgagcctactgttgagctgtgtgctattgtagtttggcaagttgtcttggtcaattaaggacttcacttcataagtcatggatctgagcctaacgtgcaaccacatgttctcatgggaagaacctggcccagtaggattccgagtcttggcactgtcggcccaggtggctagatgataggagtttaggttcgccatggggactttcttgtctgtgtgagggaaaggtgtctcatgggggaaggcagtgttgggacgaagtttctaaaaagccttgttacagactccttggccacacacaacctgaagtgtgacacttgcgcatggccgttaaaaggacgatgtatcttgtgggtcaagctgcacaacctttgcagagtgttaattaatctattcgaatagtcgcgtccgcggtcatggacatgctcggtgatatctcatgaggggtagtttgtgaaaactgggaatgaactgtgtgcaggttaatgaatatagctatgtggtcctgtgtggacgaatcctgtgtgaatggatagttggtaatactgttatttacaactattgttttaaacctgtttataaattgtttataactgcaaattgttgtgttatgcaaaatagccattttctttgttgtcagcttgcatatgcatatttctgtgtgcttgctgagtattccatgtactcaccttgcaatttcccccaattccagaagaaaggttcccgctgtttcctgaggagtttgttgctgaagacgaggaataggtcgtgagtcctagttgactgcctgtggcaagttgaatggagctactacgcatttatcttatttccgctgctactttaatattttccttaggcccttcgtggcagaataaatgtaaactttagccataaggtttatcacagtcattattaatattaaatattaggtttcctttgtgatattggctgtgatattatctttgtgtctgtgtgtgctagcttgatcctggactagcacttatacacaggaggtcctattttgggtcctcacacacccgtccgctggctcaacgcccagccggccaagtccgtcgtggagcggtgggcggagcaacggcgacgagtggcgggcggaggaccgagggcggagcagaggggcggtttggtgaagcgacgacgggcggcgggtggcgtggcgagagcgctgcgagggaggaggcgagctcgtcggggcggccggcgggagaagagccagctgcgcgccggccgatgggagggagggagaggagcgggggtcagtagccggcgggagtcggtggtgcgtaggggtcaacgcccggcggaggtggcccgtagaagaaaattctaaagaagaaggcccccgccaaccccggcctcacccccgtaaccccttcacccccgatgcccagcagaacgggccccccctcctcgctcggcgccgagcgccgcctccctcctcgcccggccaccgacgtcctcgatggtcacatccgggttggagccctccctcctttcccggtcgccgagtgcgccttcctcctcgcctggccgccaccgccgacgtcctcgatggtcacatccgggtcggagccctccctcctcgcccggtcgatgagcgccgcctccctcctcgcccggtcgacgagtgccgcctccctcctcgcccggtcgacgagcgctgcctccctccttgcccggccgccgcgcgccgcctccctgctcgcccggccgcctcgagcggcccctcctctcgcccggccgccgcgcgccgcctccctcctctcctggccaccgcaagctacccgtcctcgcctggccgtcgcgtgcctctctgcccaccgccccccgctgcgccgccgctcaccgttctgtaagggagagagaggggggatagagagtagaggaaaaaaaattgaaaatatacctctttttcattggttttgtacaaatacgctcatttagaaaatatttacagaaatataccattgtcgtgaaatgaaagcgcgaaatcgtgcgttactgcacgatgtcgcgcgaggtgtgcgcgaaaccgctcggtctcgcaccgcgacttcgcttacctaacccgcgtactctcgctatcaataaattaattagtgtaattagcaattaattaattacaattactcctttaactaacatcattagtaattaattaatcgttaatcacccgttaatcgtccactgatcatgagtcatatcaggccatctcgcaaggtgatgaagcgagaccgccggtctcgcgacctgctgttgcgataccgtggcggatgcggcggaatcgcgccatgattctgcgagaccgtgacgaagtgtcccgttgtcgtcattttcgcttaacggcttagcgatatattagcgatatatcgtttcgatttcgctctttcaatcagcgacgacgatatatttgtgctaaaaattttacatctcgaatatttataaaataaataaataaataatatactttcaaatttaattcgagagtagagggggctgacatgtgggaccacatatgccccaccttttcttattatttttgtgtagctgacttgtgggtcccacattttttattatttcctgagatccaattgccacgtaagcgccacgtcaatgccacgtgggacgaggaccaagacaaagggagccacgtaggcgccacgtcatccaaaaccgggcacaatactgctgagagacctcttttgcacggttttgtaagttgagggacccgtcatacctggttttgcgaccgagggatgaaaatcggactggacgacaaatagagggaccaaatgtgaacttattccattttaaaaaacgagccaagcgtgctagtcacaactttttatttccagcctagtcaccatctaagctaccgggccggagcccatggcacaaaactaggcacgtgtttaagcctagcccagaaagcatagcacattagcacacgagcatagtcatactagtactagcaggtacgagacgcggaagaaaattacacaagactgaggtcctacagtcctccgaaagacctcgtccctctacatatgacacctgtccactacgaatctcaaagtaggcagcctctgtcttcttcctatctccccaatctcctgtgttctgccgttcttcctcaacacgaccaagtagagcttacgcacgaccaacgcacgcggtggcggccgccggtgtcgagcggcaacactcacccagccaattgacaattcgatgttgactaatggggaacgaggttatattgcgctttgcggtcaaaatccatatatggtaagaggcgatttattaaggggagatggattttatccgagcatttgatgattcttttggacagtgaaccttggaaaatcacatcgttgtctgctttctcatcaagaggcttggtgtacatcaactcccgaatacatattgtggagcggaccaacggagttcacacgctacagcaaacatgatgcaagccgactggcagcggcagttgagcacgatgtcatcgtcgcactctcccgacagtcatccatgagcccgaagccactcgccgtcgcgcccgctttggtcgggttcgagggatgcctcaccgagcggaggaagaagaatggggattagaggggagagaggttgtctctttgagattcgtaatggacacttgtcacgtaaggggacgaagtcctttagatgagtgtaggacttcagtcctatgtaattttcttccacgagacgctccaactgtccaagcagaagtcgtcttctcgcgagaaaaacactgaaaaactgatgacgcgagtacactcgtcgagcggttagcgacggagccctgcagcgtcgacacgcgttccaccacgcaccccacggacgtgtcggccgccagaagctccggctcgcctgtatttagcacgtacgacgacgagcgatcccactcctaacacagtacagcgacgacgacagattaaccgagagcgatcgatcaaccaaatcagaatcagggcaagaaacaatggcgcagctggtggacaaggcgaaggggttcgtggcggacaaggtggcgcgggtggagaagccggaggcggagctggccgagctgtcgttccagagcgtgggccgcggcggcgccaccctcgcggggcgcgtggacgtgcgcaacccctactcccactccatcccgatctgcgaggtgagctactcgctgaagagcgccgggagggaggtggcgtcggggacgatgcccgacccggggtcgctcaccgccggcgacaccacgcggctggacatcccggtgaaggtgccgtacgacttcctggtgagcctcgccagggacgccggcagggactgggacatcgactacgagatgagggtcggcctcaccgtcgacctccccatcctcggcaacttcaccctgccgctcaccaagtccggcgagctcaagctccccaccctctccgacgtcttctaaatcggcatcgtgcacacgtacgggccgagtgtacgagaacttgtgtatttccagacttctggagtaataataaagaacacgagtggttggttaatcgcgaatcgtatgcgcggtgtctgtaacgtacgtttatgtgtggacgttatgctacggcgccatatgtccatatgcgtgccgacgcgcgggccgggggccataggcggctaaatcaagtaattagtcaaccgcggcgatttggtgagatcgctccttaaaggctcgcgccatattgcccacatgcgttccaccaggccacgaggctcacgagcaaacgacgcgcccggcaacggcacgatcgcccatgagcgcgctcgccctgccgtgctgcggtgtacccatgccgctcatgcgattgggatttgagagaggttcggagttatttagaggagctcaatattatgagaaaagctgttatttgagaagctgttagcctctagttttaagaggatctggaaaagccggattgtacttccttcttcacagattgatcattatatgatagaatttaaattttttcacagattaatcattatatgatagaatttaaatttttttaaattgatcatcatgtaaccatattgaaaacggattttatcgaaatataattaatggacacgaattttattgtaatacaattaatacatcataggagaatatatatatatgtgctaggatgtataattggcatggtgttttatcgatttttttaggatgtataattggcatggtgttttatcgatttttttaggagaatgtgtgtatggtgtcttagttaatgcgatttaaattattattggtcttagtgaataaatatatatgatgatcgttttggacggagtaagtattaactaaactttttcagcttttgtcttttaattctacattttataactgtcgcttctcaactgacaggagctcctctaaatatgccatatgttttcgaaattccaaatattttttctgcaaacaaagtagaaaaataaacgcttacaacacacacgctcgcgcacttatgtttataaatgcacatcatatcgctatgtgcactttcgaaagattagacaatcctattttaagattaacgaacatagacaaagttatcacaatcgactgttaaaaaaataactaatcgtaaataggaacactcatattattaaataggggctcatgttaaatccgaccaatcactgagcaagttctatcataagaaatctaaccatttaagcacttgagttacgctcgattataatatataaaaagtaaaacttttactctaaaataaaataaattcaccttttgtaaaaataaacttaatgtgagattagagtagttgatatttaagtttgaagtattttagaaattacggatggtcagaagtttaattatttaattaatctcaaactcgtactaagcgttacaagtacggaaccggagggtagtaggatgaacatttattaattagtgtttattattgtctattgatggtaaatattgcactaaaaaaaagagaagtatgttcctaacctgagcattgaaatttcgtaatataataagaaaactaattgtaaaatttcaaatttatctggcattttactttccggtcataatggaagttcgaaaataatttgaactttctaagtatatttgcacgctttgcgtttcatgcaagggcacccaataaccttaaaatctattttttctctttcaagtacagaaaacttactttgttgcatgtttatactcatttcaaattataatcagttggaatttgaaaccaaaagtttcggttgcgttgatagtctccgtaggtactagtaatacgcgaaacggtggggctgggagcacttttatagcactgtaaaagaactcacacatctttatcgtttcattagtttttttactaatcatgtccgcagagcaaaactagagaggcagcggaaaatttaattatttgctacttttccgtttggtaattagccaaatacctttttaggtttacacttatgaatttaccattggagagagaagcttttgtaattttttttcactttttttcactgtagagtgccacggccggtacatgtgcatgccaacatggaaccttcgcaaaaaaatgactaatctacccatgctagctagcaaacatgtgcatctaagtcataattccttaactggaaaaattccaaaaaaaatcggcaacctgtccaattttcccattttaaatttgcaaggcaacaagatcaatggccccattccggtacatcagttcattaacttttttaatcaacctaaatctctgtagcaccatgccaacaatgccagccaaattaaataccgctcttaatcttagtcacaaccatccagtggatctatttcttcaaatattgattcgttgtccgacttggaggtacttgatctttcatacaaggaccaccaattgagcaggttgtcgctcgaatcttcaatggccacctcataaacagtgaacaacatccatacctctgccatagattttgcgaaagcaattttatcctaataccgttcctgattcagcctataccacaaccaattgctagcagggtagattggtcatttcatgtgcctgtccatgctggcatgcatgtgtggtgctacacagtgcagaaagtggtaaaatattacaaaatcttctctctccaatggtaaattcttaagtgcaaacctaaaaaagatatttaactaatcatcaaacgtaaaaatgttaaatagttaaattaccaggcaacaactatgataagcaaaggtaaaatctaaaccgataacactttcggtttagtcttaattaaagagcgacggacacatacgtaagagaactactaatacacgtctatcatgtctagttgctaccagtacacccaacaatgcatgcctttctttcttcttatagaattctcttttaaattacttatccgatctataattcgattacactattatattcattgcaattaaatctttataacaaaatcttacaagactatattatgatgaaaaatatttatgttgtaaattactattattatatatattagttatttttatcatatatatatatatatatatatatatatatatatatatatatatatatatatatatatatatattatattttattaaactactttttagatattcagtgcatgatcagtgtactttataggttagttttataatatgttgattaaatttaatttctagatagacttatgtttttatcccccataatagatttacttttgatgtcgtgacaagttacttttataatatatgtaaattttttataatatatgtaaattatttttaggttttattgaatttaattttatatgaccaagaagtaatttaataaaatctaaaagttatttagatatattataaaagtaatttgtaacttttcataaaaaatataataatgtaagatcttgttataaaaatttaattgttacgaacacaatgatgtaatcggatcgtaaatcagatgagtaatttaagagaaaactttataagatgaaaaataaacatacactgttaagtgtactagtagtaacctgatcgctggttatgacaatctaacatacaacaccatcttaatcatgtccataaataaaagaacaagactatatagctagtggccatctatgagagcaaaaataaccccagtaccccacacgaaacccacgtgccttcagtatctctccgccacccgacagagtccactctccactgtccatagctgccttcgcctgagttcgactaggatacatttgcaccatatagtatcattcaccaactcgaatcaacacacactagacacgcatctaatttgcacttaagtaatccgatcggtatctgcatgcgcctgatctccacgttgcgctgcatgaaacgcgtgacgtgaacaggccagctacccgggatctctcatgacgatcgacaggtcaggtcggatccgtattaatcttcgctccaaatatttaccagttgtaggggtaggtttcccactgcatgtcaaatatatatgtcattgctgacacgatctaattaatttgtccatgtcacgctaaactaaacaagcgtctgcgatttttacggcgaaatttggagtaattaagtaaaaacattttggcttgttgctataatgcatcgagctcaatctcaaagtttcagagtcctgtcagttatcaccacgaggggttagttagctgtccatgtttgcacgcgtcccgactgatcattaaaaaaatatttcttgttaaagatggaaagggaagcaagtatagtaatgacctggaatctgattgccttgcttgatttggagatgtcgagtcagcatggtctcatggattattcccggacaagtgaagatcagatctgatgtgaactcttcttttcgaacaaaacgatgggaactggcctgctaccactatttttttcctggaatgggacgatatgagtctcagctggcgctccattatttgctagaacagtgatcgatgcgatcacagcttgggctacgggctccaaccatgtcaccaaccaaatactgcctccgtcccatcccaaaataagtagagccgtaggtgcagaacgttcaaacgttaaacacaaacaatacaaatctacacttatttattttagaatagagaaagtagtactcaacaataagagaaaaacgatctttttttaaaaaaaagctaaattgattatttgtctgatgattgtttggacacctagaaattatccatatgaaatctaattgcgtcgttgatgccactacattttattcgtaagataacctagttatgcttctaaactagctcacaaccaatgaacaaagcctataatattacaagctttaacttttaagggtgatggatcgagcgcgtgaagtacgagtaactgtccacctttgcatggaaggtggcaccactgagcatcccaacctcatcgataaccagtaaggggaagttttatagtggatgtgaaatttagttcacatcatcaactcattaattataagagacaatatatataaaacaaattacctctaacacatttgccccaatacatcatattaatttactttatttgtttcctatcaattcattggtctcttgttctcatctctcttggagtttgtgtagagattgccccttgcatgagaggtggcaccttctctcacacctttcatatatctcttccacgtcatcacgtgagcttacatggaacctgaggacaagtgtgtagaggcttataatacttgccctaagaacgtcactgctcttttcaagcggcgaatcttctctttcattggtcaattcgctaagccaaagcctcattaccaccgctttgtgagataaccttttaccctcgcttccttttcttctctcctgacctataatattagttagtcttcgttgcctcgccatgtccccttttgcccaacttttcttcacacttgaccggagatggacttttttttccctcgaggggacatccactcgttttgtacataacgtttaaaatatcatcaaaaaaatttgtcaataattgttaatatagatcattatatgatatatctttgcacaaacatgcaagttaaattttgacctataaaatttgaaacaaaaataacaaatttgaccatgaattacgtatttcatagtcaaatttgatatttttgtttctacttgtataagttgaatttgaacatgtatgtttatggagtgatatatcacatactgatctatcttacttttttttcaaattttttgatgactttttaagagatatgtaaaaatgagaggatatcctcttaagggatgattagagtttccccacttgacctatgcccacaacttctttttcttctcccttgaccttaccccttttgcctttcccttaacctctggacaactagatccaatcatcataaatttctctttgttggaaaacaacatagagtagagctaacggtgaggacaattctcatcatgtcaagtcgaagaggatttgaaaggggaacatgatgatggcatacctaagaaatccttaggggcaaaagatctaataatttgccaaatacaagcatcttgttaaaagcaaaataactatgcagcatttggtaggaaaatctaggagtgactatttttccataagataaaacctaggtaagcacataagtgacccttactcttagggattgtattttcataccaatcttgatgattccacttaatttttgaaattatatgggatgaaggcacatccatatttctcttttgttgatgccgacccgatttaaatgatcaaacacatccagctatcatcattttcaaatcataatggtatctagggccataagcgaaaatggtatattttcactggccattgatcgttggcggtagcattggctgtttaagaaaacttaaaatgtatgtcagaaaaagtccattttgtagtagtgtcttccattttccttccccctcagctgcacaccatgcacgatggctcaatgcctccactagggttaaaagtcgatttaacttttcagaaacttttagtcgattggtaaatactcactctgtttcatattataactcgtttgacttttttctagccaattttttttaagttttatcaagtttatagaaaaacttaacaacatttaaaatataaaaactgtttcattaaatctaatattgaatatagtttggtaatatgtttattttatgttgaaaataatactatatttttctataaatttgatcaaacttaaagaagtttgactagaaaaaaattcaaacgacttataatataaaacggagggagcagcaaaatgaacggcctcgacatcatataaccccagcacttcccacgcctctataaaattttagttttcttgacgtggatcacgcgagctcaaattattgacacattctagaccaggagtacttttgctatatatatatatatatatatatatatatatatatatatatatatatatatatg

SEQ ID NO: 75237 - DNA, 11193 bp, Oryza sativa
ggtcggcgggtttgaagccgagccggaccgacggggcgcctcgccgctttccccccccccttgtgacgctgcccggtgggtcccgcttgccagccgccccctctccctctctcctgtgcctctgacccgcgggtcccgcgtgtcggcgccacccctccttgtgctgacgtcagccctgggatgaattattgcgcaataaattgattaagggtttttcttttatagtaataaacacatataatcttctaaaaatcataactaattcaccctaaccaacgacaaatgggagaagatcaccttccgttccccagcgtcgcagaagtccgtagcgagtctgaatcaggctgctattgagggtcagacagaaacagtggagaaaagtcccaggaagttggaggatattcctatagtacaagaatatcctgaggtatttcctaaagacctcactacaatgccaccgaagagagaaatcgagttccgaattgatctggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgtgttgattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcaccactcggtatgggttgtttgagtgcacggttatgtcctttggactcaccaatgcaccgactttcttcatgaacttgatgaacaaagtgtttatggagtttcttgacaagtttgtcgtggtattcattgacgacatacttatttattcaaaatcagaagaggaacatgagcatcatcttcgtctggtactcgagaaattgaaggagcaccagttatatgccaagtttagcaagtgtgacttctggttatcggaggtcaaatttctgggtcacgtcatttctgctcaaggcgtggcagtggatccatcaaatgtggaatcagttacaaagtggaccccaccaaagacagtttcttagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttctaattttgccagatcagacaaaagacttccaagtctactgtgatgcatctcgccaagggttgggatgtgtgttgatgcaagaaggcagagtggtcgcatacgcttcgcgacagttgcgtccacacgagaccaattatcccactcatgaccttgagttagcagcagtggttcatgctctgaaaatctggcggcactatcttattggcaaccgctgtgaagtatacactgatcacaagagtctgaagtacatcttcactcagcctgacttgaatctccgacagcgaagatggctagagttaattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgaggagagaaatagctgaattcgtcgcactctgcgatgtttgccaacgggtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctacctctcgagaatcatgtgtctacatggggtacccaaaaagattgtatctgatcgagggagtcagttcacttcaaaattttggcagaaactgcaagaagaattggggactcgtttgaatttcagcacggcttatcatccgcaaacagatggtcagaccgagcgagtaaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtgttaaccgaagcagaggagaaagtcaggaccgtcagggaaagactgcgaatcgcccagtctcggcaaaagagttatgctgataaccgccgaagagagcttacttttgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagctagagcttccacctaatatggttggtatccacgatgtgtttcatgtgtctcaactgaagaagtgtttgagggtacctgaggaacaagctagctcagagcacattgacatccaagaagatttgacctacgtggagatgccaattcgtatcctggaaaccagcgagagaaggaccagaaacaaagtaatcagattttgcaaagttcagtggagccaccactaagaggaagaggccacctgggaaagagaaaatgaattaaaggccgcccatccgcacctcttcgccagctcttccgaatctcggggtcgagattccgtttaaggggggtaggtttgtcgcgcccagaagttcttttccctagcaaaaattcaattaataaatggttggaagaaattatttctttagaggcaagagagaaaccctaaattaataaatgcaaataataatcggaatcggcatgtggaatttttcttggattctacatgtcaaaatatgctaacaggatttttagtggaattttcagagcattggaaataattttaaccaattaaaataagcaaagtgcaatattaaatccctgggaaaatcctttttccttttatcttttcttttccctcctttttccttttcttgggccgccggcccatttcctcccgcgccggcccgctcctccctcccactcccgaagttcacccggcctccctctccctctcgggcgctgacaggtggggcccacctgtcagccctttccctaacctccggccgcccacgcccgcgccaaccgccgtcgaaaccaccgcccacgccgccgcgtatcccgctgctcccgcgcccactccgcccgtaccgcacgcccacgtcgccgcccactttccccgcacctcccgccagctcgcgcgcccgcaaacggcgggggatttgaaatttcccccactctctctctcctcctccacctcctccactactccggggaaattgcgccgttcccggccacgactcgccgccccccctcctatttaagcacgcccgcaccttcctctctctttttcctttctcggccgagccctcccgagctctccatcgctcccgcgcctctcatcccgccttccgccgctcgccgccacgctccggccgcactccgccaccgctagagccgtcgccgcaccgcgccgacgacgccgccgggttcgccagcttgtgcgccaccccgtccgccgtttccccggtcaatcccgccgccggagcttgcttctcctcgcgcgtcggtgagtaccccatggccgccgccttcgaccggcgaatccgctcgctgttaaccacccctctccctctaatacctcccatcttgttccctaggaggtctcggagctcgtccgcctatcgtcgccgttccccggtcgctcgccgtcgccgttcgccgtcgtcttccccccccacgccggccaactcgcggtgaggcgcccctccccctcttttccccttcctctccctcctagcgccgtgccgggccgagccgccgcttcggctgtgtgccgccgcctttgcgccgccgtcatccgccgtcgcttcccgcgcctccggttgccgtcgccggcgaccgtgcgtgcgcggcaccgccctcgccataaccggtcggccggtttgaagccgagccggaccgaccgggcgcctcgccgctttccccccccccttgtgacgctgcccggtgggtcccgcttgccagccgccccctctccctctctcctgtgcctctgacccgcgggtcccgcgtgtcggcgccacccctccttgtgctgacgtcagccctgggatgaattattgcgcaataaattgattaagggtttttcttttatagtaataaacacatataatcttctaaaaatcataactaattcatccgagctccgattaaatccattcaagtctcagtaaattcataaaaatgtgtagaatccattaaaaatggttttgtttcctgttacagtagtcttatagcatgttttgcttgtgtgctttgtttgtcgcgtagatttcggccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaagcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagagggttatgcgaagggtcctgacacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctttttccgttgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacactgtctgctgacgacatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggagctaacatgccggttccggctagggacgagtgcttggaggctctcgtcctgacgggatggggcgaggcgtgcgtcagaccgcctgtcgccacctaacccacgatctgaccggtctgtgaccggtcacagaccggataaacgagcgcgctgcactgcgttacatgcggcgtgacgcgctcgtccaaaccgcaataaatgtggttaagtgagccccgctatgctcacctaccccatatacgcggcgcaaaacccacaaggggtcggggcacctcggccctcggggccgaggcggtagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcactgacagtagcccccggcgttatgccaaggcgatcgctctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctcaactgccacagccgcatatccacttcatgcaccgcaaacgggcgaatgggattagtggaagcgtgggcgcgagaaacgagggagcgagatagtggacgcgagaagcgaggagccgggcgcagcgttggcaagggtataaagacgccgaggaagagatttgcttccttcctctcgccattattccccttgtcttcgccgcttgcgccctaactccttgtttcctgtgccctaccttcgccacacgcgctcgctcttaaacttctcttcctccggcgtcatggcacggggctccgctttgcttgatggtagcgtgctgccgccttcccgcatcgtgagtgagaggcaggccgggctgccgcgccgcttcatgccggaatctgccaccggccgggagatagttacgctgggcgagggacgcccggcgccatgctacccggggcggtccgtcttcttcctcccttttgcaatggcagggctggttccgccattttcttctttcttcatggatgttctggagttttacgatctccagatggcgcacctcaccctcaacgcggtaatgacattggccatcttcgcgcacctgtgcgagatgttcatcggggtgcgcccaccccttcggctgttccggtggttcttcactgtacagccggtgtcgccgccgtcggtggttggtggttgctacttccagccgcggggccggtgttgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgtctggcgggcctgcgatccctggggctcataggggccatggtgtacggcgactaccttcgtcgccggattgcgccgctccagcggcgcgtccggggcgcctgggagtacaccggatccgaagactacatgaggacccaccagggagtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcatcggaggagcgggctcctcgaggccacgatggcgcgggcgggagccgcaggggggaacgatctaccccgggagggggtcgtgcttctgggccccgcgacgggggcccggggagcggccgccctgccgacgcccgggggaagaggaagcaggaaggaacccctcccccatctcctccccgagggggcggggcggcgcgtaccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgtccccctcgcaggttcgtcccacgcccatcgtggccgtattcattccctcaacgcgagttttcactcatccatcttgtttgtcttctggtctttcttctgtttcagcgagatctcgtcgcgtccctcctgccattccaagtccggccagtctgaggccgaggacccggcgaccacagaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcgacgacttccgaggcagctcgcgacgaggccgcgggcgcatcgcttgggcccattccctcgggcgacgctcaggacaagccaggtctgggggacatccctgagtccggcacgttcatcggcgggccgagccgcgcggcatcctcaccgaggcggctcttccccacgccttccgttgctccactgagcgcagaaccccttctgcaggccttggccgtcgcaaacaccacggtgttggacgggttaagtgcccaggtggagaccctgcaagcagagcgggcggagcttgacgccgcatgggcgcgtgtcgaagaggggcgacgctcggtggaggccatggtggaggtgggccgcaaggcacaccgccggcacgtctcaaagctcgaagcccgtcggaaggtgctgggggagatcgccaaggaggtggagaaggagcggggggctgccctcatcgccaccaccgtgatgaacgaggcgcaggacaccctccgccttcaatacgggagctgggaggcggagctagggaaaaagctcgactccgcccggggggtccttgacgctgccgctgcccaagaacggcggacgccggagaccgaggcggcgtctcgccggcgcgaagaggccctggaggctcgtgccatggcgctggaagagcgcgccggcgtcgtggagagggacctggcggaccgcgagcccgccgttgccatccgggaggtaacgctggcggcgcacgaggccgcctgcgccgaggaggagtgcgcactccgcctccgcgaggacgcgctcaccgatcgggagcgagctcttgaggaggccgaggccacggcgcaacggctggcggagagcgcgtccctccgtgaggctgtgctagaggaacaagcgcgccgcaatttggaaggtgcccgcgccgagaaggccgcactgaaccagcgggccgctgaactcgaggcgcaggcaaaggagctggacgcgagggcgcgcagcggcggtgcgggcacgggcgaaagcgacttagccgcccgcctcgcagctgccgaacacaccattgccgatctgcagggcgcgctagactcgtccgccggggaggtcgaggccctccgtttggcaggcgacgtagggcccggcatgcttcgggacgccgtctcccgtctagatcacgccggccggcaggcaggcctctggggcgggcggactgtgaagtacgccgccaaccaggggggcctcgctcagcgcctttcggagatggtcgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgagaatggcgcgcgcgcgcaggtccgggacgccgccgaccatatcgtccacagcttcgagggttcggcccctcggctcgcgttcgccctcaactccgacgaggagggcgatgacggcggtgtgggcgacagtggcgacgaggctggcgacccgggtggatcggagtgagcccccaggcccccgccaatctttaaatagtttcttcttttcttcttccgaggccttcgggcctccttcttgtatagactaatttaatctgcaatcaaataaagaggaaattttttgtgtcaattctatttgttgtgtgtatgaggcgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgacggcaggattgaacacaagtgacctatttcaagtcaaaatccttcaaaaggaaacaacagcacagatacagcctttaggaaatcgaaaatgcttttattgaaatacagatataagagaaatagggggatcc

SEQ ID NO: 75238 - DNA, 7939 bp, Oryza sativa
agcccccttatccgatgatgtgaagaaaattcttgaagatatctcatcggctagaggcatcatcgttagacagcttagtggttgattgtggctcaattaggactcggctacatgaggttcaagctctgatcccagatgagctagccgatatccttactccggccgtatatctcgagcaacatcaattcaagctagagaaagccaagctgagactagctgaacgtcgggagcgcaaagatatcgaggctacaattcaagccaatcgacagcttgttcatgaagagaaggccaaacttgatcagctatctgagggcccgatcaaatctaatattgatcggctcgaaactcgtaagactgagctcttggcacaacttgaagaatgcaacgccgagctggacatggaacataaaaagctagccgatctcccaaattctgttgaagagcagaaggcaagactaaaatcggctatcaaaaatgttgctgatctgaccaagtttttaaaagtcatccctgtaaccgatgctcaaggtgcccatgccattgaagaagtagaaaaaatcaggcaaagagctatttcagctttccagcaatatttgtcttagtgatatcttatgtaataggtcttagaaatttttttgcaatcggctaagaaactctgactctttatgtaactcatctcaacaatctttaagccgatttaatatgaccccatatttggctcaaaaatatgcaatttttcatatatatatgtgccccccctaattttacaatgtcacaagcattgataaaattataaaagcggctaagggcgatacaacaatatcggccattatacatcggcaaaccataaccgattacaatatgaaaaacaactaagggcgatataacaaaggaggaactgattaaacggcttgctgattatcagtgatcaagggccgataattcgggaaagtacctccttgaagataaaccggtcccgtagtctgatagtcagctattgaaccatcaaccatcgacttcaccatgtttgacaaagtattgactaatatcccagattgattgatcaaagcatgatgtacggcatagtctacctgatcttggaagttattaaactgtagctgtgctgcgttactaacttggttaagattagcacctttaaatccctgagaaccatcaccttgaactccttgagagccaataccttgaactccttgagagccatcaccttggtctcattgaaaaccatctgcagcacctttatcagtcggttgagccgagccatctagagcttgtttcacttctccatccttagaagaaccggtcccaggaacatcagcaactacctttactttgtacttctgaactaatgttcccttgcgagtctccgtgaatgagctcaagaactgattccgtgcttactgcatcattgtatcaagatctttttgctgctcaagtgtcaatttatcaaaagtgatgggcacaatgttggcttcatcaatctcagatagacccagcttcaggatcttttctttaacagagccaggaccagccgaggacggcgatgctactagtttctcggccatgaggaaagctgctgttgtgattctgacttctgataggtcccaccaggcgtgccaaaagcgtgttgacgtaaaacacgaggcctgggagatctgcttaactctagtgcaggtccaaaactcgccttcgggtatgctagcgtaccagttgatttgatcctgcaatcaacaagaaacaaggacaaagaaaccgtggttaaatccataaacgatagccgatcggctaggtgccgatgacatattatttatctttgagccgatgtcatatatgcatcgatcggcaagtatcaataaataaaacagaactaaatctactcgatcggctgtagatattaacgatatatgatccttatatcgatatatacttaaaaccaagtgattgggatagatcggtcgccatgccgagacagtataaatcacttagatcgaaatatatattaataatgagattatatatattcatagcatagccgatcagatagatctagcatgtatcgactaatactccgatacaactctatactaagatatcaaagcaaatagaatatatcaaacaaaagcctaatatacctaaatgcaacaagatcttaacataaagggcagatataacatatcaacgaagcatatagagtaaaactagttaaatcaggtaagatcggctgaaaccccgatgctaccctaatcgtcaaccagaaggcaggctagagattgatattctaagcacgacttaatagatcaaactcaactgatgcagcattaagtatgaaaaaaagaacaatatctagacaatcaagccactggatgcttcatagagtggtaaatatcctatataatctaagccaacgtcactatttaacctaatcggctgccttctaccaacagatgttagccgattgtaggttagataacaatattactgaagattatataagatatatgataactcgacaaattacataaacaagattagagtatcataaagatggaagcactaatcccgagaacgcaagctgccataacaagtttacctcttgttgaagatcgaaatcgatgcagctcaacccgaaagtaagaacttgtcgaaacaaaacgaaagtaaaaagagtggcgatgcgccgagattgtattgaacgtgtgttaaattgattacatggggctcggggtctatttatacccgagaattacaaaacatgtccgtatcggacacgactcttatctctaacaaactctaagataccataagtctttgcggcagacttttgcccgaatatatctctaaggaaattacataaaatatcctaattaatatatacaattgccttctcaagactctatccatgtgtggcaatcatcacgaagcacattaactcaacccgatgatgtataccgagtcgtattgtcggaatcggctgtatcagcttacccaatctgactcggactcagccgatcctgattgtagctgatttggattccagccgattcttactctgttcccgaatcgatcttcgtctttgattccgcttcgatctaatcttcatcttcgatactgacactggtggagaaaccctttgtagtcccggttcgtaacccccctttagtcccggtttccaaaccgggagtaccaatccgggactaaagatcgctatctttagtcccgggtgaaataaccgggagtaaaaatcgatctttagtcccggttggtaacaccaaccgggactaaagatcgagctaaccttttttttttgcatggccctgttgctgcatggtttatatatatatatatatatatatatatatatatatatatatatatatatatatatataaaccatgcatatatatgtttcaatacatatatatgcatacatatatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaatcgccgcgataaattccttgtgtgtggtcaggttatccctcatgcgaataaactatatgaatgtatgaaattgattagtaattaaacaagaaatcgctacgtaatgaaattttgaatttatttgtacatacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgtaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacatatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagaggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactagtttggactttccagaagatgctttcttcagcgttcgctcatagtccgatagcttgatggtctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagtggagcttgcgggggagtaggtgtaggagcacgaggaggagtcggtgcaggatcctgaggaggagtcgatgctggagcctgaggtggagacggtgctggcggagcatgaggaggagacggtgtaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcagaatggctaaatcttacctttattgataagttcttgaaaggaatatgcagctcacatggtgtccgctgagtgatgtcatcaacgggacaggtcgattcgtcctgtgtttgcatatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactggacgtccatcttcttccacttccgttatgatgtgccgaccctcaagcttcttcgctgcacctcgttgcccgggcctcttcgtccacgagggttgactatcactagcctcctcgtcgtggttcccttccacatccctttccacgtgcccttgttggttcccctccgcatccctctccacgttcccttcttggttcaagtactggtttggatcctcgtttccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgacataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtcatgtatgctaagtgtttcgggcgtatatgctaagtctaattaagactacaatagtcaattgctaggagtcgcaccaattccgtagtcaataatgtcatactaagtctaatttgcaataaaataatcttatattaaaact

SEQ ID NO: 75239 - DNA, 1756 bp, Oryza sativa
ttttatttatggtctttgagattttaaaaattgaacaaaattatcgtttgggtttattttttttactttctagaagtcccgccaaaccgtcagcggttgtgccattgtactcctctacagcttgctcgctgcctcccctcgttattgtcattgagattttaacatcagacatgattatcattgaggtttattttttactttttagaagtcccgccaaccgccgcgaacatgttgcttaatggcatgtccgccgtctctcattttaatcatcatcgagattctatttagggttttgttaatatttttagatgtctcatcaacagtcaacactcaactcaactgctttacaggtctgatcgaactgtcagcggcttcgctattatactcctctacgacccgtctgctgcctctcttctttaattttttttttcagattttattatctgaacatgattgttattagggtttattttttttactttctagaagtcccaccaaccgtcgtgaccatgctgcttaacggcatgctcatcgttcctcgtcttaatcattattgggattctatttaaagttttgtttatagttcttagatgtcccatcaatcaccagttcaccaccactctacttatttacaggcatattatcttccctctttattgttatttgtcatcgttgttttagagatggacttcttttttaaaaaaaattccatatttttttattccgatcttagttctttgtcatgctttatttgcttgctcaatctaccactacttttattcttcttggaacctttaaaaatttgaccacgtggtttttagtgtttctcgttgagttttgtttttataatttttaggagaccctcaactggcgccgccatactcctttacggttagcccattgcccttactatttattatcattaagattttaaaaatcgaacctgccattaccctattcctttgccacccctccacttgccctcttaaaaatataatatgattactgggatcaaatcatatataaattacgtgacttgtgatttacgatgcgtcactgtgtataaatacttcttaaatgaaaatagctattttgagtattattttacatggacccttcttttaatgtatttactcctaattttgacgatttataatttgtataaagagtagtacagtcctgaacttctgaacgtatctaagctagttttaatttatttttattatgatttttttgatttagaattcgtatttaaatttagtttaatcccgcattgtgtttcatttgtttttaatctgtacggtacgtacttggcggtagtaatggcggcaataatcactttacataagtgatgtatatacttacgttaatttgaagcgctgctagggtacataaaaagaagtgcttctctgaagaaaagaaaaggctgagttgcctcaatcggacaataagtcctattcaaattaagctgccttggttaggagtccgatccaagtcagatcgtatatatttctatgtttgatttttataattttattttatttttttatttcaaattttatttaatcttatattgggtttttatatagactcttcttccaatattgcttaatttttaattacgaatttcagttatttttaaattatatttctatatagattcttcttttcttttttattatttactagaaaaaatacccgtgcgttgctacggaaaacttaaaatttaggataaaccttttagaaaatattcttt

SEQ ID NO: 75240 - DNA, 3799 bp, Oryza sativa
tatcagctatccaaacactttgtaaatttctgtcttttctatgtctgccggatttatttgacatctcacttctacaaattttcctatttacgtatttctaaaatccaccccctatgtttcaaatgagccattgggcagccgacgtttggctcatatttagatgttgccgttgactaatgatgaagccgaactagtgtactttgactaatgataggtgcattccagaatgaagtccactgctccactgtgctacataaatttagctacagtttggccgttaattttctacaatttggcacttaattggattaggcgtactcaattggcaagctgcagtcctgctttcaattcagacgtggccataccaagctggtggcgctgttttttgtttaacgaactggtgtatgcttacgtgggggatttggatagatgagtgcgtaacgtgacaggtgaattattaaaccatacgctaaaagggaaaaaaaaactaagttaagctaacttttgcgtgacatatagcaattccgaaaatactattcagtttcttgcatttgcccctgttttgcagcagcaaaaatagcaattacgactcacgaattctcaacaaaaatcatatttacaaacgcaaaatcccaaagtttgaatggctactagacctccagagaagaccattaatggcgatgaacaccgtcgcgagcacgaccggcgggcagcagctcaggccaaggccgccaccttcctgtgacagtgagcgatcctcccgccgacgccgccgacgcagctctggctcctggggtagtgcatcacgccggcgtcgccgaactcctcgcacggcgcgtcctcgtcgatccgcgccatggagatccccgacgccatgctctggctcctggccacggcccgcgcctcccgctcctgctccgcggcgcgcctctgcgacgccgcgcggatcagctcccggaggtcgtcgtcggcgccgccgccgaaccgcgagtccgacccgaagctgttgctcctcatcgaggcggcggcggaggacggcacgaacaccgggtagccgaacgcggcgtccgccggcacgcagcgcgcgcaccccgtcatcccccgcacgtacatgtcccgcgccctccccagcgccctcgccggcgccctccacagccagctcagcctgctcctccccctgctcatggtggtgtttgggttgggttgggttgaagacgatggaatttggttggagacgtggagctctcaccggtggagggtagggctgcctcttatacaatggccttgtttatggatggggaaaaaatttggattttgtgttacatcggatatacggatacacatttaaaatattaaacgtagtttaataacaaaataaatcatagattctgccaggtaactgcgagatgaatttattaaacctaattaatatgttattagcaaatgtttattgtaacgtcacattgtcaaatcatgacgcaattaagcttaaaagattcgtttcgtaatttacacgtaaattatgtaattgattttttttcacatttaatattctatgtatatgtctaaacatttaatgtgatgagtgaaaaaatttttgttttgtgaaaacagggtcaaaacaacggtgggtgcggaagaagagaagaggagacgggacgggaggggcgtcggcggcggtgggcgaaaactgcgtaggaaaggggagaattgagaaagacctgtgtgcgcgcgcgcgcccaccactcactctcgtgctcctgttatccttctagatggcggcgcgtgagtcacagagtcagagacaactgtgtgacgtggcatccggtacacagttcgtgacagaattttacatgccctggtcggacggaggaaggttggattgggttgctgattggttttacagttgttgttactgctagccttgaaagtttcagtggaattagtacacacaaatcatcatcagtttcatcgcactactgtgcagtagaggagttgctatcatggctggaccgctggagcgggccgtcgccttttacaaatattttcatcctgcgtggtgcgccaactggtagtaaaatatagaaatactaccaatctcgctttttttgttagaaaacgggattcctgcttgcttgtttaaatcttggcaggcagcaaacctatccatcagcctcgacaaggaaatttgaagaaactactcgatgccgtacgtaccttcatttcaaaatcataaaataatattgtgctacaagtgataacaaaataaataatatttaataagataaataattaaacgctgtaggaaaatctaccacgtcatatagtattttggaatagaaaactcatcacttcagttgattcagttgggcaaacgcgcgcgagtgccgcgcgccgccggtggcgacggagccgcggtgagcgaacgcccgcccgacgacgctcgaaaccggcggcgcgggttccagccccaagagccgcgtaggagcacgtctctgcagtccaaagacacaacgtggcaatggaagcttcgatgcgatcagaggttcggtttgaattcgatacgtgcaattttagtacttacttccgttctaaaataagtgtatctataaatatccgtatttagcgtttttactatccgtcttatttgaaaaatttataaaaaatattaaaaaaattagtcacaaataaagtactatttatgttttatcatataataacaataaaaatactaattataatttttttttaaataagacaaacggtcaaacgttaaatatgaatagtgctaaaactacacttattttgggacggtagtagtagcacgtaaaactgcgtaggacggctttttttggttctggatgacggcggagtcgccggggtgagtcaccgccgtgctgtcggttggttcaacgaagcgtgagatcgacaggatgcagcagcagctgaatgatttgcaggggcgcaggcacctttcagctgacgggagcgtcattaactgttgaaccggcgtggactggtgactggtacgatgacagagacggccgtgtttatgtgcttccgtagctcgatcggattgacaggaggggatttcttgactttctcgataatactggacgtttctgctggagacagtttttcttccgatcaattcagacggaagaacaccatgcataagcccccgtcgctcacacggatgcgctagttccatttacaattttttttataacactgactcacctaatacctgttcaaaattcgaaatataataaggttttgtattgttcggtcatgacgatgtccaactcattccatcaaggggggtacaccttttgaaatggacagaatcacacacttcctagtggctaaactttccccaaaacttgtggtgaccaaattgatcgaaaagaaatgagagccaagttacaccttttctcgggaaaagtataattaatgggatggtgtagttctgtatgcatgacttcacccaccaggattttaatattgatgcctacaaatattgcgcacatgtaggtgtgattctaacatgtaattagtgagattagagatgtaccgcaggtttttatatccctctgagtatatgttaggagcgtattcacaggggtgtgaatgtggtgttacttatgtagtggtgtacgctcgcgtatgtgactgcgtataatataaaaagagttacacattttcccattttcattatacgcagacacatatgcgaagaaatactcttttcgtaagaagaaaggcaagaaacaggggcggagggctcgctagggcaagg

SEQ ID NO: 75241 - DNA, 2171 bp, Oryza sativa
accccaccgccttcaggtcccaccactgtcaccgcctccccctcccagcggccgtgccgccgcgcaggagggtccatgtctcctgcgacgcgcggaggacgggcggcggtgtcggtggcggtggggtgaagcgctaggccatacctgctggaaccggcaaggccaagaagcaggtcgtgttcttagacgccgcgccaccggtctcgcagcggggcggcggcggcggcggggagggggagggggagggggagggggaggggaaggtggcgaggaggaaggagaacgccgcgttggggttggttaggaggttgacgaagaggacgctgtcgctgctctccaacctcccgctcgccatctccgagatgttcgccattgccgcgctcatggccttaggtgattcgctgcttatttgatactacttcgaattcgctagcttagcttctccggaatggattgcccatttgccagtatgtgattgctgtttttttttattcatgattgtgattgcaatttgcaatttgcgatttgcaattgcaggcacggtgattgatcaaggggaggcgccgagctactacttcgagaagttccccgaggacaacccggtgttcgggttcatcacgtggaggtggatcctcactcccgggttcgatcacatgttctcctcgccggtgttcctcggcctcctcgcgctgctcgcggcgtcgctcatggcctgcacttacaccactcaaatccccattgtcaaggttgccagaaggtagaaatggccattttctgatgtgcaggttttctcttcttgataatgatagtttgtctgatcagaattcagaacatgagttatacttgtagataattgcaagcgctgatcaattgtttcttgcagatggtcgttcatgcattcagcaggaagcatccggaagcaagaatttgcggagtcacttccccgcgcatccatccaggatttaggagttatattgatgggttatggatatgaggtgattttagtcacattctgtgcatttcatttgctccgatatgcatttaaatcatgtgtgtttgatgtgtgtttcaggtattcactaagggtccatctctgtatgctttcaaaggactggctggtcggtttgcgcctatcggtgtgcacatagctatgattttcatcatggcaggtgccacgcttagcgcaacagggagctttaaaggatcggtggatgtaccccaagggttgaactttgtaatcggagatgtgatgaaacctaaaggagttctctcttttgtgcctgatgtttttaatactgaagtccatgtcaatcggttctacatggagtactatgatagtggagaggtagtcaattttgcccagcatttcatatgcttgtgtgatgtcagatttacatgtggcaaatatttttggctttccaggtttcacaattctatagcgatctttcacttttcgaccttgatggcaaagaggtcatgaggaagactatcaaagtgaacgaccccttgaggtatggtggggtcacaatctaccaaaccgattggggattttcagcattgcaagtaaagaaaaatggtgaaggtcctttcaatttggccatggcccccttgaaattgaatggtgataagaagttatttggaacattgttgccacttgaaaactccggttcttccaatgtcaaaggaatgtaagttttaacacttcccctgtttggagctaaatgataaactggacacattccctataagctattaacttcttctcttgatggcttgtagatcgatgcttgctcgagatctgcagtctattgtgttgtatgatcaagagggtaagtttgtgggggttcgtcggccaagctcaaaactaccgattgaaatagatggtaacgaaatagttattgaagatgccatcggtagcaccggtctcgatcttaaggtcagtgctcctgataaattgttttgaatttgcagaaattttgtacatgtttgatatatcattaaacgtgccttgtatttatttcccttgccatcagactgatccaggaattcctattgtgtatgctggatttggtgcactcatgttaacgacctgcattagttatctttcacattctcaggtgtgtgcatatggcacttcctatgattatttttgaaatataagtattgtaaaa

SEQ ID NO: 75242 - DNA, 2644 bp, Oryza sativa
ccgccccaccaccgccgcccgttcgtcgtcgtcggggagaaggcagggcgagctgcacaggatcttccagcacttcgacagggacaacgacggcaagatctccggcgccgagctgagcgcgttcttcgcgtccatgggcgacgagatgccggcgccgtcgccgggcggcggcggcgccgccgccggctacatgctcgacttcgccggattcgttgccctgatggagagaggtgacagccaagaagaggacctgaggagcgccttcgaggtgttcaacgccgtcgagtccgccggccggatcacggcgaggggcctgcagagggtgctcgcgcagctcggtgacgagcggtcggtcgccgactgcgaggccatgatcagggcctacgacgtcgacggcgacggcggcctcgacttccatgagttccagaggatgatgagctaagtccatggaatgcctcagcttgaagctgctacagcgagtgagtgactcagcgaggtgtttttcagtttcagagtcctgagaaaattatactgctactataggttgttgataagtctgctgcatccagatgacacattgcagattgtttacagggcagaagagttcttcagagctcttttgcttgcctggagcaaatttgttgttgtcatcttgagttgtttggtgtgccacacacttaatccagtgtatcagtaaagttacagttgatttccttctttcaaaagaaaagaaacagttacagttgatttcttggcttcacctgtatttgttcaggaataaatcgtcgagatcgtgcacccttttcttattatccaaaaacactgaaatattctaaaatatagccggatagatccaatatattcttaaaatagacaatttgcacacactcctcccccccccccccccaaaaaaaaaaaacaccaaaaaaattcaatatgccaaccaccacagttaaatttattagatttgttacaaaaatattggtattaactcctagaggatagccagtgagctaaaaagaaaacaaaagaacagacaaacaacaaatagataggacagacaaataacaatttttttttcaatcactcactccgctcacccttttgagttttgattggttatgcaataccatttgaaatacaatgagaccatggtttcatcatctggaaatgacagataacaatatgccgacataacaaggaaatgtaccaactttattttcacatagtataattcgattgggtaactgtaaattaagtaaaattcaaatatgaaggttgtttttctttcaaattttagagggcacatctcagggaaatctttacagttgcattgtaaacattgagtttgtacatgaatccatattacagtaaaaaaaaagctactattgcacaatgctgcaatattcattgcagtgcaacaaactgatgtcatgatagtaacaagcagataagaaattctgcaaccagaattcagagagcttcacttatatttgataaaatgaagcatcagaagcacaacgcgcacatattctcaagccttgcaagataagtactaatttacatccccattttgttttcatttcctggggttctccctaacagcaaaccgagtaagacattacccattatctaaaaagtaagacattaccactactttctcagtgatattctacatgaaaaaagatgacaattttttcttgcagtctataaccacttgagacctcaactccgacccggctgagattgattcccttgttcaacataaggccgcacgaaagtcctcttccaccacacctcaaaggccttctgcagattggggcagctatccccaaccttcaagaagctcccgagccatgaaagcaatatcgtctgctgatcctcgagcgggagtgtcaagatagtacgcccgatcccttcctcgacaactttgcggtcaaatgacctgcagccatgctgtaaccagttgtagtcatccatgagaggctgcagccagacatccaagagaagcttccttgtgtcctttgaagggagcatgtctcctttcccaattgccacaaagagccttgctgtgacgcagctgacaagatggcgcgacttggttggtaacttggagtgaagctcagccaactcaccctggttagaccacatgactgcaaactcaccagcagcattcctgtcggccaaaatctcagttaaccaaaggagattatctgcttctagagcaatttgtcgaaaaactggctctttaaggtctaaggattgctcagcaaaatcgtcggcagtcgcttgtcgaaacaaggtcaacaaggattccaggcaattctggcaagagctgtagagagtctcagcatagatatccacagatgtactggtacagctgctattctccttcagaagcttcagcaccagggatttcatttcgcggcgccctctatcctcgccgctcttcaagactaattctatgatatgcacaaatgtgtcatttggtgggcttgttaggtcagagcataccctcttcagtattgggctaacaccataattcccactttgcagatgctgaacagatgataccacattctcctcttcttccccgacccaagggacggcttccaagtactctaagcaagacgggctgcaggaa

SEQ ID NO: 75243 - DNA, 1780 bp, Oryza sativa
atggcagcctgcctggcttgattttgttccaaccccccaccaactggtatggcaagatatatttatcagttgtgggctctattcagagtttgtcaacttgtagttattaagtgacatattgaagtatatgggtatagaagacataaaagaccatatccctttgatgtaacaacatgaaacagacatgcatataatacatgcaatgcttcttttttacattaaagattattaattacaagtggtagtaaataacaatagcttctagggaatatttctgttggatagacataaaagactgacattaacgacaacttaagtagattgtatatcaaaaagcttgtagaaatttcaaaagttgtaatacagggaaggctattttgatatatgactaatactgtagtaagctagatgataagtaaaattaaattctgacagaatggtaaaagttgggaccgtacccccttttcattttgcatattagcttagagagttgaaaaaggaaaattgatgactatatggattttcagtaaactgagaaaataaacagaaccaatatttaactgcagcaaaccttcaagatccgaagaacgcgtggaacactttgcttgataagcctctgcttggcatcattgcagtacatcaatccaactgtctcaacatagatctccacatcctcacaatcaggcacctccatgcttgacattggggattgtcttgagagcttatcagcaaaccaggtactattttctgcaaggatgttcctgtgaacactcatctttacagcaacaccatccttgccatacaacacaaccttgagatcactcatctcaagttgaccaaatccaacagatatcttatgctgcttctgtggtctatcattcgctaccttcggtggattgggtgttgaattttccgctggcgcgcacttctgttcatccgaattgattctagaccttgtcggagttgaatgcgctcttctctctgatgaaatggtaggcgccctctgaaccgaagaggcctttgatgcaagaggagatgcaccccctttaggctttgcctgctgattttggttcttcattgtcttttggagcacggcctgcgacgggcagcaccagaatccttctggtgttacagcaatggggacatttctgatctttgttgctcgggcatcaaggctcccaaccttgaactctgtcatgttgccttaggaagcttacggccaatgacttgtctgatattaactgtagaactagcacttgttcatatacctgagcagcaatccataagagcaaaattagtgaactcaagttttaagcaactagctaaaatggtcatgatagtgaatgtatgtaattaaacaagaagagctgacaatttagagtatctactgtatgagcaggaagcaaaccatatagaacatacataattttcagttaagccaccttttcctaacctgcatctcagatactgcagtttctaagttaaatccaaatattaggaaattcataagcttggaacctaacatgaacgaccacaaataccaaaatttgcagagcctgaaaacaggacgctctatcttcagcgaattggaacggcgaccaatgaaaatcacaccttatagagcggccaaattcaacataattcacaactcacaagcaaacagtcctaacttttcttaataaactaacaaaggcaagaacactgaagtgcaaacaggaaaatgaccaaaggagctaacaataacatacctctgactgaagaggcactgagcacaatcctc

SEQ ID NO: 75244 - DNA, 5214 bp, Oryza sativa
cacatcatttctttctcccccacagttgaaaaaggagagagagagagagagagagagagagagagagagagagagagagagagagagagagagagagagagagagagagagagagagagagagagacgaaggcaaggcaaagaaaagaggcagcaaggggaaagcaatggaaggaaaagggcacaaagcagcttcctttgagctttaccagacgagtggtgtcctccctttaaccatccaagctaccacaccggccatcatggcgagcttctcctctctgaaatctctcttctcttagcttttctttcttcttctccagctctctcctctagcttctttgcttcttctccccctttatccctcttggctctgggtgctctctctctgtctctctgttcctgtttgtacaggcagcagcacagagcacagacgctagtggctggcgacttggctcttcttcgtcctcctctgctcgcatcagacacctcactggctaactctaacagtgccctaacttaaccaggagtaaaaaaaaaaacttatctttaccagtatatctccattggttcttgtgaagaggagctcctcctctcctctctctgtctctcaaggggtgtgacaggtggggcccgtagtcagggtgagatctactccactcttggatgctgcgatcgttctgtttttaccaccagcctcggcgcttggatcatccgagctggaagaagggtaatttatctggcagtttgtttcgccccaaaaagctttttgatcatcacatgcacgtttcgatcttaccattaccatgatggattatacatatattcacttggtttttactgaaagtaatactactggtagcacatcaagattattatttttctgttactttaagcatgtatacatggatgcatctgaataaaagaatcttgcaatcaaattaacctcgaagcatgtcggcatgttgcttcagaagaactcatcatcagcaagacacgttctttcttgcataatcttagtgtagtactattatgcatgcccaaccccctccgtaccaaaaaaaacaaaccctgatttccgtgtacaacgtttgaccgtccgtcttatttaaaaaattatataaaaaattaaaaagacaagttacgcataaaatattaatcatgttttatcatctaacaacaatgaaaatacgaattataaaaaaatttcatataagacggacagtcaaagttggacacggaaacctagagtttgctttttttttaaggacggatggagtaggtgctagcaccctggagcaaacaggatacttaactgtgagcattagggaacagtatagtacttaactgtgagagtgagcattaagaacaggtacaatagcaggctataagccagctgcaaacatattttaaggagataaataaggagagagaagggcagcgggctacagatttgtagccagctgtagcacggacttcaagacgcagtgtgtgtatgacatgtgggaccaagtattgatagtgtagtatgtaactattgtatgaatgagctattagattgactatatatagatgaattggagctagtggttggctattctattaaacttgctcttagggagaaagatttgaactttgtcttgagttgtgtgggacataatcctagtagggagcagcaggacaggacaatgacaaggcaaaaacctgcaagagaccaagaaatccaagatgccatcggagttggcaagcagccagtgtatgtactatgctggcttgtaccgtttgcttgacctgacaccagtaacatttgcttttggagtttttgagctttggtgacattcacaagcatactcctgtgaatgcatggaattcgaggtatatactctggtttcggaacacaggtccaaaaaacttgctaaaactgaggaggaattgggggtgtgcagagtggagtagaatgcaatgcacgggttgcatgtctttggaattagaatctactagtagctaggaaatgttagttttgaccgtaattttgcacggttctacaacccggtgtgtactcaaaatcagatagaattagcaattgttcgtgcgagtttgtttcgcggtttgcagatcgaaattggcattggcttgttacgagtgtcagcgtcgatgcttctgttcagttaaagatatgtggttcaaatgcgttcgagaaaaaaaaatgtggttcaaatctgtaccgctctttccctctctttttttttttaacttttctttcctttttcttttcctttccgttgttcaaattgaacagcagaaggtagcgccttgactcgatgcttttgacctctcagatcagctactatggccggtcatgttcagtgatcgtaataatttctgccctggttttcgatcgactttgtgtgtgaacacggttcgttgcagctacaaattgccatgcccttttgctttagagaaaagtcggtgatcagatcagctaatcaaagtggaaaactagctttcctctggtaagtgcagatattagagtccagttagttggggtggaacgggaccgatttgatcgacctaggttcaggaaaagcactacggagtactagctggagtattaccttggttgttggtctgaactgtatctgctcaacgttgaaccaaccaactattgatttattttccttatcctcccagagctccagtagtccagtgccattgacacgttccgtgctgcttcagtgcttggtactagcagattgtgttatgagagactatgtaacggtgtatcatggtaatggaataattgacatcaacataataggtatcgaatataatatcgagggtaccaaatatgatacaccgtagatattagatccggtacctatgtatcatgctgacatcagcattgtactttcgataacaaacatgatatcttgtatatactaggtctcgtttttagagattatgataaagttagcatggtacatgatatctggtagatatcagatctgatatttgggtatcatcttaccgttctgtgatattcaatattgtgatcgtgtttgcgcacgacatgttacttagctcgtggggtctcatcacgtttgtgcatgggcgcagcggggctggcgtagcggcgtggcgtggagtggcgtttgccgcgcgttggagaggagggggagcgcccacatgtgatgtggggcgcgcgcggcgcgggcgatggaaagcagcagccgggccgcgcccgcgcgcacggcacgggcgcacgaatgcatgattttcgcggtgcgcccgcgttggcgctttgctccccctctcgtctactacccgtcccgcgtccgcgtgtgccgcgccgcgccacgcggccggcgaggcgaggccgcaaggcgactcgaggtacgcgcgcgtgacgcgggcgctggcgctgtgggctgtgctcgatcgactttcctcgttctcgtggtcgcgaaaaaacacacgtactgacgtacgggggttttgacgcacgcgcgcgtgcttcccggccggctgcgttgtcgctcgctcgtggtttgttgggttcgtgtgcttggcgtgaaggtctctgtcaagtggcgtgccacattgtcgtggtttgttttccatccaatagtttcgtgtagacgcaacccgttggactgttagcttcgtggcaacagctaatcccatcgagtcgttgcaagtaggcacgcgcgcctttgctccatggtgatactcttgataacacgaaacgtaacagaagcccaacacagatccattgtcgtctagtccggttaggatatctggctttcacccagacgacccgggttcaaatcccggcaatggaacaattttttttgttttttttttggtttcacactcacgggcttcagtctgacgctgtacaaaggcccacttcgggatgcagtgggcttcctcagagggcccatattcacccttttcatgccgttctattcggttgcgtttggtctgccgtatggcagtggtgggatgaaaacgagaaaatggacatttagccatgttcaaaacacggtttggctataatgccatcacgaaaacacgtttcgctaaaatgccaatatgaagcgtgtgctcaccgccactttgccattttagcccttttgtgcattttcgaaatcattttcgctcctccttcggatgacaagacaaaattgcccttcatgtcctccgccgccgccgttgagggagaggagctcgtcctcgccggtcatctccatgtccaccacgagcagctcaccgtcttcctcctcgtcctcctccatggatggcgtctagagcagcgctatatgggatagcctagacggtgaggtggccggcgagtcctccgacatcttcccctccctggacctcgccacctccgccgactacctcgccgcggtcaacgacgacatctctgaggtcacttcgccgcggtcgacgatggcggctaggatttcgaagcggccccatggcctcgccggcgacggaagtgaaggggtagccccatggcctcgccagtgacggaggcgaagggggatgcgatggagaggcaacagcagctgctggcgagccttgccggcgaaggaggcggagagggacgctgtggagaggcggcagcagctgctagcgagctggagcgcaagcctccgctgccacgaggccacctcggcgaccttgcctccgcctttgtggtgccgtatggcggtggcgggcaggggcagcctccacccgcccgacctcgaggatgccgccgccgccgccgccgccgcttcgtctacaagcaccgccgagtcctccacctcgacgacctcgcctccgcctcgtcgagcatcccggccatcgacattggcacgctggtgggggtgggggttcggcatcccggccatcgtcatggccgtcaccatcgtcagcttcttcgtcggcggacagggcgtcgtcgtcggcggtgtggaggtcgtgtatctcccttcgctgcggcgttgccatgcccgcgtcgccatcgttgccgccgccgccgccatgtgttcgctcgccgcctcctccatttcagccacgtagaccacctcgccgcgctcgttgtcttcctcccatgaactggatcgatcctcttttagccggcgagcaagggcaatttggtcccatcaagctacattccaaccaaaatgcaattgaaatgcacaaaatggccaacatggccaagtgg

SEQ ID NO: 75245 - DNA, 5238 bp, Oryza sativa
atcttgaattgttgaattcagcacaaatcacactcattccgaagaaagaagcgccaaccatgttgaaggactatgggccaattagtctcattcatagcttctccaaattggcaacaaaagtaatggcacggcggctggcacaaggttggatgatctggtaccccacacacaaacggcattcatcaaaggcagatccatacatgaaaatttcatatttgtcaaaggtatggctcaacagttccaccggcaaaaaaaggaagttttactcctgaagcttgacatctcgaaggcttttgatatggtttcatggagctttctgctgaacatgctgaaatacagagggtttggcccgcgctggaggtcttggcttgctgcacttttcttgacagcacaaacaagcattacaataaatggggatgactcaagggcaatcaaaccagcaaggggactgtggcaaggagatcctctgtcgcctcttctcttcgtcttggtcatggacacacttcaagcaactcttttacaggcaaagaggcaaggaatactttcagaactgaacaccagaaaacgtctgccaaacatttcagcttatgccgatgatgcaatgcttttcgtcaagcctcagaggaaagaagtgctactgatcaaagcagtcctagacctgtttggagcagcatcaggtctgaaagtcaacctcctgaagagctccatcacgcctatacactgcaaccaacaacaattagatatggtctctgaactgctcccatgtaaagtcgaggaatttcccattatctacctgggactgccactatctatgagaaaaccaaccaaggcagagctacaaccagtcctagacaagttagcaggcaaggttgcaggttggaagccaaaattactgtcacctgatggtcgactttgcttaatcaagagtgttctgatggcattacctgtgcacttcctatcagcgctgcaaatgccgaaatgggcggtgaaagaaattgaacgcaaatgcagaggattcttatggaagggacaagaggatgtaagtggaggacactgtctagtggcctggaaaaatgtttgtgcgccagtacagaatgggggattgggaattcgaaatctcgacgcctttggtcaagcgctaagactaaaatggttagccaaaagtcttgagcaaaaaaatcgaccgtgggccaagtcaggatataaacttggagaagacgtggagaaaatctttaactcagctgctgaattctgtgttggaaacggcaaagacacaaagttttggacagccaattggctaaatggtggaagcattgcttggcgatggccggtattgtccacttatgttggccgctcacagctgacagtggcacaagctttaaccaacaacagatgggtcagagatctgcaaggtgcactctccaatgaagccatggcacaattcttccagctctgggatgaagtacacactgtcgagctaaatctagaagaagacaccattcgctggaagctttcctctgacggacttttcactgtatcttcagcctatagccttttcttcatggcaagagagatttgccctttcagcgaacttatttggcacatcaaagctccatcccgagtgcgcttcttcctatggttggctgccaaaggtcgctgcctaacagctgacaacctgggcaagagaggatggcagcatgaagattgctgctccctttgtcagagtgaagcagaggactgcctacatctgttcgtaacgtgcgctttcaccaggagagtatggaggatgatgcagggatggattggaatcaatttcctcttgcctacagagaacgaaccagccctggcagattggtggatgaaggcgaggatggcttttcggacgggctacaggagcatcttcgacagtgttttcgcgctaacatgttggctgctgtggaaagaacgcaatgcgcgtgtctttgaacagaaatttcgaagcatggaacagcttgtgcaagatatcaaggaagaggccattgtctggaagacggcaggagtgttcacaacgtgcaatagcgagatcacgtaatatgcattgtaatttgtagaagttttctagcttaccgggtcagggcttttgccccaatctgttttcgacagcatactgtcgttgtaagctctttaattgtaatgtacccttcttttcttagtgaaattggtcgaccgaacctttcggccgacccggcaaaaaaaaactttgcttacccaaccatagatgttggggaatttatcagcatcactgtaaagagcccaaatctggccagcttcaaacttatcatgcgagcggtcttgttcgatgttgtagaattctgaatcagggcatgcataacagattaattcgatatttgttttcttgtcaagagccatgtaggattcaagagtaatggaagtaaatgccgaatccaagtcacttggaagagctgcagtgtctagttccaggaacccttctgcaacacctaccctttcatttccattcgtcctatagaaggggatactgtgagaaaaacgaagtacctcacatgatgatatcgaaaaacatgactcgttcttcgctttcgcaaatagactgacaacccctgcaattctgaccagcggtgaaaccgtgacaccatcatccattgagccactggaaaggacttgcacaatatcatacccatatgattgatatctatccgctacgctccggcccaagcctcccggcgacgggcctccgctccactacggcagaagctggcctttattaagtgcaaatgaatttggatcacaactcaacaaactgcatgctccatcctttataaagagcccacacggccacccctcaccattgttaggatttatatcacacgagttaccatttttgcctgtcgacgaaacactgtgggataagtacctcgatggattgtgcaatacatctgtttctcctaagcagaagttcccacaagcaaatggcagtttttcattggtcgatttggaattttgttcatttactgtgttgtgcaccagccaagtgaactgcactttgaggttggaaggatcgacatgatttatccgggcataagctcttggcatgcaatcatggccatcatagactgcccagatctgatcaaccgcaatttgggagacatctctggacttgtcaaaattaaagaagtctggagaagagtaggcaatcacaggattggcagaatcaggtcgcttggagtccagccgacggaggggcgtcgttgctgtagaggccacgtgttggcattgcttgggagtcagtgaggtagtggcaagaggggcattggtaggtgctaggcgaaagccggcccaattcttgggcagcaacggcgacgtctttgggcgttgcaaccctcttgagggcgttgttgaggtgcctccctccccctcttcaaggatcctctaggtgaaaacctcatcctttcgggatgggcgatggcggcgttttgaatgtcgtgaccttcttgaaggcatcgttttggaggtggccgtgtgttcctctcggtgtggtggtgtgtaggcacgtggccgggtgtgttttctcttgtccggttcccctgtcccctgctgcttttgcctttggttgtaaatggctgttttactcctctaaatgcaaaaatacgctagaagcgtattcccaaaaaaaaaaggattggcagaattctgagaagaagtatcagtatcatctttcctatgactttgttgattgtctccatgtttttcatttccttcctcttcactgtccacttcgatggggacatgttgtttggcaaattgattctcagtaacagcaacatcatcattacatatttgctcattactccaatcagcatcagatggagaattatacttccttttcctctcaatattagagttcatagcacggctgctgtcagagctatcacagagctttctccgacccaatatctgaagactggatgatcctggagcatttgtccctgctgatacactttctccagtcaaattctgcacagcgatggagtttggatcaggactccttggtaccaaagttccgggcatatcattgtcagcaggaggcacatgagatttagcttggctaatttctgaaaattgaactctgtcacttcttgtcaccaggcctttaccttccatgtcaccagcccagccatactgttttatggattcatcagtttcttcagtatctctggatttgccaaaatcaaagtctggataagggtaggcaatcactgaattgagatacttctgagcagcagtatcattaacatttttctgacaagtttgttggttgcctccatgtcttgcatttccttcctcttcactgtccacttcgatgggaacattctgtccagtagattgattatcaggaacagcaacatcatcattacatatctgctcattactcgaatcagaatcggatggacaaatatacttcctttgcctcttaatattggagttcataccatggctgctgtcagaggtaacatagagctttctcttacccaatatctgaaaactggatgattctgcagcattttcctctgcaggtgcactttctctagtcaaattcttaacagagatggagtttagatcagaactctttggtaccaaagttccaggcttatcattgtcagaagagcagatgtgagatttagtttgcttcattgctgaaaattgaatggcctcgcttcttgtcaccaagcatttaccttgttgatgctgattaccatgctgattggggacactacttcgttgaaatgagaacatttctgacggtgaaagctgagacctttttgcagcagttgataggattcttgagggcacagactgctcacgcagtttgattgcaaagaacttaccacaatcattgcagcgggccaaaaagttccgttggtagtacagagattgcttctgacaatgcggacatatctatctatctatctatctatctatctatctatctatctatctatatatctatctattattctattatattattaaaacagctttgagaaaaaggcactacgttcgctgtgggggctagaaattcccacattaatcggagaaaagaagaaaaaaatagaccgttagatcatagtagatctatattatagtggtgtagattgattgagagagttgtatataaaatacaatcatttatatggaaatttaaattaaataagagatact

SEQ ID NO: 75246 - DNA, 8749 bp, Oryza sativa
  unsure (1)..(8749): unsure at all n locations
tccaaagatactacgatttggataggccggtggtctggatctggacacaaatcccatccgtgtaattctagtatttctctccatttccaagattgatcgatgcatgtgtagcagaaaataatgatactataatccctagcatttgacatgttctttggattgaaaatataggtgaatccgctcatgcgcttgagctttctatgcgaaaagttcgctttgtttttgtcaaacttttctttcgaaaagccacatgctttcggacaaaatatatccctttacgttttgtgccaaacatttctttttgtcctcttactatcagacggaggtgatagcacttcgtccaaaccgcgtttggttcaacgttaagccttaaggcagtccgggtaattaaccttaatgtttcttttgttttaacatggtaccttaatatttcttttgcagggatgattaaacttaaatctagttgggttaattatagcttgggaagcaccgttgattcatgtgaacttggttcaatttttcttaaacaacacatataggtatagtgcgatatttcgtatggatagaacaataaaaaaaaacaagaatatagccttgggaggctatagcctggaaaaaaaagcaaccacaccacacgtttacaatcagacctcactactaatgaactactaatgagatagtaatacgacatctcgaaggaaaaggattttccaaacgacgacttcaagaacgatatgacactgagatgccagcaccgtccatcctaggttcaagacatttcacctagaggaatccatcagggggcaaaagagatcactcaataataccctaaggggaaaagtggcgctcgcaagcgtcgcccttgctagctcaaagaggctaggctttcgtttgtaatcttcctacttcctcgtgtcaagatcttctgctggtcatagagaacaccaccaaccacactccttcgacgcacagccaccgcgccagcatcttgctgccagctgaccatcgagtagaagctcgacatccgacgcattccaaatccatccacacggttaggttggagggcgagagagaagaatggatctcctctccgcactaatctgccaacgaggccttcttatggtgtcgtcgccacaagtggccttcttatggtaggcctgcaacgcacacctcacaaggccaccgttgtcactgccacagctagactgctagcgtcatctcaggccgcccatccgcatcactgccaccttgtcctcgccatgcaccgtaccagctcagtttgccgctggccggcctgcgcctcgctgctctcaacctcgtcaccgtgccggcctcctgccaccgccggacacaccaagcttgcgtcacataggcctttgctgaccgcaacttgcttctatcaccaaccacgtcacgtcagcctcctactccaaatgtcgtcatctacccgctgtagtcggctgcgtcaacctccttctcatccgctgtcgtagcttccagcaccggcctcttacttccgccaacgcaggcgtcccgcggccgccgacgctgtcggcccgtagccgtcggccttctactgaggccaacgccgcccatgccgaagttcactgacaactttctgagctttgcgtcgcttcccccgcgctgtagatggagtgtcgtcgggttttggccccgccaccgccatccttgcttgtcgcccggttttccaggcggtgagctccggtggcagcgaggcatcgaggagggtgggagggacggcggcgggtggctaggatttcgcttcgagccgtctgtgcgtgggtgacacggatatctttcttccttttcggttcaaattctgatccccacaattaagaacacatgggaccatgagttcactttgtgtagaagtttcaatggggttcacgaatttatccatggccccctccatccatctaatgcgttaaaaaaacacacatttacggatatatgtaattgttatatacatgtgtgttgatgtgcttgtgtgcatttcccattaatataaagtagctcgaccagaatctcgtgtgtggcaactaaccttagctatcatggttgtcgtcggcttctatttaagatgtaaattgcccatcatttcattaacttatggacgttttgcatgcctagccaccttttaacaagaataaaaatgggttctatgggaaaagtaggcgtagtggtgaccggtgaagctgtcacccatgggtgcaagacttaatactatctgcgctttcaatagtaatttaacgagggcaaatatttgctactgacactacttagaaaaaaatgttttttcaggcggtcaaaacatgttctcacacccccccccccccccgagggggtctggccacgtgggtgactgcagctgccccaaacctctagtcaagatacccccggtcccatgtcaccgacaatccccatgtttctaattatatagttttaaaagtcacaccagttgctaccacttatgtcatctcctcctttacttgcttgctcgatctaccactatttctattcattctctttggaatttttaaaaattggatcttatagttttaaaagtttattgtcacgttgggtttcgtttttttaatttctatatgtcccgtcaaacgttgccattatactcctctatggcctgtccactatctcttctctttattatcattgagattttaaaaatcgaatataattatcgtttgggttcatttttacttctagaagtcctgccaaaccgttagcggctttgccattgtacttctctacagctcgctcgctgcctcacttttttattgtcattgagattttaaaatcgaacatgattatcattgttttttttttactttttagaagttccgaacctttaaaaattagggtttcattttttataatttttagaagtcccgtaaaatgatgccactatgcttctctatggcccgtccgccacctactctttattgtcattgtgattctagaaatcaaacataactatcgttggaatttatttttattttctagaagtcctgtcaaccgttggctgctctgcaactatactcctataaaccccgctcgttgcttctcctttttatagtcattgagattttaaaaatcgaatatgataatcaaatggggtttatttttttttactatctagaagtcctggcaaccgccttgctcgttttcttcatggcctgctggtcgtccctccttttaatcgtcattaggatctatttggtgttttatcaacagtttttatatgttgtatcaaccgtcaccactctactcttttataggtatgttacttaatttatctcgtcatgtgttttagatggtcttttctttcaatagtctttatttttatcacaaattttagttatttataaattttattcctaattgaaatcttatttttatttttccaattttagaatttatttttttttcaaattttaattaatatcatattgtgttcttttaatttttttatttttttattttcaatttcagttgtttcaaaattgtattcctagttgaactctcttttaatttttctaatttcagatattattttattttttattctgaattttcattaatcttgtattaggttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttatttcgaattttgattaatctcgtattgggttcttatatgaaaacttctttcaatattgcttattttaattcctaattttagctatttttaaattgtatttctacttgaactctccttttctttctttttcttttttccgattaatgtgagaatttctagctcccagagtgaacgcagtggctacttttaaagctgttttaataatataatagatagatagattcggcatattttaataaaaaacaagatactaaacatgacatgtgaataacaggaggatgatcaagtgatagtactaaacacaaacatgctaataacaagaataatatcatctagtaacatgttaacactaaagtgaatagagtgatatgcggagaacgctccggattcaaaggcgatggtgttggtgttgtcgctaccgttgccattggcgtctcctccattccattgctagtcgacgtagaggaagaccgttgctgttggcgtcttctcctccattgctgctcgacgtagaggaagaagaacctggcgtagaggaagcagtgtagagagcttattgtctatcggttccgctttctcataaaaacagaaaagacaagaaaacgagcggctggctcgccagccccgttgctccgctccgctaactcggcccggttggctcgactcggcgcacgagcgcgcggtggcagttcgaccaccatcttaaccgctcgacatgtgctctcatttagcaacttacttctcattggttccaaggtgggattaatcttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccaggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgcccccagcgcccacctaaccgtatttaaggcggtgtgagcgagcacaccatggcgcattaaatgcacaccgccttaaatgcggcgcatggtgcacctgactggactgtgaccggtctgcgaccggtcgaatgaccgatgtggacagggtagtgcgcctgcgcactggttgcatattaggcggtgtgccgcctgacaccccccgtcacgtcgtgatgaggagaggctgcttagactctcatcaagaccggagacggcttgcctaacccggtcagggtagaatttccgtttcccagcgcaagtgaagacccaaaaatcttcactcattaaatgccgaatgacatgcgtgtccccccgtgtcagactgatagatttgacgggccccacgccatagcaaggcatgccagagacttccaaggcaagcaacaagacatgcatttaatgtgattatcctccctgaataggttcggtgggcccatgtggtaacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgatgaagcttatcccccatcgtctcactggccgaccttggcccctgttatttttgggtcatatctaattcgttatactcaaaatacacctttggtacaaaattaataatctcacaaggatgaaatatcagtaattttctatttactggttgatcccatcttttacggcatcaattccttttttgaacgtacaaaaatttggggagctcagcgtgtctggaagcacgggagaacgttcttttgctgatattattaccagtattcgatactgggttactcataggaaaatcagcctttccctatatcaggcactaatttatttttaacgtctaattagatcagggagttcttccaattaagaagttaagctcgttgctttttgtttcaccagaattggagccaggctctatccatttattcataaaaggaggtccaggcctacttagggaggggttgagccctttttcacttgaggagttctcctgcccctcattattaacaccttctactccaacaaggagatcttgtaatttctcccacaattagctaagcacaagagtagggtataacgcttctcagcggcccgaacctatataaacccctcttgtctcatcgtccttgaggggcctgacccctatgcactgaactatccaccgagcccttgagtctcacctgctgcccctggccgaaccaacaaggggctctcactatcccctgcttgaggagttcaccctccgacaggattctaacacattctattccgataaggtaattttcttctttatctgtcgtatttcgtaatcaaatgatacattgtcgtatataatcaggtatatggtattgcggtattccatgaatccatgtataggaggtatgtcttatccttgacactgacataattaaataaaaaagacagattcaagggaaatttttctaaagttgtagcttttacgaattttcctccaaaatctatgtagtattttccctagaaaaaagatctctgtagtatcgtccattatattagagtttcaatggaaaggagatgatttaattatttgtttcaaatatgcttttaggaattttttttcatataaatttgaaactccctaatttttctgtcttttttctgttcgagcctgattgatcttgaccatgtcgtgaactactgttctccctgctctcaggatacagagagatgttgtgcagggctcattttgagttttcgactgtatatatatcgagatatatatgtttttcagctgtatttagcagcttaaacttgagcctgcattggttggtgattactacaactcgaatgggactaggagatgttaaatttaagaaaggtactacatgaaattgcccactgggagatgttaaaattaagaaagatacatgataaacagccgctaaaaatatgagctaaccatcacgatttggggttggtatgataattaatgcattttactaccttagaaaagataaagtacttcttggaactccggtcataaatatttgattttgatgttaaaaattagatttgatctctgaccatagataacttctcaagtgcttaatttataaaaaaaataaaaaagtttttttttgcggggaaaaaataaaaaaaataaaaaaatatataagtttgactaaatcttatctaaaatttaatcatttatgactggagtgagtactttttatatgctaataaaaacactccctctcatcatgaaagttgaggacaaagattctatcaaacttttgaaaaatttgaacaactttatattaaacaagttatttaatctactaataagtttgtaatattatgatagcacttttcaagcaactaggaaggaagcccgcgcggatgcgcgggcattttatttattgttttatataatagtgctaaaacaagtcatatctcactatttctacgtcgtgagatagatcgtagacttcaatatacttaaattataagaacgtctcccagaattaaaaacactttgtcccaattacatataaattctatcgtaacaactcattatcactattttaaaagctcgctaactatcaatacatgaaattgcgcataataaaataagcctaatatatcattaatacactacttagctaagtgtttatgtctcacttatttccaaatccacatataaatattcttaaaaatatcactaacgggtgaagccggtcatagccgtagatactttctttctctattaccttaaaagttgggtagctgtgtcccctcaagatcagcccgaagcacatattataatttatctattatatattaataatatattaaatttcctactaacgctcctacgccatcacgtggtactctacaaacgttcctacatcaccacatgacgctataataaattagagaaaatcatagatattcggagaaaaaaataatatgtagtatttatttttacttaaattgatgggcctattattttataccattatattagatcttacttaaaaaaataaaaatgtaatttgtcttcccgtcataatccccatccacgtgcgagagaaaatgcatacgttcgtcatgttcactaggaaaaatgtatgtacataaagttcaccaggtacgtacagttcatcgggaaaaagatacagccgcaagaaaaaaaaaactca

SEQ ID NO: 75247 - DNA, 3129 bp, Oryza sativa
  unsure (1)..(3129): unsure at all n locations
ccgaaggaacagaacataggtacgtacatacaagatacgacaaccaaaataaaacatacatgtttagtactgtcaacaagcaaatatctacaatataaagatgaaatatattatcccacaaatatatacatgcagttgaactaattttaatgtcggttttcacttgatggatccattaactatttatgtgttattgatttttaaattaatggacatattgttttatataatataatatctttctcatgcatgtacataatgtttgccggaagaaaaaaatatatgcacgtacttactataaagataaagccaaaataaaacataaacataagtacttaggccatcgaaaaattgacggcggtctttcaaatagaactatctacaatataaagatgaaatatattacttcataaatatacacatgcagtgttaaactagatctacaatataaatatcaaatatcaaatcaatcatctttaattgttcatctttaaaaaaaaaattaaatgatatatttaatttgtgatcttacaaacactcctaaatcaccatgtggcgctccaacaaatgctgttaggtcgctacgtggtactgtataatctcagcatcgattttcatttaaattggtggaccgttattatagaccattagattagatgtatatatactaatactaactgttaaaaaaacataagtacatatacaaacataagtatgtacctgagattgaaaaggaaataaagcttcggtagtactattcatagcaagaaaaaaactatctattatctatctatctatctatctatctatttctattatctattatctatctattatatattatatactaaactaaaagtccattaaacttcctaaaaacgctctgaaaccgtcaagtggcaccctataaacactcacaagtcgccaaatggcacctaataaataaaagaaacccaaccatccatttttacttaaatcgggtggattcattattttagatggttagatatattttgtaaaaagaaaaaacatccggagccaacatccaaaccaacgtacaaaagtacgtaatagttttagattatatactgacgaacgtacttactatacgtacatccatcttttccttccttattttctttttaagaagactaaaataaaaattacttttaacaagcaaaantagaaagattcagccaaaattaggaccaactactaggttnctaggcattctctacccatccggtcacattnaaaaattcctaatgaatgcctcttaaatcactatgtggntgctattaaattggagaaagtactagaaaaaaaatacaaagcaatcgaccaccagtttctacttaaattgatgcatttaggttgttatatattttttaaatgaaaaatccgtgtggtggtaaaatccattaaacattttataaacacctctaagctgctactatatgacattcttaaattaaagaaaatcttagaaatttgagaaaaaaaatactattatatactaaaagtccatgaaacagcctataaatattgctaagtcgccaagtaacaccttacaaacgctactaaatcgtcaagtgatactataatttgcccattgatttttaattaaatggtggatctattatttcattttcgaaggttagatcgttttttcttttaaaacacacatatccacaacctccctctcaagtacataccaacaagccttcttcatgagaaattaaaatcaatattatttttacattaaaataccacatatctccacccgctaggtctagcaggtcctgatctgtcattctaaacatgctacaaacacttttaagatgctatacgatgctattaaattaaataaaatactagcaaatattaaaaatgaacaaagcattagactatcgatttgttagtttttctaataagaaaaaactctaagttggtatatgaaattcttaaattatagaaaattcttagaaattttgggaaacaacatccaaccataggattagacataaatcgatggacacattattttcaatcaaataaaacattattttaggtcactagatctatttttttttaaaaaaaacatcttataaacgctcttaagatgttacgtcgttatcttaaatcaatgaaaatcctaaaaattctgataagaaaacaaagcatccaaccatcggtttcgacatgaacatctgacacattattttaggttgttatattaatcatttagaaaaaacattccaaacctccctccctccctgcctgtagtgtacagcgtgcgccattcttttgtctctgtttttttatctcctagacaattaaaattaaaattatctatatgggaaaaaacacaaatggatctccatctattacttatatcacgttaggcatctaacaactttctaccaattgaattaatttctcttaacatacatatgagggctacacacctatacaaattgaccttgatactttgttgttgcatttaaaacacatacttaatataaaaattcaaatatatttatgaggactgttagaatgataaatataaaattttaaaatacaatcaaacaaaaaaattatattatttgatttgttttgggttgtaagtatcaatctggcaagttaaaataccctaaattttctgatagcaacaacctcctttttttttcgagataagggaccaactccatagtttcgacacaatatgttcttatcaattcaaaaccacatgatttcaaataattttattttataatttatatgttgaaagagtaattataagaaaataccagcgttcaaagaatacaaaataagtttaattttagtttagaatataataaaaatatttcaataaaaaaccctgcacataaatattcataataaaatttcactcacattacataagaaggtgcccgcgcatgtgcgcgggctacctttctagttaatatattaatgcccatagatagatggactccttaattgtgtttcatgcatgcttgctgcttgtggcgagggtagtacaattcggaattcaaagacacatttgttttctcttgtttggagaatacaagtcagagaatttgagtgatccgaaggtgctcacggttc

SEQ ID NO: 75248 - DNA, 4388 bp, Oryza sativa
tacatctttagccctcttaattagtaaagtaagcatatcagctactatattaaaaagaattggtgacaaaggatcaccttgcctcaacccttatacgtttgaaaattattaccagtttgatcatttactttaataccaacatgacccccttgaataaaagaagctatccactcacaccatttaggagagaagcccttcatcctcaacgtctgttgtacaaaagaccatttaaccttatcataggatttttcaaaatcaatcttaaaaatcacaacacttttatttttacgatgtaattcatgcatagtttcatgcaaaataacaacaccttccataatatttctcctaggtataaaagcagtttgagtaggactaatcaccttttgagcaacactcattatcctatttcacacctatccattatataccactacttacccctttaacacattttccaagatattatgaccaaattacccatatattcttcttcatcggttcgtcccctcccctctctatcttgctcgtcgaacctgacatcctagcgaacgagacgaggtcacgggcgcaggggatgttcccacctggccggatgtgctcgcgctccgcctcacgcacttgctgctctctccggcgcaaccctccgtgcccatggctgccgtgctcctgcgctgtttcatttccgccagggtcacaggacacgggcctccacgtcggggatccccaagtccatttggaagaagctctcctactccaacaggaaaaggagcagcaggtgcaaccacctgctgcttgcttgcatccttcctaatgccatccaataggaagagtagtagcagctgcaaccaccggctgcttgaagggagaaggagatggaagatgaacatggtagagaactagagattggaagaggatgaggatgaagatagggacaatttggtcctataagtttagaaaatgtgctgaatgggtaagtagtggcatataatagataaatgtgaaattataatgacatggtttcaaatagataaatatcaatggcatatttcaaaaccacgaaagttataatggcatgggtccaattaaccctaaaattaaagatcttgaaggtggatgattttaataataacatttttggggaaaatatatgctagttaatgacatgcatgcatgcacgtcttatatcatgaaacaatattaaaaagtagttgtgccttatattatggaactgagggaatactagttaagaagatttacaaaagttttatgaataaaagcctaactttatggacagaaactatcaacatataaactttatatattcatatctctatctctatttattataaaaattgaagatgtttatgtcggtactttggtacgtcatccgtatttgaatcggttttaattttatgtttcggttttaatctcttatctctatcttctctacttaaaaagaacaagaaatttccataggcggtgaaaaaagaaaacaaaagtctgactaaaaaggtgaaagaaaagaaaaaaaaagtccaactcaacaagcaataaaaaaggggaatgctaaatagttgtcgacgtcgcatgatttttgatagctaaatcattgatgtttcaatatatttagaaccgttgtttcatatgttgtagcaaaatgtttcacgaggtgatttaattgtgtttcagcttttaaaaagattgaaacatttccaatctacttggtgaaacatttacggtgtttcagctttctaaaaaattgaaacattttcgatctacttggtgaaatatttttgatctacttgataaaacagttttaatctacttggtgaaacactgaatgatgaaagactaaaaaatcatgcgaatcccatatagatagtcccataaaaaaagaaaaggagaaaatcccctatgtacccatgaaaattcacctaatcccttttatacccctgaattttgctcaatcccttacatacccctgaattttagtttggatcccttccatgccctttccgctagttgaccgttaaattcttttgaaaaagttcattttgccctttgctatgaagaaacataataaattaatgaagtacattgttggaatgtaaaaatttattggatcaaactattatatttatgagtctgtgatgcaccatattatttgtgacaaatttacttttacatatgatataaaaagttaatacttatttattggttattaaaagtttatttatgtagcatatgtgttttcatagtaatacaacagatttgtttattactatcagaacacatatgctaaaaaaatcttttaataactaagtattaattttttatgtcatatctaaaagtatatatttatcgcaaataatatggtgcataactatctcataaacatagtcttatataacaaatttctatgctccaacaatatactctattaatttatatgcttctttataccaaagggcaaaatggactttttcataagaatttaacggtcaactaacggtcaactagcggaaagggcatggaagggatccaaactaaaattcagaggtatgtaagggattgagcaaaattcaggggtacataagggattaggtgaactttcagtggtacacgggggattttctctaaaaaagcttatgtgtcgtcagtaaaaaacaatcgtccgactccagaaaaaaaagaaaaaatagtctcaccagtaaaaaaacaaaaaataaacagttttttttcaccggtatttttgcgacttgtttttgcacgcaaacgagttttttttgtgcgcattggttttttttcgtccatttttttaaatccgttcaccgcgcccctcctagatgcttttggttttttttgtcaatttttttcaccggttttttctcccttgcagttttggtttttctcatccggttttttaatccgatttgttcgccgcacttctcccgagttgaacctcggtgccatattgattgtgtgttttctactacaatttgattgaaaaaaatcgattcccactcctctctcatcatttctccatgattttcctagctttatttcgtcagatttaatctaatagttgccgatgatgacgctccatatcgatcgtgcgttttctattccaatttgattgaaaaaaatcgattcccactccttcctcattattttctccacgattttcctggctttattttgctggatttaatctaatagttgccgacgaacttccttaatcgtttttaccccgagtttgattttaggaaaaacggaaagagaaaatcgagtggatcaaaaaccctcaaccaattttgggtggatttgataggtcgaaggaagcaagccaaacggagagaggtagcggactggcctagggctgaaaaggaaggaaggctttcggcctaatacacaggaaagattttcattaacttttttaattataatctatagtgatcccaacattataattttcattaactttttttaattataatgtatagtgatttcaatatttcattttattactcagctcttaatatatcattgacaatcatctttacccgttgcaacgcacgagcattttttctagtaaatttaaaagtcaaggttcgaaagacataaacaaagcccatatcaagaaaaggtccacttcaccacaagcacagccacacaaccatgcaaaagcaggccgaagaaaaagcatgaatgctaattcgtgtatacgtgctagcaaacaaacttgcgcgcggtcctgaccacgtcacgacaagcaccgaggtagggttagggtttcgggagtagggaggggaagtggaggatcacagttaaagggatggcctagggaggcggtgggcagtagtggcggtgccgaagcggcgaggtcagcagcaggtggtgggctagtgttggtggcgtgggcaaagcaaggtgaagggtagggccagtgttttcctcgttttccgtcggttgccgatgcctgaagaattcaagagcgaataactgaatatacctcctcaagactcaaagttaagaccctgtttagttcccagaaacttttcgtaaaaacaacacatcgaatttttggacacatgtatagagcattaaatatagataaaaagaaaaactaattgtatagtttgcatggaaatcgcgagacgaatcttttgagcctaattaatccatgattagctataagtgctacagtaacccacatgtgctaataacgatcgacttaattagctcaaaagattcgtcttgcggttttcaggcgagttatgaaattagttttttcattcgtggccgaaaaccccttccgacattcggtcaaacgtccgatgtgacacctaaaaaattttcatttcaccaactaaacaggccctaagatc

SEQ ID NO: 75249 - DNA, 15054 bp, Oryza sativa
tcaaagacaataaataaaaagaggaggcgcggacgggccatagaggagtataatggcaacgtttgatgggacttctaaaatttataaaaatgtaacccaacgagaaataaactttgaaaactataaggtccaatttttaaaggttctaaaaagaaagaataaatataatcagtggtggatcgagcaagcacataaaaaaggcgtgacaaagtaaggtgtagcagctgatatgacttaaaaactataaaattagaagcacgaggatgataaggttttgtcttttaaaatcttaagacaatgagatagctatttaataaattttaagtaaaaccatattaaaaaatagataattttgtatgggtgctagccgcgtaattgcgcgggccacccagctagctgtccagaatacaagcacagaagcagatggtggcatggatccagccaaattgtttatgtttgcttcagtcttgtttggtggttgtgtagcctccttggccacttctcttgaagcacgctgcctttcggtgtcatacagagacctcttcgcatgatcactcaatactgcatgagcttctgaaacaaatctgaatgctgcttcggcaccaaacagagtattattatcaggatgaagccgatacgaaagtatgttgtactgctttcttattactgtttcgtctgccattttatccacctgaagaacaccataccaatccaactctccagatatctttgcctcagctgaagaaagaacttcacagacagttaacagctgggagatgttctcaagctcaggaaaaagcctttgagctttaatcgcgatcttgcgggcaccgacaaagtctctattttccagcttctttacagcaatttctctggcactgaaggcctcctctctgttgcattccatcaaagtattccagaaatttgaccaagaaacccttcacatatacttgttccagaatggcattaacatgctctacctatcatgttatcaagatctataaaatgtgagaagaactttcagtgcatcaggccctgcatgcatacaaaagagcatttttattaacagaaaaaatatatatggcaaaattatgaatactctgggaaaaaaaagaaagcacatttggatatactcgtgtagtcttattcacttcagaaaatggcaatttggaaaaatgacatacagttccttcaaaacaaaagggatccattttgaaatgttttgaaaaaaaaactggatggcatctttccaaacaaccatattttgaagtggcatatatacattcataaaaatctttaaaaaaattgccgaaaaagaaagaggggaaatatttcgatcctactcgatgtctactaccctagcctcctaaagcacctaaattaagaggtctgcacgatcaaatcgctggccatatcctcgcgaagaacacactaacccccagaacgcaaaaccaaacctccgatccaaaaaaacctaacacgcacgcacaacctggcataaaccaacctacccaataaagaggagaactcggggcaatgggacgcaaatgctgaacagatgctacctccgagcagatctggggctagagcgtgatccgcagcggccggcgccggcgagccaccggggtgggcagtgggtgtcgttaggttcttagaggaagagcagaggcagaggtgaggtgagtgacagagtgagtagtctactgtggtcgaattggacacgtgtcatgctaggaagtgaagtcctcgagatcaaggataatttttcaatatatgccattcaattcgtcgcactttcagattttgcccctcaattcgtcacacttttagaatatgtcatcgaggacgtgaattgtttcattccgtgccactccatccatccaacgccacatccgtcaatctgtccgtgcccgtgccgtcgttcgtccattgggcggggagcagctcgtctgtcctccctgcgcgagccgccagccgatgaggtccttcctgcacgcgtcgccggctgcagtcgaagctagtggacgcggaaggagttggagttcccgcactgccgacgcgagcgttcatctcctgcgacacgcactcgccgttccggccacgcagcgtgcacccaacggccctgtccctgtcaccagcaccctcctcgtccccatgtcgtacaacctctgcccatggacacgagcaagaacagcatactcacaaacaagaataccccgtgaaccgatgaacgacatgaagtaatgtgtgcatgctcgctggtgatgtccgggatgttgaggccattggagaagcgaccggcggcggctggacctcgtcggccagcgagctgcgtgcgggggacctcgccggccgacgccgtgcgcgaggagcagctcgtcgatgacggccgaacgccccaatgtgccaatcgggaggacgtcggtagctggcggttctcgacggcggccggatgcgtatgctgggaagacatcgactgctgatggcgggcagatgtgtgcgcatggaggacctcggcggccggaggcgctcgacggtagcaagatacacgcgcaagtcattgccggtcggcggcgagcgctgggaggacctcgccggctggtggctcgcgcgggaaggaccgacgagcgagctgctccctgcccgatggacgaacgacggcacggcacggaccgactgacggatgcgacgtcggatggagggagtgtcacggagtgaaacaattcgcgtctctggtggcatattctgaaggtgttacgaattgagtggcaaaagctgaaagtgctacgaatcagatagcatatatactgaaaattctcgagatcaacggaagtgagtgataggggtctttttttctagggttaatttttttttgaccgaaaaacagtgggggagagagatggcaacgggtgcatatccatcgggttcctttgccccatacccacacgcatgatatcaaaatatttccacttaaatacccacacccgtcgcgggtacaaaatcgtccccatacccacacccatgcggataacgggtatccaacgggcacccatacccatataattgacttgtagtatttatagttttgtactctaattagctatattagagttgtaaaccattaatattttctctagcaacaatgctattaatattagtgttcaaaggcgagtaaaaaattatacaactacattacataatcaagaaatcaactaataattttatataactagtctagaacaatgcttaaggtgtgaaaagagttttatgctatgatttagtagtcgttgagacctatatggctctgttttaggctcaatcaacaggtttttttttacccacgggttggtgggtacgggtgggtaaagaacatacctatatccatgtatctaatgggtaagagttttcacccgttagtagatccatgggtataagagttagaacacgattagctcctaatggagtaaaaacccgtcgggtctcgggttatgggtccccattgccatctctagggagaccccacgtttttctagggttaattggatctatgccattacaaatatgcatatttagataaatgtcattacaattcgtcaattcgtaactatgccattgtaattttataaaattagaattgtaccattgctgttaggcttccatccatcttcctctttttttccgtttcttcctctttttttccggtctttttccattgagctaccgatttcttccggggggatcgatccacctattggcggctgtggatgatgtctggtggaggttcaggggcaccaacgccaccgtggccagtgcgttgattcttcctcctgccatgcgcggttggtggccagcgcacggcggcgtggcggccggcacaaggcagcgctgcggctgacggcgagcgcacggtggtgtggtgtccggcgcaagcacggcgggcggcggactcaacgcggtttcgacacggacttggcgagcggcggccggggcacggcgcgtgcaacggcgacgcagctcgggcatccggtgctgctcgccgttttttcttttttttttttcgttttctttttcttatgtgatggtgccagtcaccgtggggcggtgcgccgcaacccagcggctcggcggcgcaatgatggcggctcagcgaggacgtgcgacggtgtgacgcatgcatagcgggcggcaccttggcgcgctgcggccttggtgctgcttcggggcaagtggcggcgcggtgctgcagcctggtcggcgctcggcgtcggaatgacttcgtgtgtggcggctcctagtttgtcacccagacaaacatcaacaagacggcgtgttacctcgtggatttgatcggtcgattgcccagccagacatggtacttcatgctggcttccgatgtgaggccaatgagctgcagcctgcagcaggtgagcagggactacatggcggcgaccgtgccgccctgccctagcacgaggttctccgccgactgcatcgtcgccgcgtcgaggcgttcgtggtggcggcgcagcgggcgtgacgtgccacgccgccggatttggccaccgcatcgcccgatttggccgccgccaggccaggtgccgcgccgagccaccagcctgcgtcgaacccgctccagtggcgcgtcggagtggacggatgggaagaagatggaagagagaaggaacaaaacgaaggagatggatggaagaagacgggagaaaacggaaaacaagaaagagatggatggaaacgtgacagtggtggcatgtttctattattgtaaaatttcaatgacacggtatgaatatgcgaattgtaatgttatttatctgaatatgcatatttgcaatagcatgatccaattaaacttttttttctactcctctgaagtttatatactaggagtttatatatatttttttcgttggccacttgtgagtatattgactgactgcctgcctgcctgacgctttctatgattacttgtggatttaatagttggatttaatagttgggtttcttttgcagtaatttgtatcgtgatgtacaattaaggaaaaatgaatgtataactgacagaaaaataaatgaatgtaattgagagagagagagaagtaatgtttcatgaaattattagacaggaaacttctcttctttatacttaaaatgtacgttgtaacgggtcataaccacagaagtaggaatggactatagggtgatttgagataaaacattgatctggtggttgccttcggtgtaatggaccatgcccatataaatagatataggttataaggtaatttaacataaaacattgatcgggtggttatgggaggtggtgcgctcggttggaggataaaggaggatgatttagcttttaagattgtagagatattggatgaatcttctattcaagccatctcaagaaagggaattgtccatgctaaatgctactatctctatttttagcaaagtaacgtgtaccaaaataaagttatttcttcacctacctttttctcttaaccaatcacaaccattctcttctcctttaatcataaccctcgtccaatcatttctatctactttcgttatatccgtgtctatctcaaaatggtttcattatgggacagatggagtattatctacccatttattgccaattaaatgaaagccacgtatggacgggtgtgcctaatggatgaatgttcaagcacgaacacttttggcccggctcacatgcatctagcctaacaaaaaaagctatttcagaaattttttatgtgtatgtacaaacttttaatataaaaaaatatttgaatccaaatcaaacatataaacttctgttataaatctctactattttaaaaattgaagatgtttttgccggcactttggtacgttatccgtgtatgagttggttttcgaaatacagatccgtatttgagtcgggttttaagttcgttcgtttttggaaatgcagaaggagtcgtataagaaatttaaataaaaaattcgcatattaacttgagatgatcggactcctacttacagctcatggtttttttagaaaaatatatatccaagcgaattctcaagtgaatttcaccttaattaaaccatataacgataataagataaccttcacccgttgcaacacatggatattttttctagtttacttaaaaatagaacctgtacggtgccaaaaaaaaattaaaggaaagaacatggtgtataaagtgtctaagccgcacgcaaacttttgcacgatagcctttccggaccgcacactacacatgcgtgtaccctatttggcacgtgctcgcacattacacatacgtgcaccctatttggcacgtgctcaaaaaataaaagagaatactcttaatgtgtaaaagaaacgcgaatattatataatgaactaatattaaataaatagaagaggtgaggcttcgaacccataccgactagcccaccacattgtggagccagaaaacccccaagtatttttcatttatgtgtaaaagaaactccaatatataaaattgggaaaattgtaaaaaccaccccaaatatcactctgagtttaagatgccccctcataagaagatttgtgcaaatccccaccttctaattcaccttggtttgatttagacaccttctctccacacgtgcgtgattcctggagaatctcatggcgaaatcaacctagtcccacttagagtgaattaggaggtgggaatttgcaacaaatctccttataggggggcatatcaaacttagagtgatatttggggtggttttttgcaatttttcctataaaatttaatattccatatcacatttatatagacctgtggtcattgtctgtctcactgtctgcatgaggaaactccatactgaatattgaatcaccaccatgccactaacactgagacctcatcaggcatgcggtagcaacagagtagcactataatttgaggatttttatggtataatatactagtagtatatattaccagtataaatgatctaatggtttagattaatttgatcttccactcaattagcttgtaatataaattgacaaagggtatatttgtctttcaactaggtgaaaccccgcgcattgctgcgggaatttagtatgataacaataaaaaaaataacgtgcaagatagctagataacatcagattaagtaaattaatgtggtttatgataatttaaatttaaatagtatgtagaatggtgattgaaatgtaaaaagtaaggtggtatgactttatggaagaagaaaagtagagagatagtttggacagtagattaatcatttaaagggtaaaaacaattgatgtgatatgacttaattagaggaaaaaaggagaaagataatttaaaccatagattaatcatttaagcactaactaagtgaggatgaactatataagtatacaggatatcataaaacataataaagatatacattaaaacattatgtgaattatgttggatgataatttaatttaacatatttgtatttgaaaagctcttaaattctaaaaactataaagatatagcgtatttgcatgatgtttaaatgtgatgattgatagtggatgatggtgtggcatcttgttaattagtggatgatgatgtgtcatcttgttagtggatgatgatgtgtcatctttacatgttaagcttaaatagttagtatagttagtgggggataactttatagtaagataggaaaagggagatttttatttttttttcctttgacggatcccgctcgagcgaaatcctaattgagccgttcgccttccttcgtcacggcgatcgaccaccgcgtgcccacatgccacaggcaccctgcgccaccgcaatgtactagtaagatggtattttagccagaggaattaatgaacttcacatgccatattgaaaagcaagaataagattactgtgcccatggcggagattgagaaacagcatttttcatcaccaacagaagaattcatttggtggacacagtatatacaccaggtagagtataacagatccaacagattcatctatcaattttatggatcatggttctgcatgttagaccttaacagtgggagcaagaggtcggaggtgggaggcgggatgaggcagtgggctcgacgtggccaacctcgctgccatggtttggagaaggcagaggttgaatacgggggagaaagccggcggctagggtgggagcctacgaggcatggcgccggggacgcgggagaagccgagtggggaaggaatcgggccgcctccacgtgcatcgtcttcgtattctggaagagcgctaccatgaccacacgacgagatcgacagggtactcccgatagaaacaattgtgaacttcaaatggctaaaaagccctttccagatttttaccaaataccaaacatacccttctatatactgctaggatatacttgcaatacaatgtaccgtaaatgaattgtataattttctctgtgtaaacatgaatgaggatttgcacagaaagttaacatggccagacgaatctatgtttgggtaaatttagataaatcaggtgttgaacagctgaaatttgggtggaaatcctccattccttctgtagaaaaacgtcaggaactgaagcagggtcgagctcatagaagtcactgaacttcaaacccttttcttttaccagagagaacgaaggtatccgatgcgaaaacctgaggttctctttctcaggtatctccagtatctccttcccaatgtgaagcttgaacacagctatgtatccatctagtcgtctacttcactcagaggagaaaacagtgtgtgctgccttcagagcacctgatgatcttgccaatggcatactcaagacagctattgaatctggaaggagcccaatcaggtgaccagttcttgtagatggctcaaatctcacctacctttgggaaaaaaaataatttgccgatttgaatcacacatggatttgcagtttccaattctaaagatgccgcaactgataggtgtatcctgctccaaccattgcttctcctgttcgagttcagggcaaatctctagctatgtcaaatgcaatctgagtggatccagctttgatttcggctatccagagatagagattggggaacttatcatggtcactgtacaatgcccaaatttgctgatgttcaaacttatcacatgaccggacttgtggaattcagaaacaggatgcgcgcaactagtgaattcagtgttcggtctcgtgtcgagagacatgtaatgggtgagagcgatagaaagaaatgttgaatccaactcacttgaaagatgagctgaagtatctagctccagtaacccttctacaatgcatgtttctcctaaacagaagcttccgcgagcaacaggcaattcctcatcactccatttcgcctcttgtgcattcatagctttgtgctccagccaagtgaactgaactttgaggttggatatatcaatgtgatctattcgagcatagactcttggaatgaaatcatggtcgtcatacagtgcccagatctgatcaacttcaatcctgttgatatctctaaacttgccaatatcacagaagtctggatagtggtaggcaatcacaggattgttcagagtcctgactcctgagaagcagtatcaccggcttctttttggtaattctgttgatcgccttcatgttctgcatttctttccccatggatgtccaatttgatggggacatgatgttcagtagatagacttacagctgaattatcatccaatatttgcacataattagaaccagcactaggagctcaagctgcagctggtgaaggcaccatgatctgctcaacatttgaacttgtttctgtatccatgtgttccctcggttgaagaaagcttaatatactgggtctgctgtgatatcggcgcgaaaacgcttctgacgaagttcggtaattgctgctgaagctaaaaggaatctcgacggcacagcctgttcatgcagcttgaatgcaaagttcttactcccttttgtttgagagatgttcagatttgtgtgctgctttcatggaagcatactcccttttgctgtcatactacaaagatctcttcatatgatcacacagtattagatgagcttctgaaaccaagttgagagcagattcagcaccagaaagagtgttttcatcaggataaaagccacaaggcaaagcttgtcatgttgatattttaatgtggtgtcatctgctgttgcctccacttgaagaacaccataccagtccaaagtctcagtaggttttcgcctctgctgaagaatgaactttgcagacagttagcagctgataaatgtagtcaagatctggaaaaggcctttggcacaaaaaatgtccttgttttccaacttcttcactgcaatttatctgacccttacagcctcttctctgttgcattccaatatgtaaaaaagaaaatttagtgcatcagttcctgcatacatacaaaaaaatcactaatagagaaatgtcaactgtgtgacacatgcacccaaaaaacaaggcaaaatttcttgtgcacaaacaccacctcctatttcaaagattgactaggaaacaatcttacaatactacatggataccaacatcgcatacatgtagtagtgtagcttggaaacaatcttaataaaaaaatcactaattatcttaatacaattttgctatatatttgtcgacaaattttcccccaaaaatttgacagatataattacagtacaatcgtaatataattacactgtaacttgcatgtcattacactgtaactataatgtaacttgtacgtaactttcaaaaatctctccgtaacatgttatttgggtcaaatggaggtcgtgggaataaatcctttcacatatgtgtgtgctgtgattttttttcttcctcaccataacaaatcttgtatttccactgtttcacaatgtaagtcattctagcatttcccacatacatattgatgtttatgaatctagacatatatatctatctggattcattaacatcaatatgaatgtgggaaatgctagaataacttacattgtgaaacggagggagtaataaatttaacgattcaaaatcacgtgaaacttacatacaagttacactgtagttacatgcaagttacaatgtaattacactacgattgtactataattacatctgttaaatttttaggagaaaatttgtcaacaaatgtataggtggtcccatcaagatatgttctgggttattagtaatttatgaatcattccatttatcattctctgccaaacctagcaagtaggatttgttccaagtcaatggtattggagtcgacacagaaaaagaaaaggctgtattttctggacgagtaacagaatgacagaactacagaaaaccaaaaatgagtagcgtgcatcttcgatgttcttacgtttccaattaaatcactgaacacactaaaagctgtgtagagtactacagttcctggcctcctctttttcgggaaaatttgggtacactaatttgctgattacaatgtactgaaagaaagaaaaaagatactgactgcaagtctgcaacccttccatgggcatcgttcagtaatcagtagcagaggcctctgcaatggaatgtcaggatgggttttgaacataacttatccctgggtaaaacattgatggtattaaggttaatacagaaagtacaggctcatacatacaggagcatgctgccagacaacactatatgccgacaacagttccaacagtagtcagggctcaggagccaaacacaacttatgtcattttgacaggatttcacaatagcatttgaaattaagaaaatcactaaacacataaaacacttggagaaaaaaagtactgattgcagtgcagccccttccacagggtggcagccagcagaggcaactgtaatagaatgcatgttatgatggttttgaacagggcttatccttagcaaaacatggcatttgacaagtaagagaggccacataattagaatgttagtacaggtttctgaatagattacaggtaaggcatatatgtacacagaaaatgagtagaaccatacatcaagatatatcataattaagaccgaatttcagttctactgtctcaagagtctgctatggcattcgtaagtcatggagtgtctgttatgggtggaactaaagtgcttggtgaggttgcgaaggctataggagtggtggatgggtggctgaggccctagcactcatggacaccagagcgtcagccgccactgctgcctttgtgcctggcacacctctcatgccacgccggtaacgctggtacgttatccagcccataacagtgttcctatacaggaaaacgtcaggaacagaagctggatcgagctcatagaagccacggagcttgccacctctttcttctgtcaaaaggaaggaggggattcggtgagaaaacctcaaacgatctcttgtaggtatctccataactgcactttgcttgtcgggcatgaacaccgctctgaagccattaagttgggtcagaagatagattattatacttgcttccgtgcgcccaacaatctcaccaacgacaaactcgcaagtatctactctgggaggagtccactcagatgtccagttcttgtagatgcaccaaatttcacctacttgcggaagaatttcaatctgccggtttgagccattctatcctgtatgtactaaatgagaaagaataatttctctcatacttggttttccagtcccggattttaaatttaccacaagagactggtaagtcctgctccaaccaccgtttctcctgctcatattcaggagaagcctcaagccagatcaaatgcactatgaacggttgtcgctcgactttgcttatccaaccatagaacttggggaatttatcaacatcactgtataaagcccaaatctgcccaggttcaaacttctcacatgtgcggtcatcttcgaagttatggaattctggatcaggatatgaaaaaatagttggggttggggaagggcagcctggcccagaattattgccaaaaccattggcaacgtggccatttttgggcaaggatgagtttttttcagaagaaagactctccttttgtgcttcagaaagattctccgtttgttcatttccaggatcctttctactacttctactgtcagtcgtcaaatcaatgagtgtactgccctttttcttgccaagggagatgtaagagtccagggtgacagaaggaaatatcatatccatgtcaatggggagacaagaagtgtcaagttccataaaccctgccggggcacctactttttcatttccagttgtcctgtaacaggggatattatgagaaaatcgaagcaactcactcgatgctatcacaactgcagatttgtctttagctgccgcaaataaactcacaaagcctttaatcctgactaatgggataacagtgataccatcattaactgagaaacctgacaatatttcaacaacttcataatcataagaccgatggctgtctgcatctgaattccactgcatgctccaatccttataaagagcccataactcacccttattaagatatacttcataggcaatcctctttttgccttttgtccatgaaacaatgtgagagaacatgagtctgtcatgttgaccctaagcaaaacttaccacaagcaacaggttgttcttcatcagcccatttcttctcttcttcacttgctgcattgtactccaaccaagtgagatgagctttgaagctggatgcatcaaaatgttcaattcgagcataaaatcttggcatgccatcaaggtcgtcgtaaagggcccatatctgaccaagtgagaacatattaatatccctgagcttctcaaaatcatagaaatctggatatggggacggaagttctaaagaacaggaatgctcattctgacgaacagtattagtagcttcagcattggcattgtccttatcatctgtgtctgaagtttttcctttaccttgaatgtctacttttcttgtcataggaggtggattatattgtctgtcagctctatgggcagtatcaccgaacgttttcttacgattcaagtgaacagaaaatggaagatcattcttcttttacttccttttaccattggagttcagtctactgttgccatcaacatctttctttctgttagctggtctggagacaccataggaggccgcatatatactgtgggagagacagattggctgagaggaatcaccaaacctgttggaactatcactattcttctgaaaggttacctttttttgcaaagaaagatcttcatgatgttctgcagacagcaggcgacaaacatgtgcttcagactgattcacctttagccgaatagctacacgatttgccattctttcctcatggctgtccactttgctggtgactttatgtccagcgggggatgattgtgacacatgaaacttgcgagctttttttgtctttggaccttctgaatgatcaccaactgatgacaaccctttgcaaccatcattgttattttcttccctattgaggaaaatgtcaggaacagaaccaggatcaagctctaagaagccacaaagctcaccacctctttcctctgtcaaacggaaggagagtatttgatgagaaaacctcaaacgatcttttataggtatcttcagaactcccctacgctggtcataaggaaacttttatagttgcttccgtgcgctcaacgatctcaccgatggtgaactcgcatgtagctttgctggaaggagtccagtcaaatgtccagttcatgtagatggaccaaatttcacctacttacggaaggatttcaatctgccaatttgagtcaatatgtcccgtatttactaaatgagagaaaacatcatttccgtgatacttggttttccagttccgaattttaaattta

SEQ ID NO: 75250 - DNA, 1300 bp, Oryza sativa
atttgggatgggtgaccgaccgggaaattcttcccgagtgtacacgagtgaggacaaagtgtgcagaaaagacatgtgttggtctgtgagggcagtcttatgacctatgaaagctatcagatgtaagcgggcccggcaatttgggatgggtgaccgactgggaaattcttcccgagtgtacacgagtgaggacaaagtgtgcagaaaagacatgtgttggtctgtgagggcagtcttatgacctatgaaagctatcagatgtaagcgggcccggcaatttgggatgggtgaccgactgggaaattcttcccgagtgtacacgagtgaggacaaagtgtgcagaaaagacatgtgttggtctgtgagggcagtcttatgacctatgaaagctatcagatgtaagcgggcccggcctgggggaaggcgggacattacaatctccctctgtattatctttttttctccatttttttaaaaaatactcccaccatattaaattttaatgtatgtcgccgtttacttttttatcaacgtttgatcattcctattatttaaaatatttatgtaattatgattttttttattatgacttgatttatcatcaaatgttctttaagcatgacataaatacttttatatttgcacaaaaatattgaataagatgaatggttaaatgttggtaaaaaaatcaacaacgtcatatattaaaacatgaagggagtagtttctttataaaatgtaccccacactggctccgctgaaatggaggagaacggcagaagggaggattggagcaagggagaagaagatttgagacttggacagtggagtgatgaaacggaaactggagtggtaggagacagttgccatcttcgtcttttccccctcttttctttctctattttttcacccttctttagctttacttcagtgactattaatacttaacagtcggttaacttatctttttttcctcccattttttttaaaaatactccctccgtattaaattttaatttatgacgtcgtttactttttaatcaacgtttgaccattcatattatttaaaatatttatgtaattataatttattttattgtgacttgatttatcatcaaatgttgtttaagcatgacataaatacgtttatatttgcacaaaaaatttgaataagatgaatggctaaacgttggtcaaaaagtcaacaacgttatacattaaagcatgaagggagtagtttctttataaaatgtaccccacattggcttcggtgaaatggaggagaatggcagaagggagg

SEQ ID NO: 75251 - DNA, 1709 bp, Oryza sativa
gacacatttgttttctcttgtttggagaatacaagtcagagaatttgagtgatccgaaggtgctcacggttcaaatttctcgtgaaaagtttaggggtatatgcattgttctgatacttgatcagttaattttgtgtgagaatggtcttcaggtgatctggaagttttttgcttctgattgtagcaagtaattagtagataaaatcttcaggaatttagtagatgagattttttttgagaactcattttctagtcttttatggaaatgataagtttagccgcaatccatgtacaatacgaacataattgagattcccgatatgcttaaatatgaacttaattgaaaaatccttattattcttatcattttctcatcaatctttaaatatgcttcataacttggatttgcctaagattaattcccagagtttagtgattcttttgtgcttatctctctagatcgtttttgccttcttccagtgcagttcaattgctcaagattaaattttgttgttgtgctaagtgcaaaattgtaaataatttgtgtgctatctatagtactgcttgtctgaattgatagataagtggactaaactgacttttgctattactaaatattcagtccatttacaatcatctggatccaatggtggccattatttaaaatgtcagtgtctaccagggttcacaattttggatctgaaatttcgataattatctgtctatcggcccccaccccccaatacgatataattttggccgaaatttttaatttttttcatttttttcgtgaatttgttaatatgttgttcaaattttattcaaaaatttataaaattttggaccgaaatttcggtatttcggccaccctcgatacaaatcagcaaaccgaaacattaaaccctggtgtctaccatgtcagaaaatggtatattggttcagtctgtagatcttgttactccatagagatgattaattattggggcttggagaaattttttgtgtttcagaactgtttaagtgaagctggtatctagtgcttcagaatgctgaaagaactactgcattgcacccagcatgtgtgatatccaactatgttagtttcatgtccacatttagttctgatgcagctagtctgaatgcttaggtcacttaattaaagcatgggttttccttgctcaagcacaatcctttcttcctatagaattggtacccactacatatcattactgctataaagcagtacaggaataagccacatcatcgagggattgcagccgttagatctcatccgagagataattctagccgcgcgatatggttccatcggccgtcaatctcaggtgtgcgttcacttattgcatggttgggccaagccatggcccatttcttttctccagttggcccatcactagtcctttcttcctatataattggtacccactacctattattattgctataaagcagctacaggaataagccacgtcattgagggatcgcagccgttagatctcatccgagagataattctagccgcgtgatatggttccatcggccatcaatctcaggtgtgcgttcacttattgcatggttgggccaagccatggcccatttcttttctccagttggcccatctctgggcacaaagatgcaaggcgatcactgctcaacccaccttctaaagccctaagtccaatggcgcagct

SEQ ID NO: 75252 - DNA, 14814 bp, Oryza sativa
acagggctcaaaatactgattgaaaacgatgacggatcatgtggaaaccaaacaagaaatgttgtttataccgagatactttctgctacaatggaagcggtgtgccctcactgccatattgcatatattttatctctatatttacctacattcttggtgtcacattgggcatcatttcctattgcaggcttggccgctccatgcgtagctttccctcctcagctaattgcaatggcttttgtatataaattttggagtaaatatattgtactcacatgtagtatatgctgtatcactgctgcaccaataggctactagatttctatgtgctgttttctcacttgcttagttcattacagtgatgcttcatatttacataaactaaatatcttcaatatttatttgcagccttccaatggcgtacgtgcttatttcagaccttatgtatggggacactgataaacggatcaaagcgagggtatctaggcaatgggactaccatgatctgaatgatgaaacaaagatctaccacactgatcttgtcttgctggatgaaaaggttatagtctaattaacactcatttcttctttattaatacttacatacaaacatggtactaacaaggtgctttatatacacaatatgcagggcaatagcatccatgttcaaatctatccacctgccatgattaagcttaggactcttctacaggaagggaaggtttactactttgactccttctctgtcagatatgcaaacagaacatataggccagttacgaaccctttgatgatctcattcactaaatggacaaccttagaagaatgcattgatgcttttgatgattttcctgccataactttttcattgacaccttttcaagacgccccgtctcttgtggacagaaatgctttctatgttggtataacctctttatcccttttttgtcttcctacgtttacttcttatacattagtggtttattgtttacatatatcttctctttaaccagatattatgggtgtcataactgaaattggtgcaacagacactctacgcccaaaatcaagaaacacagaaactttgaaaagaacaatgcagatttgggatgcaaggtaagctacaatatagactgaaatttccctttgttataaacttcctttaccttatattatccacactaactattgaatcatttgtttggctctttgaaacctttctaatagcaatgtcaggcaagcatccgagcacaattttcactgatcaagacgcagccattgcagcagcaattgcttttgtactcccggatataagtcattgtctttgtttgtggcacatttatctaaatggttgtaaaaatcttggtcatgtaattcataagcatcctaacaagtttctaactgattttaagagatgtgtctatcaggacagatcagagtatcatttcaacaagatgtagcatgaattgttgagtgaatacaagtttgaggataacgtatggatgtcaaatctgtatgctttgaggaagaagtgggctattgtgttccgtgactcttttacaactgatatgacctcgactcaaagttgcgaaagtatgaataacgtcttcaagaaaagatttcataggaaacttggtctttcggagctccttgtagaatgtgataaggttgctgctagccttcgtgaaattgagttgcatgcatattttaagtcacgaaacttgaaccccgtaacttgcatcccaaatttacctatgttgaagaccgtagctgactcattgttgacggtcgtaagcgattagtttcaaccgtcaatattaccaaaatagaggagaactagttatgcttgcaatgcatattcatgttagaataataatattccactagtattaggtttactaaccttttacagagaataaccataaagtggaggagaatcgacatcgaatcagacgataaatcaatcggacgatgtcaaggatatacttatcaatgaatgggccaagaacttagaattttcacgatcaattgggccaaaattcacaagtctgcaaagagtagaagtctaggaggccgccattcgaaaatgggctggattggaccagcccatggctcagccgaacccccatttgctccgttggatgcagggtttggcgtggacgtccaagattgctccaatgacggttagagggcatttccgaccattccaactgccataaccgtcattgggaggctataaaaggagctctcatcctcactttctatacacactacaagcaaagctctagccaaattcatgaccgttccacactacacctacatgatgatgaagatgcctggtcctcgaggtgtcatatcactacggagcgacatcaagcaagccgtcacatgtgacaaagaaagttgcgagatggcccagacccgcgagatcactctcgctcgcaaagacatccgactggctgcgaccatggcaagcgaaggagaagtgcctgcgaccaagctgtcaaagaccgaagaaggcgacgacaaaactaagaagattccactagatccctctgatcctactaagactgctgtaataggcgctgagttagattgtaaataggaaagcgcgctcatcacctttcttcaaaataataaagatatctttgcatggaaaccatctgatatgcctggtattcctagagaggtgatcgagcactctttacatgttaaggaagacgccaaacccttcaagcaacgactccgccgttttgcacaagacaggaaggatgcgatcaaggaggaattaaccaagctgttagcagcgggcttcattaaagaagtccttcatcccgactggctggctaacccagtcttggttcggaaaaagacggggcaatggcgcatgtgtgtcgattataccgacctcaacaagtcttgtcccaaagatccttttgggttacctcgcattgaccaggtagttaactcaacggccggatgcgagctactcagttttttggattcttactcgggatatcatcagatccgactaaaagaatccgactgcttgaagacctcatttattacgccttttggggcctactgctacatcaccatgccctttggattgaagaacgcaggagcaacctaccaacggatgatttagaggtgtttttcaactcagatcggccgcaatgttgaagcttatgttgatgatgtagtcgtcaagaccaagaagaaggatgatctgattgcggacatagaagaaacttttgcgaacatccgcgccttcaggatgaaactaaaccctgaaaagtgcatcttcggagtactgtcagggaagctgctcggatttatggtgtctcgtagaggcatacaggccaacccggagaaaatcaacgccatcctcaacatgaaaccgccgagctcccagaaagatgtctaaaagctgactggttgcatggcggcgctcagccggttcgtctcacgactcggcgagtgggggatgccctttttcaagctgctgaagaaaaccgacaatttccagtggggacccgaagcacaaaaagccttagaagacttcaagaaacttctcactactccaccagttttggcctcgccacatccacaggagccgctactgttatatgtgtcggcgacctcccaagttgtgagcacggccctggttgtcgagcgtgaagaggaaggccatattcaaaaagttcaatgaccaatttatttcgttagcgaggttttggccgactctaagacaagatatcctcaggttcaaaagttattatatggtgtcttaattaccgtcaggaaattatctcactactttcaaagtcactcggtcacggtggtcacatcgtttccacacggggatatacttcataaccgcgaagcaaacggatggattgcgaagtgggccttagaattgatgtctttggacatatctttcaagccacgaacttcgatcaagtcacaagctttatctgatttcctcaccgagtggaccgagtgccaagaagacatgccggaggaaaagatggaatattggactatgcattttgataggtcgaagaggcttacaggcactggagctggggttgttttaatttccccgaccggagaaagattgagctacgtattgtggatacattttcctgtgtcccataacgtggcggaatacgaggcgctgctccatggattaaggattgcaatctctctaggcattcgccgactaatcttccgtggagactctcagttggttgttaatcaagtcatgaaagagtggtcctgtcttgatgataatatgaccgcttatcgacaagaggtacacaagttggaagataaattcgatggactcgagctcacccatgtcctccgacacaataatgaggcagcagacagactggccaattttggctcaaaacgggaaacagctccttcagatgtgttcgtcgaacatctttacgaaccaaccgtgcccagaaaagaaacaattgaagccatggatactcaaggcgtaagcatgattgaaaccgactggagagaacctctcataagatttttgaccaaacaagaactccctcaagacaaaaatgaagccgagcagatttccaggcgcagcagactctacgtcattcacgagaccgagttgtacaagaaaagcccatcaggaattctgcagcgctgcgtatctttggaagagggaagacaattgctaaaagatattcattcaggcatctgtggtaatcatgctgctgcacgaaccattgtcggcaaagcttatcggcagggtttcttctggcccacagctgtttccgacgccgacaaaattgtgcgaacatgtgagggttgtcagttctttgcccgacaagctcacttaccagctcaggagttgcaaaccatcccgctgtcttggccgttcacggtttggggtcttgatatggtcggtccattcaaaaaggcagtcggtggttatactcatctctttgtagctgtggataagttttccaagtggattgaagccaaaccagtcatcaaaatcactgcggacaaagctagagatttcttcatcaatattgtacatcggtttggggtaccgaatcatattattactgataacggcactcaatttaccggcggagtatttaaagacttttgtgaagactttggcattagaatttattacgcctccgtggcacaccccatgagtaacggacaagtcgagtgcgctaatggcatgatatttcaagggatcaaagcacgagttttcgaccgactgcgtccctatgctggcaagtgggcagaacagctgccgtccgtactttggtctttacgcaccactcccagttgggctactggccagtcgccgttcttcttggtttatggcgcagaagcaatgctgccaagtgaggtagagtttgaatccctccgatttcgcaacttccgggaggagcgctatgaagaagatcgagtggatgatatcaaccgactggaagaagcccgtgaaacagccctaatccagtcggctcggaatttacaagggttgcgccgttatcataatcggaatgttcgatcgcgagcccttttagtcggcgacctggttctgaggagaattcaaactacacaggatcggcacaagttatctgccttgtgggaaggaccgttcgtaatagctgaagtcactcggccaggatcttaccgactcaagcgtgaagatggtactcttgtcaataattcttggaatattgaacaccttcgtcgattttatgcttaggcatttcgtttgtatctttcctctttgactactaacttcaagttttttccttgaagctttcagtcggggggatgctataataataatggaacatgatttttatcaattcaatttgcttacttgatttatcattgccctgcttgattttttggcttagtcaatgaggactgaaagttttttaataacttttgcgagttctaggctcaataaggtttgacaaacacttttaagaaatcagaggctaagttagaattgtctagcacaacataaattcatcagtattgtacaaattgatcttccatcatcatcagaatcactgttactaatcagtgtcagttctttcatcatcggaattatcagacccagtcggccgaaggtcggcatcttggaatctctcaactacgtcagcagcaatcttgtcagcagctttttgcgcatcattgatgaggtcgagggctgtttcttcgctcgtcccgtctgcaaacccatcaatggcgtcggtatcgattttggggtataaagatttggtcatggctaatgccatgcttgctcccatactcccagcctccctgatattcttgaagtaagtatccagagcgactcttagcttgtcaaagatctcggaagcgtcaagtgtactcggaccggtgttattgaagaacatggcttggatgagtggggtagcggcattagcgactttatccctggctccttcaagcctattgatcttgtcaactaagacatcaaactgtgcctgggacttgattttgcgatctgcatcaatagattcatatcagcgaacggctataagaacatggggaatcaattatcattaccttcatcatcttttaaggccgagtccctctgctttgctaattcggccttgtctttctccagagccttgacctgcttctctaggtcggaaatcctagcagcttgcactgtaatatttttcggttaattgatatcacaaggaaggcttcacgaatacgtcagacagatatggtatttacctttggacgaaccactcaattcatagttggattcttgaagctcggagattctattcctcagatcatctcagtttttctcgcgagctccttgtcctcatgtagctggtttttagtagattcgagagttccaagatggggaactaatttctcaagagttgtggttttcgcctcattcctgagatgaatcctctgcaatatgaatttatcggcgtttcagcaagatatggaaggggacaattaaagctatgcacaaatggacttacatttacaatatgagtggcctggctgagtgtcttttttagcaagcatacttcttcatcttctttctgcttgcttatcacgatttcttgaggttgcatatcgtcgtcccaccacttaattaggatgggagggcgcgagtcttcagccgcctgtatacggggaatttcttcttcatcaccaatcattggtcctaatgtatccacgtataaaggttagacgattgattagagtcatttggatcaacacggtttcgggcaaggtgtttacccgtgatgatttccgaacggggacgagtcgactcttgcgtcttaacgggagattctggcgtcgggtcactgctggtgtcttgtttatgagggttgtctgcctgagctccaacttctggaatctcttggcttggtctagtgcccgactggttttctatcgggggctcctggttaaccccggctctagcctcggccgactcgtttccggttgggggttgatcaccagatcctacattatcggttgctggctggttatcactcggatgatcctcagcggttggctcggtttcttttaagtttgttcccgtgctggtcgggtcagagtcttttcccgaaggatctatatcagatggtttcctacaagtttggttatcagtattattactacactaggtacacatcaatgcaaggaagatcgttatgtgatttgtacctggaagacttcctgatctttggcactggatgactggatgtttttttccttggagtagcctgcttcggcagtttcttggttgtttctcggtctccaggctttctagcggtatcgccttcgtcgtcactcgacaccaacttccttttgcgcgaatctggctggccggctggatcggaggtatttggccgggcttcggaacggattttgggaccctcgctcccttgaccggtttggtggtggggtgatcggcgttgagtgattgggggatccgacttcatcaaagcaaattcctaggcgtaatatccttcattgttaactaattcaacaaacagacaagaccatattttgtgaaaggttgaagtgtttgattacataccggtggaggaggattgaaggcattgaatggcacgactggcagcaagtgcgaatagctgacgatgatggcatttgagaagatcttgtacatcctttccttcatgaccttaaagtcaagagagtctggatcttcacgatttggatcatgtttgctgtcaaactcaaaagctgtgcgggatctctctttgattggagctaaccggctttttatgaagtgccgcgtgatttgttctccttacaaaccctgctcctttagctttatcatgcgctccatcagttccactgcttgggcagcctcatctcctgtaggcaatgaattccatgtgtcttggtagaccgtagggagacaagaatactcgggaagggctggttcaggattttgaacgtagaaccagttggcgtgccagcctttgtttgaggtcttcaagggcatggagaagtatttttggcttagtgttcccctgagttggaaaccagcgcccccaacaacacatggtttgctcttgtttggctggggcttgaggaagaagatgcggcggaacaaggcgaaatgaggcctaatgcctagaaaagcttcgcaggcatgaataaaattggagatatgcactatggagtttggattcagatgatgcaagctaatcccgtagaagttcagaattccccggaagaatcttgaggttggaagagaaaatccgccatagaagaagtgagagaataccacgatctcatgtgtatcgggggtcgggattgcctcgccgaacgctggtcgccacccgatgatttccttcgccggaagaacgccgtgcgccaccatttcttttagattctcttccgttacatcggagggagcccactgactctcgaaactttctctctcttctgccatggatgcaagttgaatggattgatttggtccaagatataggtggaggggaatgaggaatcaatgcggtggacatgcggagaggtttcgtgggattttttgagaatggattggggcggattgatgaaccctagctttgacggtgcggtttgatactgtagcaaggagtggggaaatggcgagagtctcggcggggaaaacgaagcgccgcttggactttggtactttgttagggtatcgggagtgctaacaggcctaggcctgtacagtacttcagcccaatattattaccagcgtggcccattgtgatccttaggaacttaggcactttttgctttagcaatttgtgctcacaatgatgtgacccgatgctgctaaaatcctttttaatgcgattagataattctttagaattactacgatgcaaataaaaggtacccaacagaaaagtgttatactatttttgtaagcttttttaggctacaaaagctgtttgggttaatttgagatgactggtttattagtagtcattctcttagcatgttatatgcttattttgattatggaaagggttatagcctaggctattaaacttcttaattaccatgatctttatcatatttggtggatcattttaagagtttcctactcggattcttgtcaaatgtgtctttttgtggaccttttaagtgtttctcgctcgggcccttttcatatttttattcttgatatattcaagtccaaaagcagtcggctgggtattatactgaatactacgtgtgctcttgtcgtttgatgtttggttgtaaaaccgctcggttcttgactacctgtttagtttttcaactaactatatagtcgggggctatacctaattaggtgcatctactcgatgcaccatgttttatttttgcccttcacagtctttgattctagtactcggcaggctaaagcaggaagaggtgaagcactcggattattgttttttgttctgagatggctatttcggcgactgcaaaggtctcgggggctagtgtggagattatggataccccatatctacatggcagttatatttcagctgggtacagggtaccgaatatagatagaatatctttatgaggactcgggttagattctaaacttgtatgtcaaggaaatacccgggatcctagttggttacgattgtattttatctataatcccatattccgttgggatatggactgtattttgtaaagcggaccctttcccctatataaggaggggtccgtgtgcctctcggggcacgattttttcctagataatacgatcaataatacactcggcggaatcatccccggacaggagtagggtattactttttgaataagaaggcctgaacctgtataaaattcctcgtctccaaacccatccactttcctatcttgatagccaccccttttattattgccgaaatcttgcttcgacaaaattgattcaggagaggaagggattagtgagtagattggaagaaaaaaaaacggccattcatactcagtggtgtgtgtggaggaggaaggtagagaggtcaccagaagtttgagaaacggattcagctcatcgaggtagtttcatttttggcattaaacagtaagattgatgagggagatgataggatgggtgatgggaattagtggatacgttgctgctttcatggaggaaaaacgtccgaggattgaagacgaagcagaagcggtgtggccgtgcgtgggcagtggggagtggggaggatggcggcttgggttgggctgggctggctttggcctgtgtacagaggaaagagatcgttagaaacgagagatcgaagagaaagagaaacaggagagagagatatacagagaaattgaactaggctgcaataatctctactgctttaaaattccgtagtggtgatggtgactccaaccctaacagacacatgtgatattatctgttggatcgggatatcggacggtgatcccatcgcacgcgattcgcttttctggctttcctcccccgcgattcggtttcctcccccgcatcgtgcgcgtggctccgtcgcgtcgctgctgtctcagccggcccacgcacagctccgccgcctgcgtcggccccgcgtccccgtgtgcccccgccggcgcacgcgcagctccgtcgctgccaatggccgcgcaagcctgcgccgcgtccaccaccttcgatccgtcggccccgcgcacccgcgcgtctccgccgactcccgtgtgttggaattaatagataggccttaacccattcgaagattaattctttggtaaattacaaaaacccacctcatgggatgacatgcatgtggaatttagtaccaccttgcttattctaggagagggggacctccttaaaagagaggatgcctcctagccacttgaagcatgtgtggtggagagaagagggggaacatgcgcgcgctcgctcgctcgcctggcagggtagagcaggcggtgcgtgtgtacatcgaatggtccgcaaaattggctcctcaaccttgtgtagatgtagcctccttttgcagttttgttttgctgcaggaaattcggatttgttttgttttggaaacattctgaaaaatccggtgcgtgaaaacggcgtggggtccagataagttacgcgcgacttgtccggttcggttacgcggagtggagatcgtgcgggcgccctgatcaagcgacctatctctatataagccgagccgccgcattcacgcaacacacgcaaaatcaatctaggtttgcctcctactctgtgctgcgccgtcgctcgtagactactccatcctccggcgtgcaccggcgatcgggggagcaggtctcctgaacctctgccttcgacgtcctgcaccgggagaaggcggcaataaggtttttgcgaagcgcttcgcgtgactgcacccctgttcgtccgcgacggctcgccttcctctcctctcgcgtgctgcgtgccttcatcgacgcccgcaaccgcgagtagttcctgccgagtaaccggtctttccgccacctcggtacgtgttcgatatgttgcacatatttaatctgtttatgttttactgcttagtttacatgcgtagatctaatgatgcgttcatgctagtttatatctgcaatgtcatgatttatttatggaataaattaaatcattatgtgcttataatttcaacaccgtggacccgcgaggctccgtggcctccacgtgatccctcgcgcctccgccgactcggtcgcggctccccggctccgccgcctccgcgtgggcaagccccgcggtcgcctttgtcgcgagtcgccatctccgcgtcgacaacggccgaagcggtttccagccccgtgtggttcggttgcatgcacatgcatttgattcccatcctgcgagtgtaagtgccatgcacgggcgcaagctgcatgcatgcgcatggcactgttcatgacgaaaaaaaaggaagaagaagaagaaggagaaaaggaggcaagaaagacagcacgactctgcgctgcggaagcggttccgcatcgtgcgtaatcgctaagcggcctacgccggcctcgctgcgtgaggccgcccccgcgcctacggccaagactccgcgggccacaccctccgccgactcgcgcccggcgccagccccgtggggcgcattttgcctctggctcggccccttccgctggaccacgccacggcgcagaggctcgcgccggcggactctacagtccttccgctggccccgcacagctccgccggccacgcctgccttaaagccaagctccaccagccacgcgtggcttcgcgcggcacccccggcactcgccttcgcgcactacggacggcgctgcctccatcaagcaccgcggctttcaccgctagaggggatggactgacctccatttctcgcgggctctggacggtggtacctccgtcgagcaccgcggctttcaccgctagagggggtggaccggactccacatctcaagagctcaagacggtgtcgccttttcagtgtggtctttgctgagcatgagggtatccgatgcaaaatgcaggcatagatcaacaccctaagaagcaggggctggaaatcatctgctccccccgaacctcggagccagcagatgagggggtattgttgaggaataaccccatacttagggtgttgtataaactaatgtataaaaggactaaaatacatctaagaggatgttgtatatatgtagccaatcaagagcaaagatgtaattttcttttacatatgaataaaaggagtcctccaagggcaagtgagagggatctctcccccattccattgattctctttctctctcattcactcttgtggtcctcatagggctaagcttgggctccctcccattggagggatgctctagccatgcatgttggattttgttccaacacctacattgttacattgttcaatatatataaagaatatcatttcacctttttatgcaatatataaacgatatactttattaaacccgttgcaatgcacggacacctaactagtaagaaaggaaaaaagaaaagaaaaagaataaaaagagaggaaaaggaaggaaaggaggaacaagaaggataataggattttctggaaaaatagaaatttagagattttggactgttgaggaatttctctggattgagaataaatacttccaaaattgagctccactcccaaaactcaaatagaaaccaaataactctaattaacaaacgataaaataaatggcggtgtgattaatttatttagtcaaattaaacctttttcatttatgaaatttccattaagctattttaggcaaataaacacgaatgctaattttcaaaattaagtaaattagaagacacgacaaacaggacctgataaggtgacaatatgtagtagtgggtcccacctaggacccaccataatacccacttgagcattatacattgctgttgccctaaaaaaatgaaggaataaggatagctgtgaagtccaatcctatgggaagctaaacctaaggaattgtaaaaaaaatgtgcattccgatataccataggaaaaatgtaggaaatctgccatttgaaatatatttttttaagtttgcatcaactgacatcgggcctcatctagccgttagctttggagtgcataaatagctctagttagccttgtgcaccattctcccctgttctttctatttgctcatcaaccgtgaaaaaccgtggaagaagcttgctgatcctttcttcttgtcacgcccagaaatttgctaacccgaatttcaagcagaatgtgtattaaaatctctatctaggatcagccagagtagacaaacgacaatttgataaacagatccacgccttacaaaaataataaataattcttacaaacgcagcggaaaaacaaataagctagacttaatcttcatgaccaaaagcatagctttctccataaaccacaggcatcctcaacgtccggaacaagctcaattctcatagtccggaacaagctcaattctcatagaactcaccatctgaaccaatctctgtctctctctggggtggagaaaaataaagcaagactgagcaccaaccaccatactcaacaagtcataccaacggaaatgcatgatgtaagatattcacaaaggaatggctcattggatatttccaataaaagcagcatttataaatcatattttgaataagtaaaacaatatatgtaattaagcaatattaaatcatcactgttcaacgctaaa

SEQ ID NO: 75253 - DNA, 6880 bp, Oryza sativa
cacataagcacaatatacttctatttcatatgacatttttttatatattatatatactccatcagtttaggtcgatgttactgtgtatgaatagtagatctggttgagactttattttaaattaaacataccatataggcaatcctttagttcttttattttgttttttttagtttagtcctaaaggaagattccaaagttacaacttgcaacttattacttcctaatttttttaatatcaaactaaaaactaccaaactgagagtaaaatagaagaacaaacatgaagtgattaatttcagaaatattaaatcatgaaaaattttataattgttactgcaataacagtataaatcgatacttactaattacaaattttagaattacaaaataatgtaaatccataaatgagactccaaaccaattacaattcaatagttattagatattattttagaattattaaatcatgaaaaagctaacattaagttattaaatattacaattcaatagttattaaatattattttagaattattaaatcatgaaaaagctaacattaagaccccaaagccttttctctaagaaaaacatcaagaccccaaactgagtacaactcgatattttctaatcatgaatcgtaaatcattttagacttcaaataatatacaattgtatactaactaaccatgcatattaaattattatgtcacgaaaagctatgatggaggagaaatatcctgtgcacacaagcttttttatacaccgtacacactaacaaacaaattttattgaaaaatgtaaaaaaaaatgtacatgtatttctaatattgttgcacttatgtgtaaagtcttaaccttaaatttattatattttagcagcaacaaaaaatataaaaattctgatagttttaaaattataaatctatcagatttttttattccctatatataatgtatttgaagatgactgtttatacatagatgtaatattactaaaagttaaatgtatgtgtacattattttctaaaattttttattatatctttagttggtgtgtataggatatgtttccataattgagactgtaaacatagtaaaactttaaatgtttgagaaattttagttaacataaaagttgtaaatgagactacaaagtgagtatagcagtactcctttaactatatgtttctacattaaattgtacctaatgagtataaaccgatacttattagttcttattttttaataattaaattaagaatataaaaactaacaaaagcaataataggatggattctatatacattgttaattattttgttttacattattgtaaataaaataaaattcttccgtctttataactttagagcaaagtctatcgataaattcaacgaattttaataacatctatattaaaaaaattataactttagagcaaagtctatcaataaattcaactaattttaataacatctatattaaaaatatgattaaatttttattatttttactatcataataatagcttgtgcaacgcatgagtcgccggctagcgtaattaatcatgcgccagtgatccattcgttttatgagccgtgaacagctccaccccaactgtgcacataaagagcctgtttgggggagcttaagattctgagaagtagctgctgagaagctaactggtgagaatctggagaatctgggaaacctagttctggcttccagttcattttccagattctatgactacagattctcagaatctgtgtaaaaagctagactgtttggggagcttctggcaattggagattctagaagaagctgcagctgctagaagctcctccaaacaaacgccaaccgcatagatatctgtgataatccaggatatgcccaatcactggttatcttgcggtcaatcttttggtggctagatgttcatgttcaaaagaagaggcatcttacatctagccaaattctaaatactctgcattagtgtgcagcacatgtggattcatttgcgcatcttattataccaattgggagagcagaggccctggtcctttgaaatgagtaattatgggccctgattggaattttaacttctaaaatcctaataatctattaacttattaaagaaatagaaaaagaagcatccatgttcgctctcatggcttaaaaattctcacattaatcggagaaaaagaaaaaaacagagtatatttaggaataaaatttaaaaatagctgaaattcggaattaaaaataaggaatatagaaagagaatactacagcccataccggtatacaatagaactaatggaaatttggaattaaaaaataagaaaaaaaataaaagtagaggttagagtccatatagaaatacaatttagaaataaaaaaatcgagatttaaaaagtaaagaatataggaagaagaatatagagtccatatagaaatacaatttaaaaataattaaaattcgaaattaaatatattgaaagataagtttggagtccatatagaaatataattttgaaataatataaattaggaattaaaataaggaatattggaagaagagtacagagtccatataggaatacaatttagaagtaactgaaattcgaattaaaaaaaatattgaaagatgagtttagagtccatatagaaatacagttagaaataataaaattcagaactaaaaaaataatcaatattagaagaagagttacatatagaaatataatttataaagaacggaactttgaaattgaaaaataagaaatactggagaggagtctagagttcatataggagtataatttagaaataactgaaattttgaatttaaaataagaaatataggaataaagtttataaataatataaatttataattataaaaataaagaatgttggaagagaagtctggagtccatataaaaatacaatttaaaaataattaataactatcacatatatacaatacattacgaatattacacattggttagtttgatcaagttagtacaaaatttaaaattatgttgccattttaatatattttaataataaaatgtgataatatatatgctactatatctctactattataaaaattgaagatgttcccgcggtccgttatccgtgtttgagtcggttataaaaattgaagatgtttccgcggttcgtcatccatgtttgagtcggttttaattttatgttttggttttaatctatatctcttctctatctctactattataaaaattgaagatgtttttgcggatattttgatacgccatccatgtaagagtcagtttttgagttcgtttgcttttagaaatacatatccgtatttgaattgatttttaatattattcacttttggtaatacaaaaggaatcatacaagaaactgttaaaaaaaccccgcatgactcctaactgcagctcatgattttctaaaaatatatatatccaactgaactcccacagtaaatttcatctaaaataaaccatataacaataataagattaaaataaactttatccgttgcaatgtaccagatattttatctagtgagagaaaaatataaagatgctagttgcgtaatttgcgcaggccaccataatgggacgctacatttaaccatggaacacagcctcctacctgaagttctgcccactatccacgccctcactcatcacagtgccacggggacccgccccaatccacctcgccgccggtgggtcccagggctccggtcactgctcccgccaacgacgaccttgttagccccctagcacaggtgactgttggctctagatccctctctctttctctctcccgttattcctttttattgggaatattggggtcgattctgtgcagctcatgttgttgctgtttgatttcctggggttctgggatggcagttggaggttgcgcggtaattggaaattttgtgcaacacttcttttaaatagggattggtggaaaatctagaaaacgatggcatgcattgcaaggtcgcaaggaggaacggatagggagaaaaaccctcttttttttttggaatacgcaaggagcgcatctttgtgaaacccctcttttcttgcgtcaaaaaaaaccccctcttttttatccccaagattcgtaatgtaggattgtagggagttgttaagattatgaatgcttaatttagatggtgtctgtgtgaaagtactagttttgttgtaagattacaacccacatgcatgtgacatttaaggcaattctccgaaatataaggtgaatgttttgcacaaactgagttcttctgtaagataattgtgcaggcaattcctgtatatctcgtattgctttgttttttacgattttgttggtcctgcattgcatagatgcctctgctggttaattgaattcattgaacttttcagtgagcgtgaatctgctagtgtgcattttcctttttcagcctgtcaattacttcacaagctttcaattgagaccactgccacatttataggtacgtgtcaactaaagctagctcaaaagacaacatgtacagatgaccatagtatataacatggaattcaatcttagattattttatcctctctactttttcttaacctgcacgctcatgttgttgttttgtgaagatgcaactctattttctctccattttctcccttccatgttagcaactacttcctccatttcacaatgtaagtcattctagcatttcccacattcatattgatgttaatgattctagacatatatatctatctagatttattaacatctagatttattaacatcaatatgaatatgggaaatgctagaatgacttacattgtgaaacggagggagtattgaacgaggcacttgctaagacagcacattgatgaccaccgtgcatgcccttatagtctcaatttacttatgatgtgctaatgcctaatggaatcatatttttattctgtctttgtatagtcaccttgtgaataccttctagccaggcttcagtgaatagtagctattaattcttctgttttaataaaatgaaaagaaatcttgtggtacacttctctgttttccatatattgtagaatattgatgagtaaccaatgcaataatggatagtgaaacacttgaccttgattttagccaatgcatgaaattggtatctaaatattgtttctcatacaggtttatactagtgaagttaatggatatacggaaggaagtgcagtgccctatatgcttaggtaggaatttgctttccctaacttgcttccagatgtagagataaaaaccctctttactttgcacaattccctctttacagttttacttcaaattgtctattgttctgtagatgtaagatttttttaatcaccattttctataaaaagtgaagcagcaaagttaatagtccacatatttctgttatccaagtatgtatatagttcgtataaaaaagatattgtgtataattgctgtccactgataaataacaagatgtctaagagaacatgcatgttttactttggaaaaaggtacatcactaagctcatgttctacatattttagagaagcacaactagacagagtttattacactaggttgagtaagcttctcatctgtggaattttaaatagcatctctgcacaaactgtgcatagctgatcatctgaatgccttatggccctattgcaggcattatccagaaggcaaggataattacggagtgtttgcaccggttctgtagggactgcatagaaaaatccatgtggcttgggtatggtccctaacattattcacctaaaattctgtcaatgccatttcgaaagaatggacctgactggggttttgaaatagaatgtggtacttactttttatgttaaactgagtgatacattgtttttatagaaatgatgaatgcccagcatgccgcacccttgcaagtagtcattcgttgaaggttgatcctaattttgacgctttaattttgacgttgtatccagatcttcacaaggacgaggaagaggtgatgcataagttttctggttgttgcacttagctatttcatttagtttcactacactttgcttgaccacacaggaacttgctttcactgaagagaaaacttgtcgcaaaaaggtgggtttatctgactgtgtcatagtatatttaatgtagggaaattattttccctgcccatttggaatttgtcttctgtttattgttactgaaattagcttttgtttatcaatggaagatccaagcatccaccgatgaggcacctcatagacgaaaagaagcacttgggaagaagcgctccgctgcaaaagcaataggttcttcaaggtctcaagggaatatgctggcaaggaagagaggacacattggttttcctgatattgtcccatctaaagttggtggtaaggatagggaagaaaatgacaacagtggctgcgatgagtggtctttatttgatgagtattcacaagatataaagaagaaaagagctcggaggtgtcttgtgccacgatcatcccctgctggacataaagtacccagcaaagtggaccaccatgaggaaggaaatgcaacacataaagcagaatcactctaagacacatatttgctgcccgctgtctacagaagatcagatggatctttcttctaaacaagacacattcacgacaaaaactgttataatgccaatggttttaacaatttctctgtgccaaggtattcctcctccagttattttgccattcctaattcagatttccacaactttgaagaaggacgctcatgcaagaagttttgagtgtggacaaatttgggctttat

SEQ ID NO: 75254 - DNA, 5499 bp, Oryza sativa
ttggagcccgtttggatctatatgacacccatgaaaagtttggggacccaaaaatgcattttgagagtttaaggacctagatgacacatctatacaagtttaaggaccggccgcacttcactcaggaacaaataaggaaaaaagacatgcgctagaagtaagcacattcttagataatttagcattcaataatatatcacaaatagcattaacaacatggctaaaacacataccagtagcacatagaagacagcctccaagggacatccaagcttgggttgggttcctttcaaaataatagtatatatacataggattaaatgcctgtaatacagctgaaccatatgtcttcatgttataaattcctattccagcaaggcagcaaaaccatatgaacaaggcaggtccaacagcaagcgccactttgcttgacccaaatcgttgtagagtgaacaggacaataagaactgccacagttatcatgacaacttcacctgccaaagtttcacattaatagtaagtatgatgtactcgtagacagtacagacttaattcttttcctgaatcaattagtgctatgtgtcaataaactgaaattctgaggtcaccttcattaacactagatattccaacctttaagccattgacagcagacatcactgcagatttttaccaatagaaagaactggaattagttctacaggaaagagaaaacctggtctagcacaatatcactcataaaagcatatataatgatcattaaacacggtgaagagaaattcaatgagcaacgcatcagaaatatgtgaacctgacattgctggtgtgacaacaccatccgctatcaccatagaagtaccaaaaagaacaagcatcaaaagcagcttctttagcatagatgaagtctcaagacgctccttgatcttcaaagacctctccagttctactgaaggcacctggagttggaagcttgatatacgagtatcagagcgtagttggttaggaagcagactaacccttgcattcctgcatattagcgagtataaagcaaatgtccctcctgccatagatacagaacacggtttcattaaataaaaagattaaccaaaagtgctgtgttttagtctactcgtagtgacctagtagtacataatgagatataccttctccatcatcgtttccccataaagcaatgagagtatacttcagcaatggtattagaatcagagtgtatattacaagtgagagtgccccaagtacatcctccttcgaagtaatagggtacttgttgaacattacatcgaaagcatacaatggactggtaccaacgtcaccgaagacgacacctagtgtctgaacagccagcacaatactcctgcctacggtaatttcctgaaagaaaatgcatgattgagaaatcagtagagttcagatactcatgcatttagaatgaggcttgcacctcatcgtccaagcatcatatgaagtgatgatgtttggatttggagtatcaatgtccaatgagaggtacttatcaaacaacttgcatgacaacatagaaaccaaaatactgccttcattcatttctagatgttgttttagaataagtgaacctcaaaatttaattcacaaactaatttgtatttaatatgtgaaaatagcattagtagatttcacatgaaaactactttcatttagttatttgttaatacatagtgatttttgtaaatataaaagcaaaaagggcaatgataaaacaagtgcattggagattgtgtcgatgccctaaatgacaagaaaaaaagaacagagggagcagtaatcaaaattgacaaagtctctaaaatactactttggcagataatttctagtgtgataaatttgaaaaatctatgaacactatcatataatgatagacagttttcagcataaatgtactggtaatacatgtggttaattcaatttgactacattaatggtgaagaaagaaagagaaataaaataactcgtctcgctcattcatcaccagtagtttcacttaggtgactcaatgcaccacatgctgttctttccacagcatttagtttcacagaacaatttaactctgaaaagccaaaccaggagatgaaacaaaacttttcatgtcacggctccttattcacatccctaaggttctaacttctgatctcgagtagaagacgaacaatgaattgcaatagaaatcatgctccggcacatggagaggtatgcgtccattcatggaaaaaggatcagaattttgtcacatcaattatgcatgttttcgtggtgttttttgcaatattgtagtatacattttgtgttgggttcacttagactgcagaaaatggctaaataaaagaatgtctgggacagaaatagaataacagtccatgtgatctgataagcattcacaataaactaaaagccatgactgaacaaatattatatcgctaggtcgcaatatcacatcaacacggccatcgtgatattcctgtggatattgtagcttataaacttctcacatcacaacaaagaataagacatagatatgctatgctgctacaagtatcaacaaaaaatggagactagggtagtaattacaattcttcaaactgtccacaatctgcatgtaacacttacatcctcagatgtgtcacctacaaacaacaagattacgccgcaaaccaagaatttcactcatcgatcaataacccaaccatcaagagcatgcgtgtagcttgtggaccgaattgcactggttcatcagaaaagcattgcaaacacgttgcatccatacacagatggatacaacctagaagaaccacggtacatgctataaactagtatgattttgctaattcactaaccagaccaaccgaatgaaattacgcagtccacaccacaagcatatagtgagctcagtatgatgttcttacagcccaaaacccaataataccttatcggctccaaggctgcaatctcaattgagcagcagcgcaaagccgcctaatctaacactatcactagagtactagaccacgattgataagtgtcaggaacacgcaggcaatacatcgaacagttggcgcgcacaaaagtagaggcagccaattttaagcaaggccccgtgtttcccgtgggggctcgggcgggtgcgcgcacctggtggcggttcatgcctgcgacgtcctgcgcctcgacgtccagcgagtcggcgcgcgggccggtgcgcacgagccgctggcggagcatctccgcctcctcgtagttgtcgtcggagtccgagcagccgccgcgggagcccgaggcggccgccggggtgccgcccccgccgtcggagctctcgatctcgtcctcctcgtaggcgccgccagacaccacccaccgcatctccgccgactccgtcttccgcagcctcatcctgccgccgccgccgccgccgctggcgctgccgctgccgccgcttcgggtctccatttgggtcggcgcgggaggcgccggtggccggcgcgtgggtgtggggcactggctccgtgaagcggaggagaacggcagaaggggaggatcggagcgggggagaagaagacgctggagagtgatgaaacggaaactgcagtagcaggagatagctgccgtcttcgtcttttcccctcctcatttttcacccctcatttcagtgcacttaatagtcggttaatttatgtttttattttctcccacttcttttgaaaaatactccctctgtattatcttttttgttctcaaattttttaagaaaatactgccttcgtattaaattttaatgtatgtcgtcgtttacttttttatccacgtttttaccattcgtcttatttaaaatatttatgtaattatgatttattttattgtgacttcatttatcattaaatgttctttaaacatcacatataaatactcttgtatttgcacaaaaaatttgaataagatgaatggtcaaacgttggtcaagaagttaacaacgtcatacattaaaaaatgaagggagtagtttctttataaaaatataccctacactggctccggtgaaacgaaggagaacgacagaacagagggtcggagcgggagagaagaagatttaagagacttggacacctgagtgatgaaatggaaactgcagtggtaggagacagctgtcgtcttcgtcttttccccctctttctctctctatttttcacccttctttaacttttctttaacacaacagtcggttaactttctttttttcctacattttttttaaaaaaaatactccctccatattaaatttaaatgtatgtcgtcgtttactttttatcaacgtttgaccattcatcttatttaaaatatttatgtaactatcatttattttattgtgacttgatttatcatcaaatgttctttaagcatgacataaattattttgtacttgcgcaagaattttgaataagacgaacggttaaacgttggtgaaaaagtcaataacgtcatacattaaaacgtggagggagtagtttctttataaaatgtaaacaatcggttagcttataatagttggttaacatagagtttatagtacgtgcagcaacacctttataaaacataattaattcatattaagaccggcaacaaggtttttatatgttggataggaatctaggcacacatagtcaaacctaaaagagttgttaaactgcagatctcaaagttaaggatcataaaaaggttaggaaaaataagaaagcggtggccgctagtgctaccgtggtggccggttagggcaagaaattgggggaagaaggaagataggcatggacgctagtgctaccgttaacggtggccggtgaccagcgttaactagttcttggagaggatgtaaagggtgaactgaaggtttgaaagaatcgcctcccgggccacccaatggagcgacacaggagtccaagcaactagtttttgttgtaccgacatgcactaaatttatctattgtatatgttattttgctataaaatattgtgtgaagatgacaataatacaaaactctcggttctatatacccatccaagaagatactatagaacttttgattttgatttatagtgcagccatgacctgccgaaaatatgattgtatgttcaatgaaagccacgtaaccaggtgataacaatccggcccaggtggggttggccgagacccaataacttaaggttgctcggaccccaacagttcataggcacacctactcaggaaaatgcccaatctccctaaaagactagtccaataggggaagggtggctctcccttttaaggtggcttcctcctcccaaggtaagaaggtgggattattcaaaggctcacacggtcgccgcccgactttagcgtctttgccagtgggtaatagtggaggatgtcctcatcaacagggaatttcgacgttgtatatacgattgtaaagccaaaga

SEQ ID NO: 75255 - DNA, 21360 bp, Oryza sativa
ctgcagcccagcttgctaaggcattcacagtgcgtcatccctattcgaaaaaccttagagtgccacgtagacttggctacaagttcaaaatttagatttctcatggtgcaagtggctctaagggtggctttgattttatatttcaacccctacaactctttgttttggtcctcatgtttttaaaatttatgtggaggtccaaaatttacaacaaacaccctagaacagattatcaaatcccatccctccccttccccaccccttctctctcccttatcccctccctcgcgttctctgttgccagcccgatccactcatcgcctggtgcacacccctcttggcctcctctccttctcccctgaccagcagccctccttccttggcagcctccgcgtgcaccacccctcagtggtgggagactccaagcgggagatggtgaggtcggcggcgcaaagtgtgggggatggcaggggctcggcagcaacgttggggatggtaggagcttggcagcgcaggagcgtcggctcccccctctgcttccacagctggcgttcctcctatgtcatgacttcctctctcctctcctttcttcacgtcacggcggcagtcaagaggccgggaccgtggcagcgaaggaggccaagtcagggtggagccactgagctctccggcatcttcctcgcgccctggctagcttggtcacctcagcgcgaagtggacgacgggacgacgactttgccgagtcggggatgacgacgagctcgatggcgcatgacggggatgacgccggattgagcttctcttccctccccttcatggtgaatcaagcttctcttatcttccctccccgacgaagagcttatccacttctccattctgcaggggtcgcaggggcggtgagggcatctccttccttctccactttttgccttttaggtttcagcgccaagctctgacctccacagtgcggtttcgtgcctctccccatgcgcccgcacgccatcaatcaactcggagaacgagtgatcaatttgggctctgcattgttcactagggggcacgcgaggcggacgtggcaacgaatattcgtagtggatggctcaggcccaacgacacgtgtgtattgtgaatggccttaagctatgtttttaagtccattttcctaactttacccctcgtttttcgcgcgcacgcttcccaaactactaaacaactagttaggtgcccatgcgttgcaacgggaaaaaaaatactgtgatagctaacctaataaggacaacaaatgagaggctcacttcaatttcttgagtgttaataacaacaaaatacagtgaaggcagagaccagtacacatagttcaatttatctttgcttcctattcttattactgtaaaaaatttaccgtcagtaacatgaaaaaacagtagctatatgtggtgcagggcaattacaccgtgtgcaccaaactatcaagacaaagatatatatagcttgatgtactggttctgaagttcttaaatctccacaattgtggttccattgtccatgtaaatatcattaaataaaaatggactaatatacaaatttcagaagattgataaatcatctaaacatttgttccctacaaaagtgcttttcatcatcatattcatatggtacttgactatatgttgaaagacatccacatttagaagtgctctttaccacagttttgaggtcttctcttccctaatctataaaattacaaaaacgtctggcatcatctatcctcttgtctcttcaaaattgatcggattagtggcctcttaacacaaccatagctacaccgccgacatgaacaataatacatatatttatctaaaattgatcccagaagtaaactgcaataattttagtagagctcagtttacaaaacaaacaccgatgatatagccaagagtcaggagaagaacatatatcatttaggtgagataagaatgacaaaactgcgtattactctgtacaagtagagattgtattctctgcaaccttttcccttcacccaactcaggaaaaatttgtaaattgtcaaattttgctgaaagttttttctggtttgaagaaagaagaaaaaagagcatgaatgtctgatatacctgctgagttactgcagttcttctactgacagaactttgtcaaacaagaaaaaagatctccttccaacgcctcctcaaaattaaaagggactttctagtggccagttgatgattccctgaccatagtcacttgaatgatagcaaatgtgaaaaataaaaggatcaggttgaaacccctctacaaaattacgagagtgagcatctatgtagcatgaaaatagatgcagataaatcaagaagtacaaacctcattatttccaattccttgcgagcattaggaaatatgagcaaaccaatcgatatgttgcacatccccaccattaatgaaacacaatgctgaaaaaaattgcatttagaaacaataaagataaatatgcactgcacatttccaggtcattgtggagcagaaacaaatccataacaaatcagcaagaggaacataccagcatccagcaacaacaaaaacaagagccagggaggacgttgacaccaggctcttctttctgccggtgacgaccgcagcgatgggggtggaggcatcgtgagggacaggtggtcctggcgacccgcggcagccagcagcggagggcgaggaatttattttattcacttacatctaatccacgatacaattttccttttctcttacattataactttgtgtgtaagcttgttgatgtataaactttatgcacatggactttttaccgtagaaactttgtgcacaataactttatagctatgcacatgaagtcttcatgtccccatcccgtcataacaaaacaaatgaattctaaaataaagaaaagcttaaatatgttttagttgaagctcgaacaagaaacaaaacaacgttcttctggccaacgaagttgcctccattgaagagacgatttaaaagtaccaataaggaaaacagaacaaagcattttaacctgagcggtcgttaagccaaatctcatgtctaagtaaagaacaagagcaaatggcaaatccaccaagagaaaacttaaaaaacttgcaatttgaaaacttaatatttgaatacctgagtcatgtattgttaacagatttgaaaacctgagattttcaatcaagcaaatgtctttaattatctaaaactggatatttaaatatctttagccaattctcaatgagcactattgaccatatcacagaaactgaaccggacagcagaagtggatataccacttcagcatacatggcctaaacagactatgttttctaatttttcatctcagataattaatgattattgctcagaaataaaaataatttccactgtatataccacgaaatggacctgaatagctagtaggatataaaatgtcaagctcaaatttataattgaaatttgttgccgttgttgtggttgtggtggtgctaaagaagtcagtacaacctcaactcaacagagcctagtagctgaggtttcctttcaatatggataaaaggaatatgcaaaagatattattttgaagaatatgcacaaataaggttttgaaggaaaggtagtaagttctgcatctcaaggctaacgtagaaatgaagcacatcaatagaactgattcagtattagaggaaaaggatcatatttaatcatctcgtgacaggagttcattttgttagcaaacctctgcatctcaggctaaaaaggaaatgaagcacatgaattgaacttcagattcaggaaagggaatttagccatcttatgacaagagtttatttacttcaacggtatggaatattcaaaattttatcgttctaacaattaaacatataatgagatttatatatggttcacacaaaaacgatgaactaatgtacgctagcacaacagggaacgggaaaaatgcacaaacatggtactgcactaataatcttacctgttcctccgtcgccgctgtccaggcagcgagggaagcgtcgaggatgtagggaggtggcagggcggcgtcagaggtcgaagggcagggtggcagcatcgacggggctggggcagtttgtttcggggataagacagacttcacgactccggcgagataacgcccttaatgaggaatgatcgatggccgcagattaggaacggattccagggcaagcaataacagaggatcgatggcggcgtcggtggcacttgcggtgggcggggcacgggccggagggaagggaggaagctcatggtggaggacagcaagggcggcggcaaggacgccctttcttgcggcggcgcaagtgatttggaaggggagggggcagtgaggggaatcgacggtggctcggcatcaaagggggaggagcggttactttgtgcaagcgtggatggaggcgcggggcttaggaaagttgctttaaaattaatattaatctatttttaagttttttaagctaatacttaattaatcaagcgataataggtcgctccattttgtgttcccagataaaaagaagtttccaaccataacaatatgtgccatttcagtagccaaaccaataacaatcaagaagcgtgttgttttagccaaatatcgatcaatgtttgcctgtactgcccattgtgtccctagtaacgtcagtctaaaattaagtgcccacttgtctgaattgggattaaataccaagctcgacgaccatatcatgtttttagtcctaagagaaatacatacgtttaatcttaaatatatcttagtatttgtctatataattacacatatacatatatagacaaacttatattattttactaaatgatgcatcaatattgacatgtaccataatatactccattaacataagcttggatctccccgacacccccccccaacggccatttggcacgttgtcatgaaacattacaattggtggtgtttgaatctcccgaagatgaagataaagattaagtgttttacgcaaaactatgtggtaataacgtgtgattaattgagttttaattattacgaacttgaaaatggattaatctggtattttagtacaactttcatataaaaagttttcgcacgaaacataccgtttagcagtttgaaaaacgtgccataaaaatcttcatcttcatccaactattgttggagaaacgaacaggaccaatgagtaagctcaagattagatgtggactcttgaagcaacttcacagtacattcattgtggtcacatgtgaaaaacatctttggtgtgtaaaaacaaccacgctgatcgatatcatcctgagttaagagatatgcaaggataggaaggaaataattgttcaacaaagggcacaagttcttttagcctattggcaaaaacgaagaagccatggtaaagacaattgctaaggctaacctaatatttaccttttggagaatagccttttaatcctactttcagaggttagttagccctagtttatacataagcctaattttctccctactttatataaggcaatttattttgttggtctattgttgtataatactgtattttttaagagtcataaatttttgtaactatatgcatgtgcaaaaataagtaacttggaaatcacctttacaaaacaaacatgcaagcctactttcgctatgaaatatttataatttaattggatatgagtttaaaagggcacactactaatcatcatcgtggtgttctgaaaattagtaagtactcgacaaattattaaaagaacccattctacctgcaaattttcttcagttcctagtaaagtttatttagtattgacaatatatatatataaagaaaaaccaacatgcaaaaaaggggcgtataaaacatattttcagccaattaaatattatgctagagtggatcaaatttatgaagtgtttttttttcattgtggccaaaagaaaccaactccaagtaatatttgttaatgcaatcatgcttgaaagttgaaactaactctaaaaatatgattagaacttgcgttaattgtaaaacagtcttaatctctcgacgagtttaacgtaaacgaggattaattcatagtcaaagattacatcaccaatttagacatatctaatcatgtatgttttttattcacaatttcttgacattgtatttagttttacaaccttttgctcccttaaaacttgacatgtatggtaaataaaaaaacatcaatgtgtgaaaattcaagtgccatcgatgagctttaacggaggaagccaaactctattgacaatattttagaacaaagagagtagaaattaacatctgaaaaatgctattggtaaatttctcataaaaaaccaacgatacttacaaatatatatagtttggaatagtaataataagatattttgccactttcctgaatctcgttgtgtcaaccttgctgtaccgtcgacgtctaaaacagaaaacgtaaattgagaggggtggaggtagcacaacatttggaccgaacccgacccaccggtgcgaacccgtcccggtcgtagtcgctaggctcgcgcacctcttgcttcagcttcactctggttcacacggggaatattccgctccccccacaaaccacgcgccccctcctcctcgcgccgcctccgcgccccgaatcaaagcacgcgaacgctagggtttgctcttccgctctctcgccgccgccgccgatggcccagcgctggcgctcgagggcgcggcgcgacccggacgtggacgacgaggaaggctcgcccccggagcggcggcgcaggggggctcgaagcggcagcgacgacgaggaggcgggcaacgaggacctcagcctcgagatcgtcgcgcgggcggcgcggcggcggcggcggcgcgaggccagcgccgggttcgcggccgacgccttctcgtccggggacgagatcgacgaggatgccgtggtggagctcggcgaggcggatcccagcagcaggaagcggcgcaaggagaagaagaagcggcgcaaggagaagaggaagcagcggaagggggcgccgcccgagggctcgccctcgaccgccgccgccgacaaggaggttcacgtgggcctttctttcccctgatattgcttgtgctctatctctgcatttagttcaccatcccatgccagaattgagttggattctttttattttgagactagaattgagttggattgtgagctgtacgtggactgattaactaactattctgttggatcttggagttcatatctaccgcctctctgcgaatgcagccgtagtgattgttagtaagcattcgatatattacgcccaaggggagcaaacacgtatactgattgatatcggtttatgtaaaatgtttaaaactttaaaaggcaatataaatttttttgttgaaagggtctttcgattctgtagacttcaagtgaaaataatgttttatgttgctgcttcttagaaagtatacgcgtattgaactatttgtgaatttattaatggtatggaaaccttacaaatagataactgattttatgtttgtgagtgagcattggtattcgatgtttctttgttgggaatggattactaacgctaatatgtttcggagttactaatgcgcggatttgttctttcagtctcaagttgctgggacccaggaggggcaaactggcacagcacaatcagtgctcactgaagatgggcctgatgtccctttatctgacaatattgttttacggaagcttcttgtaagtaccaagtgaatttccttgcatatgcacatgtggcacaagataataatactcatgttgcttttcctcatgatccagcgcataccaagatactttgatcctggtgaaactttattggaaacatgctttaattgtggtgaggagggtcatgtagctgtgaactgtccaatggaaaagcggaagaggccttgttttgtttgtgggttgtttggacacaattcaaagcagtgcacgcaggttggtctccctagctccaaggcattattgcttggtgacttgggtatgtatgctcatgcccttgacaagatcatcttatttagttttccattaattacatgatgttgctgcatttgttatttcaactcataagttaacatgcttgccttgtttagataggttccagacttccagttcattaatcacacatatttacttgcccctgccaatgcttcttgcctgtgtggcatggcctgccaatttcaggaatcaaacatttgttaatcatttttgtagggtcaagactgtttcatctgcaaaaaaggaggtcatattgcgaaagactgccctgaaaagcacaataggaatactcaacagtctactttttgtttacgatgtggagaatcaggtcatgatatgtttggatgtgccaatgattatccacgcgatgatgttaaggtcagtattgttttctcatggagggatacttgcctaaggaaaaaaaaatctaactcaacatatctttaaagccacctctcacttttaatatgctgtggctacaatctaaatcctactgttaatgcaaactgtgctgcttcagaatatacctatgaatgaattgtggttttgtcatttacgttgatccagctttatgtgctattcacaagcttggttaggttttgtgagccagcttaattttacattaagccccttccttatccttctgtgttagttgaatacctgaatccacatgttttgtccacttaattaacatgcaatataatgcaagtcattctcttatgtagcacaaaagtcctgtagcagcgagtttgcattaattgaagtcatagtattatccaaacttattttccccctccatctactttgttggtctgtgcaggaaataaaatgctatgtgtgtaatcagaaaggtcatctatgttgcgccgacttctctgatatttgtccaaaagaagttagttgttataattgtgcccaacctggtcatactggtttggtaagtttagtggttattatggcttcctttgtttctatatgttacgtctcacaacagctgatcatggttatggcttcctttgtttctatgtgttacttctcacagcagctgatcaatgtcttctgaaacagggatgtgccaagcaacgtagggaagctagtaccgcggcaactccaactttgtgttacaaatgtggcgaggaaggccacttcgcacgtgggtgcacaaagaacaccaaggttgttagaagcatcttattaattgtctactgataagagttgcttggggtatttatcctgtgtacatcctgtttccctttctgcagtctgatcgtatgaacggtgaatcatctgcatatagtcggaaaaaaggcaaaggcaagaaagattttggcactagatcagctcctcatgatgctcgcaagacaagtaaaaggaaaagccccttatttgaggaaagaaggaactcatctcattttaagtccaaagctaggggtggttggattgcagacgatgcggatgaccagccatacaagaagtgcaaacccaatgtgtgggcttctccatctacccctaagaagcaatacaataaccatcagttctcttctggtggtgactactcaactcctcagtcttcaagatggcagaaacacggtttcgcatcgccgagcgcaacttactcaccaaacacaaggaagcatagcttttcatcgtcgagattcgccagcaacactcatgtccggtttggaagaagctagctggaagctagtttttgacatttttttgccgttctgtttacaaacacaattgatcatcacttgtgcctgcaagggctgtttctgtatcttaaattacacatgtggtgctgtcgtgctgctgctgctcagttccagcttccttgcttcccccttccagctccgagcacgctttccttgtgaaatctcgcggctgtggcgagcagatttattaccagacacttgcatgcgcgcctggtcttttgttatcgttgtgtgcagcctacatgggcaacctactctggagctctttgctgcatcgaatcttacctctcccaacgatggctcgcagtgtaggtatgcatccacaaggcttctcaaaactagcccagtcatcctaccaagtgcactcagtttgggttaaaaaaaatcactgcttccagaactgttaacagtgtgtttactgaaagttctctgcatgttttccatgtttagtaaattaattaattgtgcgctatcaatttttctcgtttctagtgctctggaaatcttgtcgaaatatactccccttcccataaaaaataaatctagtacaggatgtgctacatactagtactgtgaatctgatggccccattatttcgcttatccgtggaataagccaaatgacatatttacaaatgaaaagctacagcctcgtcgagcttgctctatgcagcctcatcgcgtcggagaccgaggagatgtgtgttagtggctgcatcattgagcttgagctctacggcctcctcgcgttggaggccgaggagagacacgccagcggtcatcgaggttggagaggctgggaggagccatgcgcaatgaccgtctacttgaactcgagctctgcagcatcctcgcgtcatccacgaggcgtgcacactactaggaaaacgttttttccgtgctgttgactctgattttcgcgtgcgggtgcatatgtcgcccgcacggaaaaatccggaaattttttttcaaaaatccggtggcggtgccgctcccggccgccgcctcctcgtcgtcgtcgtggtggtggtcggccgaggatgccgctcccgcactcgtcatcgtcggcggcggcctccgcgccgccggcctgagggaaggaagaggaggggaggggagctggatcctgcggggggaaggtggccggccgctggatctgtgctcccgctggcctccgggctcccttccggccgcaccgccgccaatgcccctcccctccgctggatttggggagggaaggaaggggaggggcggggaggggagcaggatctcgcaggtgagagggtggccggccgccggatcggtgcggggacggccgccactgctggatccgtgcgggggttggccgccacccgccggatcccgctcgccatcgttgcgctgccactgccgacgagttccgtcgcggccgccgcgcgtcgtcgttgccgccgccgtcatcgcgcgccgtcgggactcggggaggagaggacaggagatgacgaggaaaatgaggagaggagaaaaagaggagatgagggaagaaaaagagatagagaggagagatgagaggagagagaagggaaattttaaagtggataggacggaaagggagggtgggtatttttgcgtgcggctctcttaatagatccgtacgtgaaaatatgcccatttttgcgtgcggtccatttaagaggaccgcacgaaaaaaccaattttttggtgcgatcctcttaaatggaccgcacgcgaaaatgagccctattttctcagacgcgaccagttatgtatggcctatttgcaattacaatgagtcactgtccaggaaaatcttttgtgtagtagtggcatagaggaaggggaggatgtcacctaaaggttctcaagatgacggcgtgaattctcacttcttgtggtaatgaaaagtgaaggtggaggttggctactatctctagtcctagaccatccaattctttgctgtggtgttgcgtcccttcgtgggtgatctagttgagtccatgctgcttgatttttggcgtgtccaccgttgtcacctcgggaccttcgccgttcttagagataggcggcgagagggtgagggaggaaggagggacaaggcggagaagatggtgtagatgtgttgatctggtagcaaattggtagcaaagtacgaagggtggtgtcgagctgacagctgcatcgacggcatcgagctggggctagaggcagattgctcttgtcctccatcttgccattatctcgaatgagggtaggtcagagactcagaggcgaagctcatcgtacttagtggagatgcgctcaatgagggcccgactcttgtcatatctgaaggagtctgaggcatcttcgatggcccctctcattgttggcgggtagaagccttaagcctatagtcacctggtcgcgccacttctaaccttgcctatcctagttgtaaggctcctggacgacgataagttgatgagcgagcatcccactctctcaggaggtagggaggtgcagataacactaatacgtggaacctattattactttaatcatgtaggacgagtaccgccttgaattttgttaggagggtaatttgtctgatttgaaaagtttaggcgtacaaaatgtatgaaagtttatggggcgatttagaccttttctatattcttctatacacacataaatgtgtgaattatgtattttgtaggtgatagctacaccgagttagcgtattaatattaaaattttcaatctctactagctagtggagtcgagcattcacgcaaccatgacctgtatggtatatgagcccatttacattatacactaatcgtacaactaaaataaatttatatcaagttttagctggtccatatgcaacaaagaacacattctgaatgagagtcctgaatagaactgtagcctaaacaatagaggttcatttatgcgtgaaattaaattccagtccaaactataatgttggtatggggtagcctaaacaataaatgttcatttgtgcacgaaattaaattccagtccaaacgataaaaaaaaaaattttcaataaagtcaaaggataacaagttcaatcgggcctaggatatatgcgaaagaaccagctgtcgctcaaaatacacatacagaatctcaagtgctcgctcggctcaggagagggtgtttcactcattggcgttcccggcctcaatatataagatggtgcaatgtttgttcagtaggcgaggtgggactaaaaggagagcttactagctcagtggcttcatcgtatgggcctcgaaactcggcaagcgaaagggccgcagcccatacgtgtggtcttcggctcttcgctgctgcagacgattttgaaattgattggttgtttgaatcttctaatcgcttacgatttgtctcatcgctacgatacgatgccccgccgccgcgaaccctccgcctccgcagccacacgaccgcagcgacggtggcgcaggggctctcccgccgcgccgtgcaacctgccgacggcgtgttccgggaggaggctgccggtgatcgtgccgttccacgggggcgcgttcgcgaggggcgcggccgacagcgacgccatcgtggtttcatcgcgctctgggcatccacggccgcgccgtccccggcgccatcggctgttggccccaccccggctgctgcggcggcggagctcctccgccgggtcgcggcgcccggggtcgacccgtgcccggcgctgcgtaagctcgcggcgttcctgtctgacgacgacgtcgacgaattcgacaagaacgcgctcgcgagggccggtgggcggtggcgcggcggagaccgtggcgtcggtgctccggaggagggggaagggcgatgatgatgatggcggcgtggaggccgtcgaggcggccgtccgggtgctcgcggtgctcgccacgtcggactgcatcgaggaggagaacaggaggcgcgtcgtcgccgcgctcgccgcggggggcgccgccccgtcggtggcggcgtcgctggcgcgcgtgatgcggagcgggagcgggctcgaggcccgcgtcgacgcggcgaggctggtggagtcgctgctccgggacggcggcgaggatgatgaagtgcggcgggatgggcggcgcggaggcggcggtgtccgtgctgtgggcggtgtgccaccggtacagggaccggcgcgcggcggaggcggcggcggcgtccaagggcgggctgacgaagctgctcctgccgatgcagagcgggtgctcgccggcggcgaggcagatggcctcggagttccttaagatgttcaaggtgaacgccaagagctgcctcgccggccatcctgcaccgagacctcttcaacggcggtggcggcggcggaacgcgtgtgcgggcatggagcacgcgcacggcgaggacacccgagcgccacgccacgccgtgtcgtctcgtctgagcttgctgctgccgtcgccggtctggatgaggcggcggaggcggagacgtgcaccacaagacaagactgggcccccacattactggtgggccctgaccggacaaccagaccaaattccgccacctccgcttccgtcgcttctagaagccgacggttatttatacccccggctctttcttcattcctcgcctcgcctcgcctcgcctcgcctgagccccaagcccccaacctcaatcgcaccggcgaccggagctcgctccacccccaccccgctgccgccggcaagagggtggcgctctgctgcgacgtgcagagtccagctgccgacaacacggccgcgcgctcgctccgggagggcagggaggccaggcaaagaggccaagaacacgctcaaaaatcaagaacgcgtgacatcgatctgcgcatggcgacgccaccgccaccagctgttcaaaagatcaaggtagactaggtgtccataaccttgatataaaaaatagctgcttattaagcaaatgacttttccagttgtttaatggtgaaggcctatggcaagaccttttgcgaaataaatacttaaagggtaaacctctctctggtatgtccagtaagataggtatttctcagttctgggccggtttaatgaaagtcaaagaccaatttcttagatttggttcttttagatgtggcaatgggacaaacataagattttggaaagacacgtggttgggatcgcgtgctttcaaagatcaataccctacattatataatgtggctcgaaaaaagcagtatacagtggcagaggtcatgagcacaacgccgctaaatatctcttttagaagagctattgttggccaaaagctaatcgagtggaacgatttgatcctcaagctagctaatataactctgtcaaatgaaaaggactgctttgtatggtcgctccataagaatggtcaatttttcgtcaaatctatgtatgccgcgatcatgaactgtaatgttcggataaaaagagaattatgtgggacttgaaaattccactaaagatcaaggtctttatgtggtttcttcgtaagaaagtaattctaacaaaagataacctggctaaaaaaaaattgggggggggggagacaaacattgttctttctgctatgcacaagagacaatccatcatcttttctttgagtgtcatgtcgctcagtttgtttggagatgtgttttttttttgcttttaatatctccccaccccgtaacgccaaaaacattttcggtaattggcttagaggggtatctaggtccattaagaagatgattctaattggagctagcgctgtatgttggttaatttggcgttgtcgcaatgataaagtttttaatggtaaacaattatccaaccctatgtatgttatcttcatgtcttcctactggctccacttctggtctacaatgctaccacaggaggagcaggatactatgcacaatggtgttacactcttggaattggtagccaatggtctcttattccactatgggtggcgtagttctataagaattgctagctaaaatattttatgtgtttaacgctagtcaataatcaaggggagttggagatttgtcccatcaccttatttctcattttgatttacttttatcttacctttttattactattaaacttatggctgtgtgtcttatgacagaagccggagatgtaatccatttccattatctcaaaaagttggtagcttgaccaagattcactaattattctcagaaacgacatatcaagattcaaattcagattcaacctcagggctcagggtatagaagaagagagcgaagctatgccatgtcctcgctgatgtggcgtagaagctgtcctcgatggtcaattcacaggttccttaaatttgtcgaagctgtccgaaacgtcaaacagaacagaacggatgtaatataacatatacagtatgtggttgaaggggaagatgacaaaaaggaaaatggcgaggagattttgatcaagcactgtgaagttgttgtgttctctttttgacaggaaggggcttgctgttgctgacatgcgtctcctgggttgccagacaaggaataattcatcgtagtctgctagcttcagtaggatttagcttcaatagttcatccctccatttttgcagaatctgtcaatgtatttcagaacgcgaccacgcttccgtcttctgtcttcacgagatggaatcgtattccgtttgattcagagtcctattccgatccagagtttagatggaattctgttctgacgcaagcactgatgtttggtcggattccctcctgctcggattggggagctataaatatagggggatcaggtcacgttggttccaagattgcgagtttctcttcagaaatcacaacagaactagttcttccaggattgcaagagccaagagccagggttttactgtacaaactctgaactctgaagatttgccaacttttgcaaatccaattctgatccagagtttagacggaaatctgcccatgttctcatttaaccactgaagttggtgagatttcctcgtcctgctcgggttggggagctataaattcagagcgatcaggtcacattgcatcaaacattggagtcttttcttcagaaatcattccagtatagcaagacatccaccaagagccaggctctttttaacaggcaatatgggctgtacaatctccaaagttttcccaagttttgcagagaatttcttgaaaggggccaaggcaggaaattcactggagctgccgcaggatgtgctgatggagatctcggataaaattttttttaaatttttcaaaagtgtccgaggacaaaccaattcaatcgggccaagatgaatcaaggatgcacaataaagaaacccacgtgttcgacgtgctaggctcggctcaggggagggggtttcacgccgtggcaatccctgcctcagtatataagatggtgcaatgtgtgttcagtaagagaggtgggactaaaaggagagcttactagctcagtgactgcctcgtatgggcctcgaaacttggcaagcgaaagggagcccatacgccaccgtggtggccgtcgggtacctgctcaccccggcgctgaggtgcaacgcatgtaaaataataggaaaaagtacaccgaaggtccctcaacttgacatcaagttacaaaaacgtcctcaaaccgcaaaaccagatatccggtgccccttaactaatcaaaaccggtcactttaggtcctccggtggttttgactccggttttatcctacgtggcagctgagtcagcgtaggacccacgcagaccccacacgtcaggtgtccacgtcagcacctctctctttccctcttctctttctttgtttctcctctcgtgccagatctcaccgagaacgtggtcggcaccctgggtgcggcgcgttctcgctgccggtgagggcactggtgccgctgctctacacggtgcgccgcgtgttcgtcgtcgtggactgggtgtacatttgatggcacgaacatcactgggaggatcatgaacatcaccaaggaaatccacccgccatgacgcacctgcgtgaggacggcggcaaaggacatcccgagaggaagcgcgagatcacccggcagctggcgctagcggagcgggaggcgacacccaaccacacgctacggcgggtcatccaggcagggtgcgccacgcacgccttcgagcggttccccaccccgtgtgcgcccgttgactcctgccgcgtcgccgcgctcattgatgaggggacaacgatgctcggcggcggtggcaggcagcggcagctcaccgcgctccgggagatcaaggccatcaccaccgagagcgaccgcaacaagcgctgcgtcgaggccactcctggtgccgtcgagttcctcgtctccgtcgtcgtccagagccacgccgccgcctccacctacatgtcggccaagtcggacgatgacctgctcgactcggtgatcgattcccccatctcgacgagctcgccggaggaggaggccctgggcgtgctctactccctcaagccgttcgagcccaccctgcgccgtatcctcggcaaggacaatggcggcttcctcgacaccctcgcctccttcctcctactgaaggcgatgatgtcagcgatgccgccggagcggctaggctgtcgccccatccgtcgcagcatccggagccggacccccttacgctgccgatggcgagcgttcctcgaagaagcaggtgagccggacgacaaggcatccgcggccgtagccgccgctggcgaggagtaggaggatgacgctgctgtgtccatctcgcggcagcgactgacacgtgagatttgggggagaagaccccgtgatctggcatgctagctgcggccacgccgttcgggcggtccggcgtcctgccgccgcaggcgctcggccaccggcacgccgtcctccatcgtcatcgtcgccgccgaacccgcggacgctccgggaagccagctacttcttgggctccgtctcggcggctcgccgagacagctcgtctcgtcccttgagcgaaccggcagtagtagcagcaacatagccacgacgccaagaaccaccaaatcccccaccgctacgacggagacgaccaccacgacgccgtgtccagcgtcttctccgtggacgctggctcatggccgccgcctcctcgtccaactctttatgctcgaggcggcgcgagctcaagacgtgggtctccgaccgcctcgcagccaatgacgcggtcgagctcgtcggccgcctaggggaagctcgcgagaacgaggaaggaaggagagaaatagagaaagagaaagagaaggggggaagacaggaagagagaggtgctgacgtgggcacctgacatgtggggcccttgtggggctcatgctgactcagctgccatgtaggataaaaccggggtcaaaaccaccggaggacctaaagtgaccggttttgattagttaagggatgctggatatctggttttgcggtttgaggacgtttctgtaactcggtgtcaagttgagggaccttcggcgtactttttccaaaataatatgcatgacgctacttcaacatgcgttctgccagtggagtggttagttacttttgtttgttgtcctcggcccacggttcgagtctcggttgtaccctctttttacagctccttatatcaatgggttaattggatccatgccattataaatatcagggttttgaaatatgctattaatattacctatttggattcatgccattataatttcacaccttttttagataatggaataaatatcccggcctttgctcattagagctatagccaattattacaaggaatcacacaaacaacgagtgaagttcaaataaaattaaacacacccaaagataaaaaaaccaaaccaagaaaaggagcacacatttattcaaatctatttgtgaatctccatccatggttcgcaaatatttgcataaccgtcgtctccagtttatggcatgcaaccttcataaactctccatcatcttcacacttttgcagctttgcccaaaaccggagccaatatgttgccttgaatattacctgcatatatgagatagatggtgatttgtcaaaaactatatcattcctactcaaccacagagcccaacaaatgacagatgctttaacaagtatgagtttactcatcttcttgtcaatccctaaaagccaacaatcaaacatattagatatggtactagggaggtttaaaccaaaagaaaactgtactactctccaaacaaattttgcaaaatgacagtcaagaaaaagatattgaatggtctcattttccatacagaaacaacatcttaacctgccattccaattccgtcttgccaaattgtccttagttagcaccagccctttaagcaagtaccacataaagatcttaatattaagtggcatcttaagcttccaaacaatcttatttctctcaatataaccattattaattagagcaagatacattgacataacagaaaatctaccattccgatgataattccatctaaaacaatcagaggattggttcaactgaatatgtataatggaagcacacaaatcatgccaatatataagattctgaccaactaaggatctcctgaaggaaacattaagtggaacagaactcataacattagcaatagtagaacttttccttcggacaatagagtataaagatggatatttatctttaaacgccaagtttcctagccatttatcttcccaaaaccttgtttgattcccatcattcacaatccaagaacccatatgtaagacagtatctttgaccttcattagacctgaccaaaaatgagaatcaccatgtttcctactttctctttaataaagtctgccaaacaccttcctcattaattaatttaaacaaccacttacttaagagacacttgttttgtatttccaaattgtggacccctaaaccaccctgatccttgggttgacaaactatatcccatctagtaagtctatactttttttttgtggtcatccctttgcccagaaaaaacgtgatctataataatcaattttttgaagaacccctttcggtatctcaaaaaatgaaatcataaacataactaaacttgaaagaacagagttaatcaaaaccagtctacccccaactgacaaatgttttcctttccaactacagagtttttcctcaattctttgctcaattacttcccaatctttattattcagcttcctataatgcatcgggataccaacatatttaacaggaaacgagccaagcttacaaccaaagatgttagaatactgatcataaaactcctttgcgtgaccaaaacaaaataattcactcttgtgaaaatttatcttcaaaccagacaacttttcaaacacagataaaatcaatttcagattcttttcttgttgtaaatcatgctctaaaaaaataatggtatcatctgcatattgcaa

SEQ ID NO: 75256 - DNA, 1569 bp, Oryza sativa
aatcatttactttcatgttaaatactcgcacaattacatcagctctatctgatggttgttggccaggttcaaatcgaatagtttctgcaatttcttgccacttaaagttacaagtgaatgtgacaaataaatcaggcgagccatacacacgacagattgccatcgcatcctgataattcatcaccatatatcttctaccgccggtaaagctagcaggaagtatctgacgtttgccaacagaatctccattagtaacacctctatcaatcgcatctacgattccttctacagtttcagcacgcaaatcagcttgatgatctattatgtattgtatcctattagcctcgatagtagaaaagatatcaacaacactttggtcactcagtcagccataacatgtgaaaggattaggctcatttagtctataatggataaggtatctgtagacctcaagcattgtagcatattttctaccagttccatcataatttctatatttaatgcctagatggaagccacgttcaccatatggaaatagcaaaggatactgcaaagccatatatgatggatgcaatgaaaacacttgatgcattccatgatctttatcgtgaacaagcacaccaaatttatattcttttgctgaaaaatcgcctactattatgctagctatttcaccacttgttggtaggttatactgcacatcatctttagcattgcagcctaatagcgaagagttattttttcattaccatgttcagagaggcggtctctagcatatctgaaatttttaacaagttcattattggtatcaaacatgcgtgttaaggcgctaacaatttcagggtctggtctatcagcattgtcgcaatcattttcgaaaatatttaatcgattttggatttcattgtcagaatcatagatatatagctgcgcaaatttaggtggtgcacctcgtgatggcagaagagtacaaattctgtgatgcacaacaccattgattttgaaaacataaggcgcattcccattattaattgacttgtcaatagctgcacccattgaggtgaaagcaaacatcgaattatatgatcgaatttgtctcaaaaatcttttggaacgtgcatcaccattgaaattcaataaagttgcaagcggttcaggtagaggacataaaggaggcaattcaattttgccacttttgcaacataggttgtaaactatttttcttttcgagacagcagagagggttttaactctctcttgataccaaaagatggcaccacaaaatgggcattcatatgtcggaggtcagtagtacgatcgttctgggtatgatgctgtaacatacatatttgattatgtcagtttttttccttaataaatgtaaaatgatttgcttttattagaaaaatacaaaccctttaaagattgaatgtaatccttatctgtctgggatgaactaccactggctttcctatttgcaactgcagtcaataaatattttaaccatatctaagttatgcagttctagcagcagtatactacaataaaaaaaacaccttttcagcatac

SEQ ID NO: 75257 - DNA, 37494 bp, Oryza sativa
aagtaacttagtgaaatctaaaagtaatttagatatattacaaaagtaatttatattttttttatcaaaatataatcatgtgagatcttgttataaagatttaattgttacgaacacaacggtgtaatcggattatagatcggatgagtagtttaagagaaaattgtatttgaagtgtaggtggatagtgtttattatagatggagcggtagctggtttaggctgtgtagccatgtccttttccgaagcagaggaggcgccgtgacagacgtttcagattctgaaacggacgaaggcacacgaagagatcagaagtattgagaactggtatgccttttattccccccacacatcacgatgccttcttccagcaatggcaaccggacctccgatccaagcccctggtcatcgactctacgtatgtgggcactcggagaaattcatgtctattattttgctataatcaagttttggttctggacttctggtctgagttatgcagattcgaattggattgcctgccggtgggtgaggtaactctaaaatcgtacgcacataatatacttgatagagtgcctaggtttccatccttctcgcagacaatttcttagcttggcttttggacttcctctgctgccgcagacacttcacagttcacaccgtcgtcccagtcaatttgcatccagtgttcatgaaggtcagatcattccttggattttcttttgtcgcacaacattttctatgtgatacattctcattcttattgctatcagagtttgatttttccacagtcatcatcgcttcccctaatctgtggagtaataatgatctttcatctaaaaaaagattcactattttttccttctgctgtcagcttggttttggtagctaatgttaatattcttttcttttttcaagttggctaataagtttagcaattaaatctttccctttatatatatcttactccctcctttaagtgtaaccatgattttttatgcacaactttgactgtccgtcttatttaaattttactattcatattttatcatcttataacaataaaaatattaattaaataagataaacggttaaaattaagcacggaaacttatgattgcacttaaaatgggacggatggaacttaaaatgggacggatggagtatatttttatcttgccgacagatggagtatatttttatcttgcccttaatttaacaatggatcatggctgatccgagatccctaagtatatatcttcgacgcagaacagcagaacctgcctgcttctcctgtagcttcactgttctcacgatacattgagtaagttgatcccaaaaaaaaaattaaatgattaatcttccattgcagcatactaatactgagcggtttttcttttgtaaacatgcatcgagttttacataaagcaatcatctgcattgcctttgctttcttttatgtttttcatgcccagttcttagtgtgtgcatctttaaaagaatggtagctatttggcatgtaatgttccacagcaacgcggctgagtataactagttttatgtaattgttcatgctaagcatctagctcaccttgattactaaaaagatctttgttcatgacccagagcaaactggctattgtgaaggtaatggggtgagtgtactgggttcttggatcaccagacagtctcatcatgagaaacgtcaagggcctaatttgtgagggtgtggcatcctcactgtcacgtccataaatttaacccaaattttcagataattttgtgtattaaacccctgtctaggaatcagccagggtacatacacaaaacaacaaattaatatgcagatccaaatgtaaataaagcgtaaaatatttacagaataggcgcttagtcctcacaccgaaaagaaagtagcaacagcagaaaaagatgatcctagcggggcttcagctccactccacaggcaaaactcaattggggtttgagccttagtcctctacttcgtcttcagctcagaagcactacacttctgaaaggggaaaaaatagtaaggctgagtacctccaccgtactcagcaagccacaccaatgatgcagacgtgcaaggggagacgaagggaggttttgtggctatttgcataaaggcagttgtaaaacattttattgagcaaaacagtaaaactattgattaattaaggtaatattaaatctccactgatcaatgctacaccatgttgaacaggcccaaccatcccacctgaactaactagttcattaagccaatttattaagggtgagactaatcacggtgaatctggtcgatcgcccataaccgcgggcacggctattcgaatagttttactctggccagaggtgcacaactgtacccacaaaacataatccaccggcatgtcactgtgcctggctagacacgtcaccatgtcaagtgattgtggcaagacccttcacataaccctcccctaacaatccacaccacactgatgtttcacccccaccccctaccccagagttgggcagttccctcgtgcaccgtggtgaatccagaagctggacaaccggacacctcggccgacccaactccattacgccctccctcaccatcggtgcctaggaaagggttgagctatactacaagtcaagtagttacccactctcgcttgtggtaaaagcactgtaagtcttccagggtttcccgtaaaccggtccttaattaccatgggtgcgactagcgaaaccgtacactcacagcccaccatcaagtcgtattttaattggataattacgaccaatgaaacatggtcggatgtctcgagcacgcagcctgtcaaaatactagatgtctaataacgtaattatcttattatgtgagctagtggtaattaagcatggctaaacatatataattctagctaggtcacataagtaacacaagctaagccaattatcaccaaagtttagcaaaggatggatatcaagtaaacgtggcacaagcgagcagataggtaaacccataatcccatgtaattagcaagacatgcaattttaattgcaaacaataaaacatttataaagtaggctcaatatgctcaaggggaatgtatgacttgccttgcttcttcaaacaatcttctgaactctttcctcgcgaacatgatcttctgaaacggcggaaactacacgctggcacgcaaaacgaggaaaaagtctaataaaaaccaagtaaatagtaaataaaaagtaaactaacatgtagacgtaaattttagatgaattttgcaagttgaatggcccaatttgaagttcgtatgaattagttatgaattttacaagttttgagccgtttaaattgatttctagaattattattgatttattacgcaattattaattatttttccaaaggaaaaggttatcgctgacatcatcgaaggggaggccggcgccgacatgcatgccccgcacgtcagcgacacaaaatggcggccgcacggtggaccaagtccggacgcgcgcggcctggcggcaccatggacctggaccataggtggtccacgggcgagcgaagcagcgccagccagctgagaggcggcggcgcgtggccggacgaccacaggcaacgagaccgggacgagcggcgccacgggaagcggcaaaacgggagggggaggaggggtggaggaggagggagtcctcaccgagcgccaaggtggcgagggagtgatgggtggcagcggtgtctcccgggaagatgacgcaggcggcccccggcgacgaccggtgggcgtggaagggtggccgagcacctcctcgacctggccaaggggatggaggggttagggagagaggaggaggtgcgaggcggcggaaggtgtaagtcggaggggagaaaaatggtggagctcaccggtgaccgagggaacatgggtttcgatggggatccggcggtcgaggtgcggtgggatgcggcgaacgcggtggatgtgttggcatcgcgtgtggtggccgggaacggtggcaaatggtagccggaggcggcgaacacagcgacgacctcaacttcgcggtgaaaatggtgatttggctttgtttttggggcggaggagtggatgctggggtgcggcaaggcacggtgatgccgatgatgcaagaggcgcggcacggggacggtgggagctgcggcagcgcgcggccggagaaggtggtggttcgggtttgtggtggcggcggggtttcaatgctgaggaagtggtggccgaggtgcggcacgcgacggcgaagccgtcggtggtggtggcacagcgcggcgacggctatgccggcgatggcgtgcgatcggagcatgctggcgagcggcggcgaagcgttgggcgtggggagcaggggagagcgcgaggggagcttgggcgaggaggggaaatgagagaggatggctgggggatgctttttatagggctcggggcttagaatcgtggccgagaggggcggagtcggccgacaacgtggcggcgggagagctccatccggcggcgagatttggggaaaatttggagaagtggtggaggagtggatggcaaccacgttcacgaggtcggacgcgagcgcgggatgggggaggtggcggatttggctacggagtgggcggcaatggcggtttccggcgggtgataggaggttggggatgacagttggagccacgagtcccacctgtcaaccagagggagagaggaggttggtagagggaggcaatgcagacttgaggagaatggggagccgagcgggccgaggaggggaaaagaagggggagggggcgagggagacaaggatggggttgggccgaaaacggcccaaaggaaggaagggagattttgatttgttttctttttattttaattgattaaatgaactttgtgatgctaaaattacttcttgagctctgaaaattcacgggaaatttcagagagtactttagggcacagagaatattgtgaaaatatttccggccatgattttcaaaggaaaattttaattccctcgttatttcacttgattaaatgctttaacttttatttaaatcctagaaaatgcattatttaatgatttttaatcccgaatgaaaatcagggcgatagactcaccatgcggcataattgaagatactgctacatttttgcacaaatttagacatgtttgtcgaactgcggttatctttgagctgcattttggataaattcagacatgtttgtgaaatcattgtctttgagctctaggccttgacgatactgcaatatttttgttttagtgattattaatccaaagtgcaattctcgcacggaggcatcagacatggttacgttagctgaattgatgcacgcatgtgtgaaatccctgccaaaacgagcacatggttttaagagaggggtttgaaaaatgcaatggattcaaaccccatagggattggtgtcacgaaccgcgacgaatcaccggcgtctcgcctagcgatttggtcgattttggaagtttgggtgattttggggaagaacaggggaagtagttagtacagagtagagagagagatagttggtttttgctttcttcttcttcgatgattcagcccccaactcgaaggtctgaacttatagttgtgctttagcacttatatggccagcagccgcacgacccaatagcaacgacctaagtatacagcagaagtctaaaaggggtacacacatgagtaaaatagaagcagcgtgacattccctcccccttaacaaccagcatgtccccaggctggtgcttgtggaaaacgctgccgaagttgccgcaaattctcccacgttgccaagtcatcgggaagattagtccagcgaatcaacccatatggcacagtggcaccaccccgcttgatcaattgatgccgcagcaccacttcaggctgaacatgagcatcctgttcaacacattgcacaagtaagtcagaacatacaggagtacctagtcgaatcaccttcttgaggagcgatacatgcaccaccggatgtacgagactgccttcgggcaattccaggcgataggccatagctccaattcgacccaaaatcttgtaaggaccaaagtagcgaaagctgagtttctaacaagtgacaagagtgcttagcaactgacatctgcacatatggttgtagcttcaagtaaaccaaatctacaacagcaaactctctttcggatctgttcttgtcagcttgatgtttcattctctgttgtgcacgtaccagctgttgatgaagtaattcattcatctgagagcgctcctgtaaccaaacctgaatgtcaggaactgtgctcaaccccagatcagcaaccccaaaggatgtggcctttctagcaaataagacttcatagggggacttgcccagcacactgtggaatgatgtattataccaaaactgcgcctgggaaagccactgagaccattttgtctgacaggcatgcactgtgcatcgcaaatatgcttccagacattgattaagtcgttcagtctgtccatccgtttgaggatgtaggaggagctcatattgagtttaacatatgcaagtttaaataattcctgccaaagagcactagtgaacacacgatctctgtcagaaataatcatactgggcattccaaacatgtcatagatgtgttggatgaaagcttgtgtaacagtcaaggcagtgaaagggtgagatagaggaatgaacttgtcaaatttggtgaacttgtcaaccacaaccataatagtatcataacccccagactttggcaatcactcaataaaatcaagactgactgttgtccaagcttgtaatggcacagaaagaggttggagtaatcccggactcttacagtgctcagtcttagcttgttgacagatttcacaaccctgcacataatcatgcacatccttcttcagtttgggccaggagaacaagttcttgatcctgtgataagtggccgtgacccctgaatggcccccactccactgctgtgcaaggctagtaggacagcctccttagcttcagtgtggttgcctaaccatattttccctttatgtctgatgattccttggaccaatttgaaatccccttgcccatctggcaataaactcagttcagccaacaatttatgggtctcctcgtcctttgtatagccctcttgtatgatttccagccacctgggaatactcatggaaatggcagatgtttcttcttcacactgcctggacagagcatctgctgccttgttttctaggccctttttatactttatcttgtactgcaaacccatgagcttcaggaaagccttgtgttgtaagctggtggttaacttttgttcactcaaatggctcaaactcctatgatcagtaagtatagtgaacactgaatgctgtaagtaagacctccacttttgtattgccaacagaatagctaaacactccttctcgtatgtggatagggcttgagatttgacccccagtgttttgctgatgaaggcaatgggatggccctcctgcattaatacagctccaatgcccttgtcacttgcatctgtttccaccacaaattctttgctaaagtcaggtagtgccagcactggtgagttgatgagagcttgctttagtgcttccatagctatctgctggggttggagccactggtacttgacattcttctttagcaagtcggtaagtggccttgccagttggccatagttctttataaaccttcggtaataaccagtgaggcctaagaatcctctcagttgtttcaagttttttggaggtggccattgttgcacagctaccaccttagagggatcagttgctaccccttcaaccccaattatatgacctaggtactcaaggtgttacttggcaaatgaacatttactaagcttcagatgtagctgatgttgagccaggacttgcaaaacccctttaagatgctgcacatgcttagccaaggttgggctgtagattagaatgtcatccacaaataccaacacatgctttatgatccagggagcaaaaatagtgttcataagtccttgaaaggtagctggggcattactgagcccaaatggcataactctaaattcgtaatgcccttgatgagttttaaatgcagttttatgttcatccttctcctgtagcctaatttggtgataccctgatctgaggtccaatttagtaaaccatttggccccggccagttcatctaacaactcctccaccactggcattgggtacttatttttgacagtgatctcatttaatcccctataatcaacacaaaatttctaggtgccatctttcttttttaccagcagtacaggggaagcaaaagggctctcacttggcctaaccactccctactgaatcctttgagctatctgtttctctatttcatccttctgagcaggggaatacctgtagggtttcaaattgactggtttcacccctggttgcagaggaatggcatgatcaaatgccctgtgaggaggtaaggaatcaggttcttggaatctatcctaaaactcagttagcaccaccttaatgcattctgggacttcttccaccgattcttcagtttcctcaattgcacacagttgcaatagctgtgacacagctccagatttagttagcccatgcaactgtttagctgacatcaacttgcaatgattcagttggtccttaaccccaaagagtgtaattcttttgtcatggtgagtgaatctcaacttctttctcttccaatccacccacattgggctgaattccttgagccattccatccccaaaatcatgtcatagctccctaaaggtaagattttcagatctgtgacaagatttaccctgacaccaccattccaccttgggactcatcttagtacacaacatcttccctccatcagctatagttacctgtgacacagctgtatcttccactggtatgttcagcctttttatcacactctcagacaagaaattgctggaactccctgagtccaccaaaatcaagatatgttgcttttgtattagcccttccaatctgatagttttcctaccagtaaccccagtggctgcacactccgaaattaccaattcttcatcactactggtttcaccttcctcctttactggttctccatcaacttgaagttggaacacctccaacaactcctccagaatgtggagttgtactgattttgggcacttatgacaaggtccaaacttttctccacacttgaagcactctccctagctcttcttgctgccttcaaagattcaaacctgtcttcccactttggcttttcttccacttttttagtttcctctagaactggccccaatatacctttcccttgatatccaatcttcccaggtgccgtattagcctccttgaaactccctctggtggaaacatagaagttcttcttcccagcttcagctatcagctcctcctgtattttggcgagagataacgcagcatcaactattctcggcttatgtagcttaatagcaaatttaatctctccctttagccctccaacaaaatttgtcacaaaataagtttcatcgtaccctttgttatacactagtaccctatgcatcaactcctcaaacctcttatggtactcgtctacacgcccagtttttgtaaaactctctaactcctctaagtggtcctgatatttatctctcccgaacttactatgcacagctacacataactccgcccaaccttctacactgtgcaactcctcataggtctgtaaccacagcgttgcattaccaacaaaatgcagcgttgcaaaggaagcccacgtttcaaacggaacttgatacatgtgaaaatacttctcagaattggactttcacaacttaggattctctccatcaaattttggaactctgtttttcgtaatctagtacccccatgatgctgactcccttgagactgactccgccatctctctgaaccttccctcaaatcgaaatgaatcggagagtggcggaagtgaggcttacccttgaccagggtatgctcctgagccgcagaggcatcagttgcaagaccctggtgattctcgaccttgccttgcccttcgggcggtggtgtcgctgctgttggtgatgccttcggctgggattccagcgccgtgatacgggtggagatcccttccaccgtcttgttcagatcccacatccccgcatccacgttcggaatccacgattccaagccccgcaaggtgcccaggatgttgttgtgactgcttgtgagttccgccaccttctcaccaagcgcctccgtctcgccttctgtcgccaccactctctccgtcagagttgggttccccatcttcctctccgtgttgcgcaaggaccgacggctctggtaccaaagatgtcacgaactgtgatgaatcaccggcgtctcgcctagcgatttggtcgattttggaagtttgggtgattttggggaagaacaagggaagtagttagtacagagtagagagagatagagatagttggtttttgctttcttcttcttcgatgatttagcccccaactcgaaggtctgaacttatagttgtgctttagcacttacatggccagcagccgcatggcccaatagcaacgacccaagtatacagcaaaagtctaaaaggggtacacacatgagtaaaataaaagcagcgtgacaattgggtgatatgggagggactcactctccatggatagattcctctggggtttagtatttcccaagcaaccgaacaaaaccttaaacaaacccatgccactggatgctttaagtttgcctaaccgtcaaccattgcgtgaaaattataaggtgagtcagatattcagaatcggagctgaaaattcttttggaggttaattttgttgcaagagtcagatagtactgttcttggtttgaaaagagaggtggttttcatttcgattgagctgaagacgacgtagtaccaacaaaaggagtatatcaatataatcgataagcccaactattaataacaattccagtttagcttttgcgtatagaagaaactaattaattaatacaagacataatttaattaactgatctccaatcaaatacttgttaattacattatatatatattctaacaagaaatttttgagagacatgtacgtgtgacctagctacgtatataagagctttaatttaatttttagttacatcctcggccttgcggttgggtgtattgtcgttgtatccgatgcccttcctcttggtcgggaagatcaagaagacgaagctcgacaagaacgccatgccaagaggcaggttcttgaggagctccttggtgttgccgccaggattctgcccgaagaagcagttctgcagcccgacatcactgaacgcaacggtgaggaacaccatcgccgtgaagaaggagtgcacgaagtccagcggccgtagtcttagctcactgtgactcaatttcttcgcttcctcctcttcccgggacatgttgaacacgttcaatccccgccgtgtcgccacgccgtagtagagcttgccgtcttggccgacgacgctgtccgtgaaggagaagaagagggagaggccggccaggacgccgaccagcacggcggtgagccacttgttggcggcgttgcactcgccgtggttggtgaaggacggcgacagcgcctggtaagccagcaccgtccccgtcggcagcagctgcgccaggttcgccgtgcttgccatcaccttgtcggtcaccgtcttcgtggccacatctgttttcgacgacgtcgtggactcatcgacggccttaggcgtcgacggagctaagttattggtcgtcaccgccgtggactcgccgttggtgttcgatgccatgttgatcacgatggcgcccggaggagatgccgccattgctggagcttttgatgcggcgtcgtagtaattaatcaactggtgaagactgaagagagatatatgtgtggtagctcgagttcctgcgcttatataggtgaaaacatttggaatgattccatgttgtgcgcgttgatttttctatgcttgaaactagatgggtcgtgaccattcatgcatggaattcagatcaactgagcaagtgtggtcagctgttcagcagtaccgatctgcatccactgcagtttttttctacctacatgttactactacatcttactccatcttggagttggagtacttggaaggttggaattctcgagatattttctcaatttacattgtaaccaacttggagcatcgcaatcgccaacgggctaaatttgtcttcactgtaccggtgagaccataagaaaatgacgtttttatcgtgccactgatgcatgccttttttttcctggaaggcgagaaaatgatttttattttcggtctgtgtgaagaactagggagtactctggctatttttttagtacaacttggccgtgcgcgaaaggtttatatccgggagtagagagaccgctttgaacctttcattttagatagaggaagatcatttaacaggaaacccagccacaattttttttttagccttacatgtaaagctcatgtatatattgcaatttatagttaatcgtaaaagacatgtgtattgatcacatgttatattttgcaatttatagtaatcatgtacaacactactcttgatatataggcgtgtacaatactactcttgatatatagtcgtgcagagaaaccatgtcatagaacaattcaatttagttctagtaaccttctatgataagcagtgtttaaagaccaaattgaattgttttaacatgaacttgccaggcaaatacaatccaataaaccgtatcatatactgtttaaaaatggaggtagtacatgtttattccctacaagaaactagaatttcttgacaggcaaaaactgccctaaaaaaacatcaaaatggccaagaaaacgagtaatattagtaacttaatttgttttgaccgtaaaaagttaactaaccgttaagaaaatcggatttgctataattatggcgataaattttcttcttaatcacagtcgaattttcgtccctacgatggtgcggacattcatgctcacatgggacatcagcgcacgcgttttacggcttgttttcgacagttcttcacgaatcacgatctagctatgtagctgcgcctgttcgcttccagcgtgagggtgaaaggcatgttgatatatgaccggtgggtaaaaaaacttagttatgtctaaatacatagctagaagttgattttttttgacggagggagtacactttagttacagcataattacactataattacatcataattaatattggttacatttgtaatttttattatatttagctgtaattttaatttatatgtggtgatcaattttaatttgatgtatttatttaagtttgtcatcttaaattagccttgtgttgtggaaggtgactgttttcttacctagatttatgttgcatgtcggataggtagtcccataaaaattctggattcttatagtgatatgaaaaatcacctatcttaagggcctctttgaatcgtagaaatgaaaaaacagagtaataagaaaaacgcaggattctgacagaaatacaattgtaaaacagagaattacaaaacacaggaatgaccgtttgattggaccataggaaaaacgcaggaatcagattagaaagatagactcggagaaaatttttcaacaggttaaaccttttgctaactttcctccaaaatgtatatagaattacccatttcataggaattttaaaggattcgagaggattcaatcctttgtttcaaaggacttcatagatttttttttttcaataggattaacatcctctaaaattcttatattttttctacaaattaaaggggctctaaatgtttatgtactggcagtacaatatgaagggcgccctaaatgtttatgtatttaaaatttttatcgggtttaatttatacatagcagatggaattaatttgtaattttaaattatgatgcactgcaagttttagagagcatttgcgacccatgaaaacaagttattatcacgtgcgagcttcccctgaatgcagtaaccatgtgcgtgcagtgcgtgcgcgcgtgcagactatcttaattaattgcaagggagaccccgacagtaggagtactaaattagtactgtggaggactaattaatttctttctaagccgccggaggcaatgccacaaacactaatctatcagccactagcaccaattgacagtgcaaactagggaaaaaaacacatgcgtgaaagctgacattgtaatactccggcacgaagaggccgaccggtctgacgaagtatatagtagtaataggcaaccaattaacccggccgaccagtcgccaagccgcgcgtggcacgaagaggcggctggctgacagtccgccgggcgcgcggttccggagaatcggtcgtcaatcgccgcgcgcgcgggacgtcgaccgatcgatcgacgtggatgactggcggttcgccgtggaggttataattaccttggatcgtctctgaaagggacttcgccgtgtgggaggaaagtaagatgcgatgagacgcgacgcgacgcgatgtgtagccatcagacccgtagtcgtagataaattccatgtatgtgtacgacgtacatgtgctcagaagaagcggacaacaaaatggaaaagggagaaataaacatcctagcatttgtctacggacaaacgttgtcactactaagtaagagttgcaggttcctgccatgttcctttcgatcctgaccagtcacgtttttgctttgacacaaacgattgttgcgatcgcttaattaattccaccattaattaggactacgtgatgcctcacactttgctgcggatatatggatgaatacattttatacgttatagaaataataaaatgatatatgtatatgtttaaataatataaaaatgacgtggagataataatttgacattatttgcatattgattatataattctaaaaatataaaaaaaatgtaaattatatgtcatatttgaatgatatttaaaatattcttagataataattgctagtgggtgataatgtggcaaacttgtctgcgatttaaaatactctatataataattgctagagggtgatgatgtggcccattccattcctctctctcctcccatcggcctggtccgcctcccctcgcttgctaggccggcccacctgaacgcacactgcaccacacaccacagacgccaacatgcggacccacctatcatctcccacctcccgccgctcctgttgccctcgcctaaccatagcgccgccgttgccgcccgcttggaaggggggatttacaacccgtgtttccctttccctttccctccatttcccctcctctctctctctcctcttgaattggccggatatcctcccgcaaatcttgccggggccattgaaggccactggatttgacaccaccagttccccgctctccagccctccccctcgtcccctaccattatataaaccccttccacaaccccctctcccatttccgccacttaccatccacactcgacccgaaacgagctcccgtcgttgctctctctctctctctccgccgccgctgtcgccgagctccgaccgagcttcgccgtggtcaggacctcctttcgtctcggcgccaccaactctggctttgtagcgtctccgccaacctcgatcgccccttcaccacacccgaggactgttcgaaccccgttctccccgagctcacaccaacttttccgtcgccaccaccgctttgggtgatccacgggcctcgcccttcctttcaccgtgctcatgctctctccgaccgtcattccgccatgtggcgagcataggagcgcgggcgctgcctcccaccggtcatgcagtcgtctcctccaccgggcgtgttgcgtggccgccgtgtggggcccgcctgtcagccgctgttgtccacttcgggtggctgatgcgcggggcccacagcaccggtggacggctctcaggtgcacccggtccagcgtagaccgattggatgccgcgtgagtccttctcgtggacccaactcacacgcgagttctctggtgcaaatgcaattatttatttattaataaaaataattcaagaatttgaaaatattcacctaaacaacacttaaacttcagagggccatatcttggtcgtttggactcggaattgacctgttcaagtctctaattttttcttaagaagtcaagaacctacttttgtactttgttcttgtgacttatttggattttattagagtaaaaaacccttttcttttcgttggtcatgtagacgctgcagctttggaagatccgctctacttggaggttgaaggcaagtcacatctccattgaacatattgttgtcccatgattttaaattattgcataaccgctttatttaaattctcgcgttctcattgttttatttagcttttcatattaatccttgttatagccttatcgttgcaatggtttatatcacttcgttcaccctaggaaaataaaacccaacaagtgtgtactctatatatggttccaccagtatgaatttagctagatgcttcgctagttaactagacaactttgacttgttttataatcttagactttaggagttatatcatattacttggatattatggagtggttggcttatgttggaatagggcatacaccctttcccctattcaaaaacaccccaaatggtcttaggctaggctcggggtgacgaggtgcatggttttgacttttgagagtagcactttggccatcataaggaccggtctttgggcctttgttgctatgtaataccgtacttctacatgtctaatgggtaaggcttagtttgtagtttagtctagtcatgaacaaaaggacatatagagatggatgaagtcgggtgatggatatctctgaggcaaatgaaggctatatgggcgggtgtccgatagtcgagatgtcatggcacaggacaagcattcgggtggccactctcgaaggatgttctgatgacgtggggcttagccttaacctacctgtcccgggagcctcggccataggcaggcgttgggtcggtgctcttgtgcaaggctaggatgggtgaagaactatgtgacaccctccgctcatttaccatggtggtaagtggcacgtggcaacgcgtgaggaaggcatgtcttgtgggtaaaattgtacacctctaataaaagtataatccattcgaatagccgtgccctcggttgtgggcaagcttaccaatgtacacaagttagtggtttttctcttaaaacttggttgggtttgcttgggatgagctggggcccggtgttgccagtttggtctaactcgttgtaggccttgggtttatgcaggttcgtgtgggttcacgaccttgattaataatcttgtgtagatctaggttcggagtttcctaaatagtctcgagcaaataagtggtttaaaatgctactttaatgcaaaacctaacgccctattattattcccttgtacttccttgcatttactgtgcgtttgccggtatgacttgttgagtatggtggttgtactcagtctcgctcatttttcttccaccccagaagaggagctcttggaagaggatgggttcggtgtctagctcgtgtctgccgtcaaacacctgtcgtgttcgccctagtcttccgtgtttcttcatatttctctatgagctgggcctttgggttgcccgtgtaataagtactatttatgcttctacttgttaaactttgatttgtatcaacttttatgtacctcgcctcctggaacatggaataatgcacgcacgtatgcaatgcatattgagttatctccagttgtgacacatgacgattagatcatgccacattgggagccagtgatgagaatgtaagacaaagttattttttacaaagctttgagcatgcagctcatgtgcccctagtcttcccttgttagtgccaaaccaaatcacacaattaaaatatatccctccaaggtgaatcggttagttaattgctaacaaaaacataccacttctggattggaatctgtcgacgttttttctcacgactacgatatttgcatggtatggggattgttggtactacagaatatgcggggttgaggtaaaagagatagagactgatttttatataggttcgggccccgtattcatcggaatcaggtaatagccctacccttgttggctgttgacggtcgttatcgatcagtttcgacagtcaatattactaaaatgggagagaactagtgatgcttgcaatgcatatgttaatcagaataataatattccactagtattaggtttactaaccttttgcagagaatgatcataaagtagaggagaaccgacatcaactcagacaataaatcaatcggacgatgtcgagaaccagacttgtgtgtgaataggccaagaactcagaattgacacgatgaattgggccaaaaattcacaagtctgcggagtggagcaatagaggaggccaccagccgaaactgggctggattgggccagccccaggttggttcggccgaaccaatcctggcaccgttggatccaggttttggcatggacgtccagtattgcatcccaatgacggttggagggcacttcggacaattccccttccacaaccgtcataaccacctctatataaggagctcactctctttacttcaacacacacctcaagcaatagctctctcattcctctcaagtttagtttagtagtatctagctggtggaatagaaatagaataggagtccggagtccggaagccttcggaagagttcgggtatggctctagcagctttcctttcctcttttgtaagctttgtacttttattagaatactcttctatatacatttatggtattgaaatactttccgagtatatgagtacctactttacattacgttcatgttatactgaatatacggctagcttatctgggagatgctttggtgcgggtatagtgtttgcttatgcaattactctatgtcatgacgatgatattagagtagtatctggtagtttagacgtggtgtctagattatgagatatcattatttggggttatatattgcagatgagagatgggccgctaatggtgacacctcagtacgggtattcctccgcgcctatatataatccgaagttaatttcctgagaagggtattcctccgtatttagccccggttggatggtgatgacgggctgtcgtaagaaactcggcagtcaggggtggcttctcgaagtaccaggagggcatcggatagagggtattagctagtatattagttaactagaatgtatgtatactatgtatattagaagtataggaatagatttgttttctcttttctttccacctagcttagataaattgttatgaggatgagtagaaatgcttgtgtgtcactctacccttggattatcttaacccctgcttagaatatgattatcaaaataatatataaattattagttgagttctctctacatgatcttcccacgggataaaataaatatgatacccttgtaatactctcgggtgaaatgctacaatggtatatccgtgcgcttgcggatgaactctataaccataatataccagaagtgtttctgcgccattgcttggaattatatttctagtaaagtcgttaagaaataccaacaattttgcagctctgagctgtaggcgcttcgcttctgcttcatcctccgggagccagccgttcgagaggtactttaggaacagggttcgccagtcctctgggtcttcatccagctcggcctggtcgattgccatgatattcgggctctctatgggcacacttgatgcgtacaggacctcaaaaaagatgcttggcgaatgcgggcctccacaaccagcagatttcgtcaaggcatatgcttcctcattttggtctctaggtaagtgttcgaccgttatgccggcgaagcacttttccatagattgaacagcctccagatatctcttcattccttcctcttttgcttcaaaggatttgtcaacatgacttgccactagtttagagtcggttcggatgagcaagcaccgaacccccaatgctttcgccttttttaggcccaacagtatagcttcgtactccgatgagttgttggttgtgtcgaactgtagccttgcggcatagcggatcggcacgccccctggcaaagtgagcactgccgtgcgcctgcccctttgtgcaaccacgagccgtcggagtacatcacccaaggttgttcgacaggctcgggttcaggggcgaatgccagtgtccattaggccacaaagtcaactaggacttcagacttgatggcagtgcgggcgacaaaatgcaggtcgaatggagataactctgccactcacttgctgagccagccagtaatttctttgccccggagcacttcgcccaaaggatactgggaaagcaccgtgactttgtgggcctgaaagtagtgtttgagcttgcacgaagccatcactagggcgtaggcaagcttttccatttcgatgtatcgtatcttctccccttgcaaagcttcggagacgaaatactctggtttctggcctgactctgtttcttggacgagggctgcactgatcgacactggcgaagctgctaggtagagtagcagttcgcttcctggtgctgggctgaccaaagcgggtgggctctgcagatatcgctttagctcgtcgaacgctgcttggatttaatttctcaggatttaatttcatacccactacacgtaagttgtcgaaggtctcctgtaagtcggacgcatggtcgaaagccatgcggctttttatgacgatattgtcgacataagcctccacatttcgccccagctgcttataaaggaccttgtacacctgcctggcgaaggttgccccggtgttccttaggccgaaaggcatcctgaatggcaaaaggtgctgaatggtgtgatgaaggctgtcttggggatgtcggccggattcatgtggatctggtggtagccggagtacgcatccaaaaaactcatgagttcgcagccagctgtcgaatccacgagctggtcgatccacggcaaggggaaatcgtccttcgggtacgccttgttgaggtctgtgaaatcgacacacatgcgccatttgccgttcgatttcctcaccagtaccggattcgctagccactcggggtggtcgatctcctggatcaccccagccttgagctgcttttgcacttcggctttcgctgcttcttggcgatcagcggacatcttgcgcagcttctgtttccttagcctggcatccggcttgaccgccagatgatgcatgatgaggtctgtcgaaacacctcccacttcgtcggggccccaggtgaagatgtcaatgtttttcttgagcacctccaggatgttctcaacttctctttcgcccatgtcgccccccagcgatacaaatcttgtggaatcggcatcgttgacctgctccttgatcaccctgccgtggggggcaggcttcggcgcgtgcttcgctcggtcatgcggttcggcctcaacatcgtgcaccgctctgttgatagcggccaaatcgccctttgatgtagccgaaggttgaagccccttgaccacgatcactcctgcagggccaggcatcttgagcttaagataattgtggtgggagatggcttcgaacttgttcaaggttgcgcggccgaagatggcattatagttgtatgggatgtcgacgtcgtcgaacagtatttgctcttcgcgtctgttttcacctgtgccgaaggctaccaccaattgtgcttggcctaggacttgaactgcttctccgccaaaaccacgaagcgaggccggtgcttgggtaagggctagggtaggcaaccccatcttggcgtatgcttcggcgaagatgacgtcggccgaactccctccgttgactaggattcactggatttcgaagccagctacgtcggccgagatcaccagggggtcttgatgtgggaacaacactccttcggcatcttctggcccgaaagagatctgctggttcaaatatcatggggccccttcacccgccgaagtgatgttgtgcaccattcacagctacatcttcttttgccattttgacagttgattcggtgggtcggcccttgtaatcacttggattactctgcgttgtacatcttggcgttgttcggccgggggtgcttgttcttgaatggcttcgcgaggtgcttcgacagctgctccttgttgcggccttggatcttatgcgttgccgctctgccgaatgtttcggcattgctctgtggtgtgcgaagagcgtccgtggaaggcgcagtaaaggtctttcctgaccttcttgcgaacaggctgctgatggctggttgcttgttgggcgtcgaactccttgcggagggcttgaacttcttcaacagccatcacggccttgcctgcactatcggttctgaatttcctccacgtcatgggagcttgacctgacctttgcggttgtccttggttcgccggctgagactggcaaacagcaagaggagttggctcggcgacttgtgcttgtacttgggcttgagcagcgatgacagaggctttatcgtactcagcctggattgcttgccgtcgcttggaatcctcttcgccccttgcgtattcgtcaatgatgcgaagcaggtgctcaaccgtctgcggctccttgttggcgattttccttgtgagttcgccctcgagcagcccggccgaagcggcattgatgatagacgcctcagttatgtcctgaacttggcatcgggcttgcgagaagcgacacatgtactcctttatcgaatccctcggccgctggcgaatgccgagtagatgttgctctgtcttcggctactcataggtgcgtcgaaatttatggacaaagacatcgcgcaattgctcccatgagtaaatgctattagctggtaaattgaagtaccaagaacgggcgaggcagtctagagcaagatgtattacctttgccttggtattttcgtcgccatgagcggcttcgatcgcggactcatagatggacaggaactcttttgggtccgtttcgcccgagtatcgcggaatgggtgggaacttgaactgggatgggattggatgaatcttgattcccccactcagcggcagccccctttcgccccccgccttgctcacggcaacttgctgtagaggcctgtttggatatggcatggcgaagggcgaagtcatggcttgcacgtgcggtttggccacagtgttcggctgcctggccgctaacggtgatgcctgatgagccgccatggatgggtcgaacgaaggctaggtccatgccatggcgacctggtttggcgcctgattcgttccgaagcctggtgtcggtgcctgtggtcggatggttggtgcttgagtggcattgctgaagtcgaattgcggtccttgactccatggtgaagcccccggaccaggcaggttcgtcggtagtcaaatgggtgcaccttgacttgtgttcccctccggttgggtcgaaggggttacttctggaatgttgtggggttggttgagctgctgaagaaaagcatgaagctgcgcttgcaaaactgaagctccttccgccattgcttgcgacatttgaccaggtggcggggggcatacttgggcagcgaccggccgaacttgtgactgtacatgaggggtcggatgtactgtggcggtcgaaggctgtccggcgaagtacgctggtgcttgcatgacttgtgacggaagggcttgaatcggcacttgcgggtagacctggggtgggatgtagcctgccgaatactggagaatgggggccgaggcgaccttggcttgccgggccacttcgtatgcctgctgctgctcttgcatttgacgaagcatgtcctggagtcgcaccatattctaacgcatggcccccatgttggcttcggcttgcgctttgaggttggctccggtgtgctgtgcgcggtcgaagctatagcctgctgcggcgaagcagcctggggcaccaccagttgacttgtcgaaaggatctccgccctggtctagagcgcccttgccgctgctaccgccttcgccgcatcgactgtgttcggtgcctgccccgtcgaagcagtaggagccgaaggtggtggttgcggcgcaggggccaaagtcgatggtaccacatcggcttcggcaccaagtgccgaaggctctgctccctcctcggctgccatctccactcctgcttcactctccttacgccttgcaacattctcctttgcgaccttcttcggtggcattcgctctcagtggtttcgctcggaggtccccacggttggcgccagctattgtcgaaatgacaaccgcttaaagtgtattaaattgagaatttttcttaggatccccccttttacatgaccctaggggtctatttataatcccattacaggttcccctattagggttaggttttacaggggaatttatatgattgcccttatgaaagggacatttacatgggtatatagtgtaattgaggtacatgggcttctagtgggccgactggggaacgctggcccagtggcccctgggcttgatcggctaagatggcgtcttgggtctccttgaagttgaacttgctatggcgaagccatctgccttcgccatacattcttcgccatacagtctttgcccaagatgcctccaaccttgtgggataccagcacgatccttcgcccttcgccgtctttgcttgatagtcttcgccatggggacttcgccccgacagactcgacgtcttgggcttgaacccccactggttgcatggtttcggcacgtctggtcgaagggtctcataacataccgccaacagttcccatcatgaacttcagccccagttggctttgggatcttggtttgaggttctgacgacgtgtccgtcaatggtggaggtggccttcctgacatgtttaccgtcttccaccgggcgtgccaaaagcgtgttgatgcgtaaaacacgaggcctgggagatctgcttaactccagtgcaggtccaaaatcttgcctttaggttcgtgagcgtgccaagttcatttgatcctgcaatcaacaagaaataaagacaaagaaaccgcggttaaatttataaatgatagccgatcggctagttgccgatgacatcatttatctctgagccgatgtcatgtttgaatcgatcggcagatataaataagtaacaaaagactaaatctacttgatcggctgtagatattaacaactaataatccttatatcgatatatacttaaatcaagtggttgggatagatcagtcgccataccgagacagtataaatcacttagattgaaatatatattaacaacgagattatagatgctcatagcatagcagatcagatagatctagcatgtatcggctaatactccgataccactctatattaagatattaaagcaagcaaaatatatcaaaacggaagcctaacatactttgttgtactaagatcataatataaaaggcagatctagcatgtcaattaagcatatgaaatataaggctaaatcaggtaagatcgggtgaaaccccgatactaccctaatcggcaaccaaaagcaggctagaggttgagattctaatcacgacttataacgtcaaactcaactgatgcagctataagtatgaaaagaaggacaatatctagacaatcaagcagttggatgtttcatagagtggtgaatatcctgtacgatctaagccaacatagatatttaacctaatcggctgccttccaatgatagatgttagccgattgaaggttagataacgatattatcaaagattatatagaatatatgataacccgacgaattacataaacaagattagagtatcataaagatggaagcactaatcccgagaacacaagccgccacagcaagttttacctctagttgaagatcgaaaccgatgcagctaaacccgaaagcaagaactcgtcgaaacgaaagtaaaagggtggtgatgcgccgacattgtatttgaacgtgtgttatcgtattacatggggctcggggtctatttatacccgagattacaaaatatgtccgtgtcggacacgtctcttatcactaacaaactctaaaataccataagtctttgcggcagactcttgtccaaacatatctctaaggaaattacatgaaatatcctaattaataaatacaattgcctactcaagactcaatccgtgcatagcaatcctcatgaagcacattaactcaacctgacaacgtgtaccacgccatattgttggtatcggctgaatcggccaacctagtccgactcgaactctgccgatcttagtcgtagccgattcagactttagccgatcctcactctgtttccggaacgatttctatcttgaattccacttcgatcctatcttcatctccgatacttggattaccaaatttggttgttaacaggttgtaactcgttgccatctggaccaagatcttcaaccattccctcttgaacaccatcacctttgtcacctaattcaccagcagttactttaccagatgagcttgaaccaacttcatcggcagcaaccactttcagcttgtatttctagacaattgtcccttggcgggtttctttgaatgaattcatgaacttgtccttcacgctgctcatcatctgttcaagctcttgcctatgttcagccatcaatttgtccagtgtgactggaataatatttccttcatgaacttcagatccggttgaatttggaagcttgttttgaggatctgttgacttcgaagcttgcttgttgcccgacatatttatcgtgtcccactgggtgtgccaaaagagtgttgatgcaaaaaacgaggcctgggagatctacttaactgtagtgcaagtccaaaaatctcgcttttaggttcgtgagcgtgccagttgatttgatcctgcaatcaacaagaggcaaagacaaagaaaccgcggttaaatccataaatgatagtcgattggctagttgccgatgacatatcattcatctctgagccgatgtcatatttgaatcgatcagcaaatataaataagtaagtaaggattaaatctactcgatcggctgtagatatctacaatatgtaatccttatgtcgatatatacttaaatcaagtgattgggatagatcggtcgcgatgccgagacagtataaatcacatagatcgaaatatatattaacaacgagattatagatgttcatagcatagccaataagatagatctagcatgtatcggctaatacttcgataccactctatattaagatattaaagcaagcaaaatacatcaaatagaagcctaacatactttgttgtactaagatcattatataaagggcagatctagcatatcaattaagcacatgaaatataaggctaaatcaggtaagatcaactgaaaccccgatactaccctaatcgacaaccgaaaagcaggctagagattgagattctaatcacgacttgtaaggtcaaactcaactgatgcagctataagtatgaaaagaaggacaatatctagacaatcaagctgttggatgtttcataaagtggtggatatcctatataatctaagtcaatgttggtatttaacctgatcggctaccttctagcaacagatattagccgattgaaggttagataacaatattgcctaagattatatagaatatatgataactcaacgaattacataaataagattatagtatcataaatatggaagcactaatctcgagaacgtaagccgctataacaagttttacctctagttaaagatcgaaatcgatgcagctcaacccgaaagcaagaactcgtcgaaataaaacgaaagtaaagggtggcgatgcgccgagattgtatttgaacgtatgttttttttattacatggggctcggggtctatttatacccgagattacaaaatatgttcgtgtcggacacgactcttatctctaacaaactctaagataccattagtctttgtagcaaactcttgcccaaatatatctctaaggaaattacatgaaatatcctaattaatagatacaattgccttctcaggactcaatccatgcatggcaatcctcatgaagcacattaactcaacccgacaacgtgtaccacatcacattgtcggactcggctcaatcggctaatcttgtccaactcggactctaccgatcccagtcgcagccgattcggactttagacgatcctcgctctgattccggaacgatttccatcttggtttccgcctcagttttatctccatctccgatactgaaattaccaaatttggttgttaacagcacggaataccgttgtagcacttcaccttcgggtgaccccaaaaggatatcgaactcagggaacgtgtgtaatctacctaaggctaagactatccaaggacaacaactgatgataggtaggctaagctagagaggactttctatgtgttttagttacctacgctaagcaagataattccctatctgttgcttcgggcaccgacccttgctggtctgccagcatggttccggctatagctctatgatgtatccgatcgtggagaattactgggacggaattcagggctgtcaccacctgccgcctacctctgacaaatccgtgggatacacaacaaacaaaggtcacctctaacctagacaccacgtctaagttattaattactactctaatacttgtacaggaacttccttctttatccagagtcctagtactagagcacttagtatgaatactaaacaatgaacccgcaaagatgaaaatctatcttacttagacaaagtaattaaataacataagaaaggaacacgaatgcttactttatagaagaagttctctgaacccggagcagagtgtaccgaggtagaagtcagatgagcgccaaacttccgggcactcctccagagcttcccctccattctctccatctctggctggccatttttggtcgccgcgggtttcctcccaagccctaacccctctcctctctctcctagggtgccgtcgccgcccgtccgtcccttcgcgtcgccgatcatcaccgctgccttcgccttccgctccggccgccatacccgccggtgaggttcccctctcctccctctttccctttcccccgtgtgcaccgccgttctccgcgcgtgcaccgccgtcaccttcggccgacgccgctgccttccgcgctgtccgccgccgcctcccgcgccgccggttgccgtcgccggcgaccgcatgccgccgccgctcgccatgcttagccggtcggcttgaagtcgagccgagccaggctggcgccttcctcctcccctttgaaccaccgcctggtggggcccacccgccaggccacctcctcctcctgttgtgtcgctgacccgtgggtcccgcatgtcccccccccattggatgatgtcagctgggatgatttattgcgcaataaataattaaggtttttctctttacagtgaaaacacagataatcttctaaaaatcatatctaattcatccgagctccgattaagtccattcaagtctcagtaaattcataaaaatgcattgaatccattaaaaatggttttgtttcctatttcagtagacttatagcatgttttgcttgtgtgctttgtttgtcgcgtagatttcggctgtttcgtcgatccgcggtttctcgaagacgttgctgtggtctcatcagtgcgagagcaaggaaattcatgcattacaattgatcatattgtacccaatttacaaatgtcccgcatttctattaaatgttgcattgttttacaatatcatgtgggatgggtcctactactcagtcatatattatttaccttatgccattgataacttgggtattaacatgattagatattagtttagggaatgcttagccatgcttagttcaactagtacacaaaaggggaatcacattaatgcatatactttgattattggcatagctttggattagtgccaccgcaatggtgttagttaattaaaatacactacatggtgggctgtgggtgcatggttttgctagtcgtgcccatggcgattaaggaccggttcgcgggatgccctggaagaacttatcgtacttaccacaagccagcgtgggcaatggctggacttgtagtgtagctttcctctagccgatgtacccaggcaagggtgggcgtgatggagttgggtcggccggggtgtccggttgatcggcttccgaattcaccgtggcacgagaggggactgcccgctgccttgcgaggagtgggggtgaaacttgaggtgtggtgcgattggttagaggggcttatgcgaagggtcctgtcacggcctctttctggtatgtcatggtggcatgtcggcgtgcggtaacgtgtcgtggggctgtttcttgtgggtacagttgtacacctctgatcagagtaaaactattcgaatagtcgtgcccgcggttatgggcggtcgaccagattcactgtgattagtctcacccctagttagctaatgaactggtgtagttcaggtggttggttgggcctgttgcaacgtggtatagtgttggacagtgattggttaatattgattaattactacaactgttttactgctttcaactactgcttttaaatgtctgctttattgcaaatgaacctctagccacagtgggtagtactcagtcttgctctcttttcccctacaccagagcagaagttcttcccagttggagccgtgtcgaagaagttggttttgttgatgccatcaaggatgcctgtggaatggagtcgcccactgcaggagtcaagtcttcaggcttagctcgttttaccttttccgctgcatttgtaatcttttatatttttgtaagacgtggatctgtatgtcaataattatcgtttgtgtaccctgactggtcctggacaggggtttaatgcacattcagcttagaaattctggtttgtgaatttctgggcatgacaataagtttgtgcacctcgagtacaaaactaaaaaaaatactccctccatttcaaaaaattttagaaaaatgtaataatatttaacaaacatattatcaaaatatattcaatattacatttaatgaaactaatatgtaatttggtatggtaatatcgctactatttttttataaacttaggcaaatataaaaataagtttgactaaaaggaaaggtcaatctaacttataatatgaaatgtataattctataaataaaacccgggtagaattatttatagaattctatgaaatatataattctataaataaaaccagcttatgatagcaaactagcagcggggaccgccaggctccaccgctgcatctctagtaccaactgctatatttaccattatcgataccttagaaaaatgatttgtcattggaaaattctattagttgtatagtattgttggctccactattgtaaaccagtaatctatagggtatggtattcatctaatgatgggtacaataagaataaagaataatgtacgtcaaacagtaataattttactcgacaataaattgaacggaggaattagcattgtgtccttcaagcacctccaatctcgctaatatgcaaactaaattagcagttagcaatactgtaatacagtgtaagtataatggtcctatggcatgtgatctgaaacttgtgtaggcttgttcgtttctggcgccggacggggagtggtgtcggtgtatccgatgcccttccttttcgttgggaagagcaagaagacgaacgtcgacatgaacgccatccccaggggcaggttcttgagcagctccttggtgtcgttgccggcgtcggggaagaagcacttggtgagcccgacgtcgctgaatgccacggtgaggaacaccaccgccgtgaagaaggcgtgcacgatgtccagcggccgcacccgcagctcccgtagcttggtgcgcgacaactcctgcgcttcctcctcctcccgggacaaattgaacacgttgaacccccgcggcgtggccatgccgtagtatagcttgccaccgcgtccgacgacgctgtccgtgagggagaagaagatggaggaggcggtgaggacggcgacgagaccagcggtgagccaccggtttgacctgtagcactggccgtggttggtgaaggacgtggacagcgcctggtaggccaacgccgtgcccgtaggcagcagctgcgccaggttcgccgtgctggccataaccttgtcagtcatctccggtggcggcctagccgccggcagcgcaggcgcagctgtcgccttacgctcgccgacaccgttgggcatcagcgtcgtggccatgcttatatctgcctcaggagctgcctcgccgtcaccattggtttcttgtggttgtggcatatcaatcagcttggtctcaagtgaggattccattacttggttttccttgtgcattaacgaaatccggttgataattatgtataatacgttacgttcttgaggatttatataggtgaatcgtttgcagttttttccacgcgtggttggtacgcgtgcattggattaagaggaaatggtcaaccagagactaagctgagctaggtagttggaaagttggaatcattcttagctttggaattggtatactagttgatcctcctcccatcctaaattattgggcgccccatttttttttaaaatcaaagtcggtaatttttaactaatgatcatactaaccacatctataataagtattatatatgttatatcactagatttatattttgaagcacttacatatgatgttaatttcatattcatcggaaactttacatagaataaattaaaagtcaaagtatgctgctcatctctacaaatggattcatgcaatccatactgaaaccaaaccttatgtttcatacagacttttcgaagtcttgaaatgtgatgtcgatgcttcgccgatgcgatccatcggcagagttttttcccatatgttcttttacgtgccaacgcatcattttaacttgagctttgtacctaaagaaatgcctcagccgtgatattatagggaaatatcgcattaccttagcagaaactctcgtcttggaaggttatccgtcaacatcaccggagtcatctcgtctaatcttatattgtaacgccatacaaactgggcatgtttctaagttctcgtaatcctcaccacaatagaggatataatcgttcgaatatgcgtgtatctgatctgtacttcaagtcctagagggcagactacctgttagcttcgtacgttgtttcgggccatttatttccctccggaagaatattctttatgagtttcaataactcacaaaatgccttgtcagtcacaccatttttttgccttccattgtaagaattccagcgtattacctaactttttatgccctgttcacagcctgggtacaagaacattttgtggtccgttaacatacgctcaaatttcgtgacctccttttcactttcgtagtccttctttgcgtcgtacaacatccgacaaaaatcatctgcactgtcattttctgcaacaggcccgcctgtcgcgcctgttgtattttcttcaaattcaccgaattgagcctaatctggaatgttgttatctttttcttcattttcaaccattggaaactgtcaaggttacgggtagggtataccctctacccttcgatatacgtcacgtatcgatatggtatgctcacgagtatacggacgtgttcgtcatacgttaaggaaattcatcatggagttcacaggtagaaggagtcctattcggtcaaaactgggtcgtcattgtgtcatgttcggtccggcttctccgagtcctacttggagacagttgacctgcgatataaaagggacccctcggaaggacctaaggcatcgaatctcagagccaacacatccaccacagcctacgaagccgaagcttgtcagagccaagtcgccgggagatctagtcgaatcaactcgactacgatctcgtcggtatcatcgagttctgctattccctttgtaatctgtggtttccaccatataatcccatatcaactagattagggctattacctgccaaggggcctgaaccagtataatccctgtttcctgtttgcttgatgtcgtactacgtagatcctcgtaccagcgtaccccaataccctctatattcggtctacgggtatcccccgtcgacagtggcgtgccaggtagggggacttggtgctcaaggttctactactatgacatccagtttcaccgacaacagcgttaacaccaatctcaaccaaggagttcctacttcaacaacactggtgtggactcaagtcggcgaaatcgtctttccggtttacaccatagtgctgatctcagctggtccgccaatggccggaaacgagaacgcagtggctagaacccggggtgactccatgtcgaagaatccagccgccgaagcggagatcggaacgtcgacaacatccgagcccgagaaggatcctagtgcggccaagccttgtctttccaacaggaatcacgagccgatgaggattacttccgaggtgacaaggtcctggtgtcctatccacaaaactaggaaacacaccctgcaagcctggtgggtctttctcaacgttcatgctgaaattcgtgcctgcaaagagtgtggaattcaacatacctctccaactcgtgatgtccattgtcctattcacaagacaaaaaatcacgacctctcgagttgcaaggtctttctcagcgccatgaagacaccacctcctaaggtccagcagtcacgcatccccatcagggatgaagacaaggaacaaggagcgacgccgattttagatcgatttgttggggtaatcgacatcgatccccacgaaccatcagtcttgcacttgctcgaagactatggatcatcgacaacgagtacgccgcgtgaggtattggctattgacgatgtcggcacgtcagtgcgcaccaatgcggaagcggagaatcaagtgactgctccgacccagcacatcagagccatcaacgcaatactgagggaaaccccctacgatcccattctgaacgacgatcaagcacgttggatagaacgactacaggaatcagtgaccaacctcagcaacgtgttcgaagaggccgctaccgcagcacacccagaacagccaccaactggcgatgctaatggtgaaaaccctgaacggcgggaatcgcctcatcgagccacccctccacctcgcggcacctgcgatctcctcgatcacctgaatggccgccgagaggcacgacacacacgagacaacgagaaccgttcccggcatcatgtctcttcacgggccattcaagcgaagatcgaggaggccattcaagcgaagaccgagaccgtgataaccaccataaccacgatgatcgcgaacggcggtgctgggcgatactggtcgaggacatcgccataataacgacgatgatggagatcggcgccgagacaataacgggagacgacgacaggattctcgagaacccggctgacgtcctcataatcgtacgccggaaccaagcgacccatcatcatcgtcatcatcctcgtcatcttcatcatcagatagacatccacgaaggacttatgatcgccgacaacccaccgccccagcgctaggtgtagagctttcagtcgttcacttcgggatgtccgatggctactcagagattattcgaaattgtcgatcgatgcgctcatgcggatgacgcactgaacgacaaaccgaagaccggagaagagaagaaaccagccaaggacgcacctgagtcaagcaagaagaaaaatcgcaagagtgggaaaaggaaagctcaatcggaagttctcgcaacagaatatgcggaccctcccaagcgcccagacccacaaggcagcgacacgaataaagcatggtgccccatacacaagtcggacatacattctctagaagattgcctcgttttcaaaaagtcgctcgcaaaacacatggcatcggaaaaaggcaaacgagtacacgtggttgagaaggacgctgaggcgcctactcaggaatcggactcagcatacccagattccgatcttcatgtctcacacatcttcggaggttccacggcatactcctcaaagcgagaatacaagaaagtggagcgtgaagtctgttcgacgtggcagggggctacgccaaagatgaagtggtccgagcagaagatagaattctcggaagaggaccaccccaagattgctgtcatcccagggcgatatccgatcatggtcgaacccactattcgtaatatcaaggtcgcacgagtcctgatcgacggcggcagctgaatcaaccttctcttcaccagtgccttggacgcgatggggatcccacgaagcgagttgacacccactgatcaacccttccatggaattactcctcagtcattgtccaaatcattgggcaaaattacgttgcctgtgactttcggccaagcaaatagcttccgaacggaacagatcacctttgatgtcactgaattcgatacagcatataatgccatcattgggagaactgcactcgcgaagttcatggccgcatctcactacgcgtatcaagtgctcaagatgccaggaccgaagggaacaatcactattcaagggaacgctaagctggcagtacaatgcgacaagcggagcctcgacatggtcgagcacacgcctagcccacccgccacagctgaatcacccaagaaagtgagcaaaacaaacaagacgccgaagccggacggcgcaatcaagatcgttccactctccagtgccaaccccgacaagaccgtcaagatcggggcatcactaggcgagaaataggaactcgcactcatcaccttcctccgcgacaatgctgacgtgttcgcttggcagccgtctgacatgccgggggtacccaaggaggtgattgagcacaaactcatggtgcgacccgatgcaaagccagtaaagcaaaaactgcggagatttgcaccagatcgaaaacaagccatacgagaagagctcga

SEQ ID NO: 75258 - DNA, 2028 bp, Oryza sativa
tgcgtacttgatggaggttgtgcaaacttcttgttctgttactcagatgattaatctagtcttgcactcttgcatgcttaggatgctctcagggtatgccttgattggcaccatttgcttcagtgcttcacattgtcgaaaataacgaatactggttgtccactccacatagaggttttaacgatgataatgcatatagtgtctttgatcattttatcgaggattaaactattcgatgatgcagatatattaactacagtcaaaattgaatattctattaaaataattagtctcctaaactacacctaacattgatattgatcaaattacggttttgggcataagttttaaattattgtgaactatctataaattgtggtcacatagaccaaaacactagctttcaagtttacactaatggcctggaattggtgtaatggtgtgcacaagcatacaatatcttttgtgaatctctctgctcaaacattaaaaatccgcaggagtatttgcaaggaaatccaatgtggatggagtactgcaaggtacccctggtgaccctagggttcgagaacagctacgacgtcttcgtcaaagttcacgggggtggtctctcgggccaagcccaggccatttgcctcggcgtcgcccgtgcactggtgaagatcagcaccgcaaacaaagttactctgaggggagaaggtttgctgacaagagacacccgtatagttgaaaggaagaaggctggtcttaagaaggcacgcaagcgcccgcagttctcaaagcgttagagtatgcacaaccttgttgttagactcatttaaaagttttacattccacagtttgtattggcccttctctgttattttctgtgcaaattatgtgctcctcaccacagacttgtaatcttcgttctctgtaagcaattttattgaggtcacaaaaggcaattatcttgaaatcattcctgatatctgatgagaacagctgctcaactttacatcctcatatagtcacataagacaattataaaggtcttgaattctgaatgcagagtaggagtattttttatacttctttttagccaattaccatgttggaaatgcctttttgtagggaaactagatagaaaatggcggctctaccataaagatcaaatgcaaatatgcacaattctgtcaagcatgctctatcttgtccatctgtgaagttgtctcgaattgtttcaaatccaaaaagaaccataaattttgcttcctcctctcaagtcgtaagtcgtaaatggtaactgcatccgtgtcgccgaagctataaaagcgatcggaaataatcagaaacgttttccttttgttttcataaaaagggggtaaacgtatttaaaaaattcatacttataaaattaactatttagtgttaacttcaacgtgaatggtaaaactttctaaaataaaatcttatatgcgcgaatgagaggtgtataagtgttactccctccgttttaggttataagatgaattccttcaaattgaccaagtttatagaaaaactagtaatattttcgatccaagataaatttattataaaactatgattaattattaatttaataaaattaatttggtaatgtaaatattattatatttgtctataaactttattaaacttggagcagtttgactttaatcaaaatcaaaacatcttataacctgaaacgaagggagtatttatcaagagagttgttgattatgtttagccatgtggctttaaagtggggtctaagaataagtttaaactaaaatgataaattgaacaactaatatgaacatattaaaacgtataaactgagccactttagatattcaaaaaaaaatccgttgcttttttcacccctactcaaaacgacagatccgtacaaagcccgaccgagccattccgactcgcgctgggcgaaaccggttagccccagccgctcgagcccaccaccggaggcggcccgtctggttctccccggagccccgagctccgctccgt

SEQ ID NO: 75259 - DNA, 530 bp, Oryza sativa
ccccccccccccccccaccccaattaggcccattggacttgtttttgtgtaaatgggagtgggaccatgaccttgaaaccctaatccctatttccccaattctccaatccgagcacctagtcaaatcggtgaaattcaacggcgtcacggcgctgaggggagcgggcgcgccggcgtgcggcggcgcggcgggcttgctcgcggtcgcggagggaagcggcagccggcagccgtgcggtgtggcggcggcgctgccgcgcagggcggcctcgaggaggggagcgggctaacggccgccggtagcccgcaggcggcagggtgggtgcggcggggcggtgccaggcagaggcaggctgcaggcaggccgagcaaacaacaaaagaaagagaaggattcaactgaagaaatcaacacaaaatggatagaaagagaaaaggaaaggcattggcttcacaaaagaggtacatattcttgaatttttgacaatttcagaacattgagagagatatattcaaaggacttgattttca

SEQ ID NO: 75260 - DNA, 2943 bp, Oryza sativa
catggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgttgtttttggtgaattatcagtgtgcagatgaatttcatccactgctattgaagaagcttttagagggatatcttgtcttgtcggactaagagctcttatctctttcttttcccacggtaactagagattgaataatagaagcctgattcaataatagaagccagattcaatatcataagaaaatagagattgtagcgtagagtcaggctatcccatgtttgcaataacagctttgggatctttcctgttaatgatgaatagcttgcctcaacagagaatcagaattctttttattcggtataacaaccttaaaaacgaatcgatctagatgccccgctcttgccatctttgatggaattgaatcatcaactgacttacttgaggaataaaaaaatctgcagcacgggtccaataatttgatcgatacgccctgtacttttttcttcaattgtagaaaccccgggatgagaagtagtaggattggttctcataattaaaaaaaaaggaatttatagaaatttttcttttattcttgttgaataatgccaaatcaacaccaaaaaaatatccaaaaatccaacaaaagtcaaaaggaaatgaattagttaattcattattcaatgaataatttcgatacctctgagtgcatttagacttgatttcgttcaatgaaagcgaactagcgggcagaattcctctgagtgcaattcccaagcaaggtcacccacttaagtatggtaccgcgcttccctgtacatatagaatccttcctttgcctgaaacaattccaccaaccaaatcaagccagccgggtatcctaggagacaggggaaaaagcactttacaaatcactcgctgggtcgggggatgcttataagaaatcagtagctggggttgtgcttgttgttcattccttcactctggaagtacgcactcattatagcaaaacaacccactaaactccctgctgttcactccattccctactagattatttgagacagtagctgtgaactactcccctccctctttgagagggacgaaaagactctttccattcttcaagctactaacttccactaatacattcaagcacgaagtttcctccaactattggtaatagttgcatcgagatattcgtagagactagctatagactttgtgagtcagtgtgctcattaattacccaattaattcaccaggacagtaaggatggagctgctcattccacgattgacaaagctagaacgagctctctcttacttagaaagagtctcacatacctggtagaagtgtgcattttacctatacccatacctcttctatctatgctccaagcatgatagcaattgcattaagctattggtgcttctttctcacccggcccgagatgggtgttgaaggcacgtgtagtttaacaacttccttacgttgacgcatatcatcatggggaatcgagtgagttcttcggatcgacggacaagaggaccttttcattcatctcacctatcctacgcagatttataatctaattaaagaaaagaaactcttgcttttagaaatgaatttcacatttctctacgcaagccaaggaatctgtctacaactggtacttcacatgccttagaagtagatttgaatgagaatgaatgaaatgagtaaacgttactaggaaggtgaactcgctatcaaactacagcctgcgctagtggctcaatccgttgcttgttgggttgaacatattctttttctttgacggatagcttctcggctcttgcctggcctggagttgaagaaggaactggtagcacttgaatcagaggaagatcggaatagcagacgagttgcagcttttagtattgttcacagcttggatgcctttatgccaattttcccgtgtttatggaaagcccgtctttttggcagaatatagccccactaggttcttttgttctcgaataagcagctctagaagctctcgcatgcgttagactgactacgccttctatctttctttgtattttattctaagcgtggtaaggatattgaattaatggcatggaacatatttgctagcccctatagttggatgttgctcctatctagcgagaggggtggcataggagccgtctataggtccccaaacgaggcggcaccaaggagagaccagagacaaccctgctagtgaatggactacataaccatcgagaccggtgaaagaaaaaaaattgaaaaccctagtgttccgctcttttcaaagttgccaggaaactaagagaaccggagaatcaaaacctgtgaagatgcacaagcaggtaagcctagccggagtaaatattactgtactacacgggaaaaatgcgatcaacttgagtgcaatgagatatttctccttcggtctttcaaaaactgagatatttttttccctttgatccctccaattaatacacagcgaatttcactttccatctcacaccaaaaccacggtcgcaaactgaccacggcaca

SEQ ID NO: 75261 - DNA, 6461 bp, Oryza sativa
cagttgcagataggcccaaaaggctagcgcattttgttggtgtgcgtagccaacccgcgcgcgcgcgcgtctccggtccggggagcgaggcgtacgtacgtacgtggggcgcggagtggccgcgcgcgccgttgctgcccctcgtcacgggggtagggggacgcgcggacaagcctcggcagcggggagccggacgcggagatcacgtggcggcatgggcgtcctaaggctttttgacgtatagtagaggaggtagcctgtgccattgatggatgagagtacgtaggagtactttgctaaagtagtagtagctgggttcagcgaacgctgcgcggtttcgtttctgtgcgtggattcgtcaccgtcggttacgcataggacaagctgcgtccaaggaatagaatagagtggtggagtcactctcttagctcgatcgctaacatatggattcataaattggcgtggctgcatatggaacgcagctagcaagcgtacagacttatatggaagccagcatatattagtagtatcaaacagatggatcgcgccgattgcccatgcatcatgcatgtaactcaagcgactggctagcttatccataggtctgccgcaaactcatgcacatatggtccgtggaacagaaatacagatcaggccagtccaaactccaaagttcaaagtccaaacatggggggtgtccggttggggagcaaaaactcgcgtcaagaaggacgccaaaaaaaggcgcggcacgcaccggcaccattttccaggcccatgcatgcatgcatgatgcaccgatgcgcgcagtcacgcactagacggtcgatcaatccgtgcagagcgccagagataacgtacttaaattatcccggtacaaacgactaaacgagtaaacgacgaatactaccctacgacgcccaggccacggagtgtacagaccgccaccggcgtccgcattcggtttttggctagcactcgcagcagaggcccgggttgttgggtcactgcgcgcgtggcgccgtgcatgcgcgcgacgaaacgatcggtggtgatcgacccatcatctgccttgtcccaaccgggcgccggccacgtacgtatatacgcccccaccccgttggcgcacgacgcacgcgcacatgccgcccggcacgcagggccgcggtgcccggctcgcggggcgccacccgcgccgcacgactgcccacccggtcccttcccctgccggccggcccaaccaatcccccgtgcccgcgcgcaccaaaccgaccatcccgacggcgaatcgcgtggtgtgtcgcgcgcgcgcgcggctagctctcggacgatcgcgctcgcggagtcgcgggggttcggccagtttccgcgaacgttcgctcggcggagggcggagagtagatcctgtccaccgttgcgtggaccggaggcgggccgcgggggaggcaggcggaatcttggggcggccagtcggcacgcacgtctcaacgtggcccagatgcgatccgggggggaggactagtttactcgcggccgtacggtgccgcacctgtacgcttgtactcctacgtgactgaacgaccaggaaacggaatgtgttgttggcctttggttctgaggagagaacggccggggaagctgcagagatcgagtcgatttggatcgccgacgcccgttgatccgtagagaacgatcggttgaaattggtagaggaagaagcacggaaattacaacagcacatgtacagctagaggagagtaggagacagggttttttttcttggttgacccttcatacaaatgccgtgcaaaatattcacaaaacccaaccctgcatcaagctagagtatttaaaccgttcccgtccaatgctcaatacgactatgtacatatttctcgtacaaatcacattgaaaaaaacaaatctagaattgaatgtggcacattctaatataatgaatatagatagagatatattcaaattcgtagtattatgatgtgtcacatataacactaatttgattttttatgggactggagagagcaggtaatactccagtattggtcaagttcctttctgtactgaggtgtacacttggaactaacagactggctgcctgcctgcatgcgaacaaggaactagcaagccgctccgctagctagttgcaaacgattttggactactcattggattgcgtctgctctgttttcatgatgtttgagaggccacttgcgttctcagatgcggccaaattcggttgctctcgtgaacgctcgtaccgttgtccgccaggtgctcgccggccggccggcctccattaactctgaactgacctgtgccccctctcgccctggtcacaaacgtgttgcacagttgcacgcaataatgtccaaaatgcatcattgcacacacaaacatttcgcaaaagaacatacagtagtttacatcactgtaaacatgttcgtaagctcttgcaaagagtcaacaaaaatctgtcatccatgatctgacaagcacccgatctagaaaataagcttgggcaagtacacagccctaaacatcatcatcattgtactactagttaacgtgcaaccaaaccgaagttgtgaactgcagtagtactgtagtagttatccagctaaagcaggctgtggtgcgtgcaaaccagtcaatccaacccctagattttggatgcatcgaaccgtccaagaacgagacagtctggtcccaggggcagcaacatgcaaccatttgttcttgttgcattgcaaaaccgaattcaattataatcgcttttcttgcagaattcatagcacaggctggaaaaggccggccagattgggaggcagccgtgacacatagattcagagaatgcctctcgaccagaaaggagaaccacgtgttgtattccctgaattccgatctgatcctgtcgtaacatggcgctcataatgcgttcgtaagttccagttgcaatggcactcgagtagacaggaagcatttttggccctagcagggtgtatttgccgggaaccagcatgagccaataattagtagggatggataaactgaacaagaaggttggccgactctgccttttagttttagtgtgattactgattaggttggtgattctcgaatcatttttatgtgttaaatatcagtagtatatcctgaaaaatgatggtgagcattagactatatgaagcacagagatttcactttatacctacaatatatatgcatcctttaaagtacatcatagaatatgctgtccatttttctgaacacgtttcaagattaaaagaaacaagaagctccgggcctagggaaccatgaagtaacccactattttttttagtgaatatcgaattctaaatttagaagtgtaatcagggtaagcttatgcctcatcctggttgggaaggttatggtagtttcagtcattggaattactctgttcctatatatatagtccttatcctttttgttattgcgttatgatagagggaaagagaaaagaaataatagaaattgggccatgtttcccgagagaggctgccttctctcaggtcagcagttttataattatagttgactgctcaatgacgatctgaccgctctactcactcgtctacgctccgaccattcagtcaaaatcgaaaaaaaaaaatgtttccttgaaaaagtctaagaaatagtagtagtagtcaagaagtgcacttttcgatttatagggatccctatctttatctctatccacgatgcctatcttctgttttatattgatagaaggttgctgaacagagaacatgcacggatcgatccaccagaagaagaatctggcccgtgcgtaggtctaatacaggcccatgcagatgattactatagatgggccacttagcgcgaagaaccgaaggcctgatgttttgggcctatatggcccttcagcaaatttggcccatgaaatctagatattttattccaccaggagtcatgcaaagagatccctggagtagtttggattgctaccaattgtaggctgtagcgatcaggattttttatattttagccctcgtgtttctctccctcccctactgcctctcttccgccggcggcgagccggcgacggctcacggctgccttccgcggcgtcgccgaacggcagtcttatcgccgtgccgcttctctgaatctccgcccatcacctcctttccttaagcgggaagcactacgtctccgagtagagggcgcggggaagcgcccatggtcgccacgccgtcgcggtctccatcggccacggcaatgaacgttgctgctatggccaccggagcctggtactgaagcgcaccattgaactgacgaggtgatccgtgatcagcgcctcaagagccttccctggtttggcggatgaatctctggcgggtgcattctgggcccgcaacttgctcgacgaaatgccgaccacgtgtttcattcctctgtggctctgtctgacgcaacatggttaccaagatcaagccgttggcaccaattagagccgaaatgatcgaggtaatatttcagtttctttgccaggttcatcgtgactttatttctaatcaatttagaagactagatcagattaacatagatggacaagaactgcattgtggatttgtggtaggttcagaaattgatgatcatgtattcatgtggagtgtaacttcaccactcttcattcagacccacaatgactaaaattacaaaataaatagactttccaagctatagtgctatgcacatacggtatccaaatccatgactgattgtggagtcatactggagttagggcgtaatccagaatcagcaatcagcagtggtcaccgggaggcgatgaaccagaggttgaagagtgaggaagcggccgttaggaaccaggacaagaaagccatcatcgccgacagctgatacctcccacagaatctgggagagcagtgagatccatggaattggagcagaagatcgatgaccgccgcacttgagctggcagctgctagtgaaagtattgccaggacctgaaaaagattgcacgcaaagttcttgatctctatctgatttttacaagagagggtgaaatataaagcttaatgagaaccacaaggagatgtgctctttctacatacccagtctccgatgacgacaatgaccatgacacctggtacccgaagagggcaccctacaagtatggagtacacgtcgatcatggcgagtgtacagctccaggggatcaccaagcccattattgtaactaggaagctaccaagtttacaacaaattcagcataagtaactagaggacatgaagagtttcaagggatggagcctgcagcagtagcattgagcagagtgggttgaatttggttgtgctgccaatttgattgcagaggtatgtaaggagttaaggacaaatttgcatcataaaaccagatggctgatcagctaaacatgtctagtgatcactggggatatggcttaaacctctagaactatggccatgcagtccatgtctgaacaaaagtaggagaaatccaaacggtggcacgctcaggcgagcacttaccagaaggcagtatagctgaagaactcgacgccgacggacatgaacagcagggacgccgacgagaagacggcctgcccgacgcggaggccgaggctgccggcgctcccgacggcgccggcccccgccctctcccggttctccatcccccggcggcgccttcacaccgccggctcatgacatccttgcttcctcggcgagtccaccgtcgccgccggccagctctgcgtggaattcttggccggtgcaacggagatgctgagtgaggctagaggaagacgaagacgaaaaggcagggaaaaaaaaagagggggacaagatgaaaaggccggggctttgggtggatggatacggtggcacgggaggtggagctgattcttgattcttcgtttcttccctttcctctcgagagctctccttcctctctttctcgtcgctgcttgtcatggttactgcttttgacttcgagtaattctcctcctcacgtcgctgtctccacctggatcagaacagattcttccttttgttttgtgcagagcccgactcggagtggcactctagcagctgaaatggcacgatctaattgcactcttgtacgctgaccacgacatctggggagctaccaagcttggcacgtaacgtaaccgtgtgcatttcgactttccggtaatctttttctctattcagtttgatcgatcgtgttcactgattgcagctgcgataatccaatggacaattgattctctcctcttctcttctggcgtgttgcatacgagtggttttggatgatcactgttccacttataggatcgaatcataagaactaagccatcagagggggggtgaatggttggtatacccaa

SEQ ID NO: 75262 - DNA, 698 bp, Oryza sativa
cccattggcagagagcgaccgaagtttccagtaaaaagcagtgcggatgccacacaaaatggtcgaacacatgttgaagaagatgatggtactggtactatcaaggttgagagggctacaagggatgtagtctctccttcaaggtgaatttagaaaataacttgtaagcgttatcgtgtttgtcttcctgtgccttattattattatttttttgggattctattttagtcaaggaactgttaggaaagctgctggctggaatcttccagacagatcagagggcacaggaactgttcgaggtggtttaaagccatcacaagtcacctccaccaaggatagtagatccgatgcttctcatagtccaaacacaccaaaacgtacagctgatcgagaaaatcaatggagaacatcatggacggggtctgaagagtcgatctcaacaaacccgtcgcagagagatgcacaaagtgaatatggaagactagagagttctacagaagatgtaagaccttttttagatatgctatttgtctaattgttagtgttgtttctaactaatggttatcttccagaatgaccaatctataagtgggtctggaactgttgtactgcgctcgccaagagcatctcaggtgtaccctgcagctactaaccacagttccaaggtgtgttttagattcctaatatgaatgtcatag

SEQ ID NO: 75263 - DNA, 16765 bp, Oryza sativa
ttggtttgaataaatactttttggtcttgacaaagaaaaataattttagcttcttttcagggccagaagattcagatagaggcaagctgtttaacatgccagaataaaatagtaaacacaaacaggaacagaacatagaaataatgagaattgcttatgtacaattaattaacaggaggtgttcaattgtacataattattcgagagtattattcaaacaaaattgcatagaatctggcaaaaacattaaacttctcatacatgcaaccagatatgacttgcttattaattttttttcacgtgtcaatattcaccacacatccgctcctgcctaacagacatcggacaccgatacctctcaccatatctcgcaggcccacagcgctgggtaagtgtcaatgttggctgtgccaaggccattcgatgataacaatgcatgggccaagacgttataggaagcagttgatctgcctgcatcatcagcgcagaggcaagggatgcagcgaaactgggcaaaccaacagcgtgctggcggttctggtcttggtgggggacaacaccagatcaactcaactcttttttaagacacgtcatggaactgcctaaaatcaaaaacccaagtacagaggcctctagtggtcgccggtggcgaggtacgccatcatggttgacagatttggtggtggaattgttgtacgtgagcaggagggaagtagatatagaagattggaacgagatatgttcggtggggaaggagtaactacactatacttcgctcctttgttctttttttttttactttattcgagtaattagggtattgtaataaggaataataatatattgacatgtggttagaggagtgcatggcaggcgggcagcaagggatcctttgtgaatgaaactcatggtgtgaactcaatattgggcataaatgtaattcttgatcagttgaggaatcctgtttttagctttgttaagtctagcaaaggctaccgaaaaatactatcttcaactcacaaaaaggtttgctgatggttcacctacaggcgcaggcagacaaccaaggattgccggctggcagatcaaccagtgcttttaattgaaacaacacagctcgaaactaagggtaggtttatatcttattatcagttcgcatcacatatccagcacaaattggcccagcaatgccatagctcaaagaaactaagcacaacatttggctttgtagcctagcatgcatcaactgtcacacagaagtgccttatgtccttcaagctgggcaagctttcctgggcagttataggcaagctttcccacagaagtaagatttttattgtcgttagcaaactgctgtccttgctaagctaggataagatttctcttgcctaggatccaaacataccctaaaagatgtatgcttgaacttagttctagtaccacaaactagcacatcatgggcagatatagatacagcaagataagaggtgtcatgtggcatgcatgaaccgatgacaaagaactaagcacctattatttttctcgtgcaatgaaaatattgcatgctaattctaaaattcatttttttcagaaaaagaaaaaataggaacaggaacaggaacaggaacaatcaagtaaagctatgagagaaagcaatctctttttttcttgctcagcaccactccctccaccccaatatatagggtgtacctgtattttactcaaatcccacaatataagacggcatctcctcgacagccgtttattcgcatgcaagcatttaagttttgctcgtttccattcatatgcatgcaagcattcaagacatcacctcctcggcttccgtttacaagcatgcattattgctgattagtttgcttagggcacccacaatggttatctataggctctctataagagatccatgtcagcatattttcctacttagaagagattaaatgaagagagagagcaaagctatctactaacctggagatagtctatagagaaaaacgaggcaatgtattagagagctatagatacccatgtagacatactattgagatggtttactattattctagtctattgctgagatgtacatgttttatagatagcaccttactttaccattgcgggtgctcttagagcaagtttaatagtatagccaactactagctccaaatcatctatagtcaatttaatagccaattcgtacaatagttacatactacactattaatatatggtcctacttgtcatacacactgcgtcttggagtccgtgctacagctggctacaaatctgtagctcgctgctcttctctctcctcttttatctccttaaaatatgtttatagctggcttatagcctgctattgtacctgctcttagttaaaaggcctctctctcccagcaatacgtgggcgtggcctgctgggatacacactgtgaagatcaaggtccacggatgaagcaaaacttcacgtatcggggcgaacggaacagttgaaaatccttggtctgtgcgtctagagcaggtacgccctatataatgggatggagggagtatatgcttacggtgtaaacttgatttattctatggtaggtaggtaactaccaagataccttcatttccatttttatggtgatacatgtgtaataatatggaggctttacaaaaaacatggaggcacttaaatgtggacagtaacagaagcaattaatggctataactcacaacaaaaagatcagtttccacttttggtttctatttttgatgcaccaacaaccgttagctagggtgagcatccatacatacagaattaatctcgattaacctagcagctagagagcagagcagagagacacacatcagcataacactagcaaatatcgtgagttcgcgaccaaaccctagaagccccaatttatccccccctaaccctacaagtcccgattcccctttggaagtctgtgggcgaggagggattcgaacccccgacaccgtggtctcgtagccacgtgctctaatcctctgagctacaggcccgccggaaatctccaccggatctctacccgtggaagacgaagctcgataagcaatccccataaactcacctacgcagtaccaatcgcaataatcccaaccccaatcgacgaaaccgtttcatgataaggcgacctgttcgctcgaaaccctagaaattgaatcagacccccccccccccaaccccactccacgaaaccaccaccacaccgaaattgcctagcggaacgaggacaaggaaacgagtagcgaaccaacctgatggcagcctcagcgccaccccgggatacggcggccgggctgtacggacccccaccctccccgcgcaaaatccctctcgcttcggggttaggaggcagatcgagacggaggagagacctcaggacctcaagccctacctccgccgcgcgccgccgccgccgccgcagccgcgcttcccccttctcttcgccggcgagagaggcggtggtggtggtggggaaggggaaaaaaaaaagaggagtgcgtggttgtggtggctagggttttaacgcgacggggtcggaactcggaagaggaaagaggaagcccttgacccggtccggctcgaaccgtctggctggctggctccgcggggtgctcgggacgctgacgcgcggggcccacatgggggttgcgggggagaggtgtggggcccacctggcagagggagggtggggggcgcactcgataagcttttctctctctctttctttctttcttccttcccctcccgaagattttgctcgctttctccaacctctcctccgctccgaagcggaggtcggcggcggtggcggcggcggcggcgcgtttccccggcgagtaaggtgaccggctgctcctcccgcacttcctacgcctcgttccgtcgctacagtagcggaggagggcctgcaatctcagatcaggggtacctgtaacccgtttcggttcttggtgggtgggttggtggtggtggttcttgatccatccatccagcggttttggtgcatctgtgcgagttccatggtctaggttttttttttcttttagcatttcgtagtacgtggcccgtggtagatggcttgggggagtgcaatgaaatgctgtgggaaattagcgtgcgtttagcacatagcatctgttcttagtactgttttttttctggatatgttgtggccttgagggtatagattgttgttaatttcgatcactgaatgtgtggcagcgattaatagagtgccatgggataaactttcatggaagtagagtggttcctttttttttctcttttcattgtgctggagcatcatgatggggctaagatcggatgtttttctggttgtggttatgcttgaatgtgcgggtcttctcttggtttttcaatggtctgaaaatgtgggctttgtgctggactgtttgagattttgtgtgctatctttacacggtgatttttcataaggctgaagctgtaaagccgaatgtcgattcttatgatcggcaatataatttatagggtgcactagatctaggagagatggagacaattgtttatactggttcagaccctcgacgtgagataataccctagtccagatgagtggattagatctgtattggagtgcgcagcacggcgtaggaatagcacgtggcgcttatggaagaatgagggtttcccggtgctccttatataggtgcggaggcaaccggctagatatggtagtgtagccttcataatccgggtacctaccatctatttacaagggataggattggccaacttatcccttatctctttcttagtttacaagttaaccatgtgggcctagggcactcggcccacctcatgccgcatggcccaaaacgccttgctatgggtatctgggtaccatgtaccccacactgaactgaactgaaatccatacacacttaataacaactggagctatttttttaaagtgtatcctggaacatttattgaaaataaatagttagaatatttttttctaatttatttgctggatagctagacagatattaggatgagaagggattagcattggtagatctcaactatcaattacttaggggtaaaattcataagccaatgactctgtcaaaacctctctgccactgtttacatttcttaataaaataataagagtacaatactgaagaatgtaaaaaggaaacactagaaatggatgatatttgtttttcctgctttcctttttttacccctttccttgtgttaagcgatcgaccttactatatactcttgcattttgtcattattacatggaaatatcaccataatgtagtatgatttagtgcatggcttcctattttactacatgatcttcatttgccgacagttgaggtacatagaactgccctcacatgctattttttcaagcatcacggcatcccccttttttctttgatgtgagcatcacgacattcttatccaccagactaccactagcatttatttactattagaacaggctgaacagaagccaccatattctctatcaagggctagaaattacaacgttatcaaataaaaggagaaatatcgtcactgttcatcaggatgagctcagattataatggtgaagatttattggatatattttagagctttctttactatacctgtatgaaagttacaattgtgtttctagaaataaacctaagagttatatagcaaatgcatttctactttcaatagactataatctagccctgcaaattgcatgaagaatccggctatctctttattacaagagatactgcacacttttgtgtggttagttcttatatccagctattagattggcagtaagcagaaaaataattcaacagactacctgaattcgtttgctcttgactctctttgtgctgacaactatcattatcttagcaaaatatagtaaaaaattgaacttgtcaaaataattggtcataaatggtgtgcgtgaatttacttatcatcagctatcactgatatcgtaaacaagtatgagagagcacttttttgtttttgcttcattatttatggactttgttgttctggttgtgttgatagttccttttttacacactgttttattaagtattatccacacaagttacaactgccctttttctttttttccttttttgtttaacaatggaccaagcatcatagaacaattaccttattgtccctcttatgttttccaggagaaatggaccttgcatctcaaggtgtggtaacacaacaacaaaaaccaagtggacggagaccggttggaagctcacaaatctggacggtatgtagctgcttctccctttgttttcacttggccatcgtgaacaaaattacatgcagacactcaattttccacagcgatatggtgttctgcttcccagccagcagacacggaagctaaaagaatgggttctaactgacgaacagcaacaactagttaatgctagtggtcttggacatcttgccctcaccacaggatttactattgatcgttctttgcttacagccttttgtgagagatggaacaatgaaacaaatactgcacatttcatgggatttgaaatggccccatcactccgtgatgtttcatatattcttggaattccagtgactggtcatgtggtgactgctgagccaattggtgatgaagctgtgaggcggatgtgtttgcatttcttaggagagagccctggaaatggagagcaactgtgtggcttaatcagattgacatggttgtacaggaaatttcatcaattgccagaaaatccaactatcaacgagattgcttacagcacccgggcataccttctttaccttgttggctccaccttatttcctgacacgatgaggggatttgtatcaccaagatatttacctcttctggctgattttagaaagatacgtgaatatgcctggggatctgcagcccttgctcatttgtacagaggactatctgttgctgtaacaccgaatgctactacccagtttctcggcagtgcaactttgctcatggtactgttcttgtttgaataaatttgaatgattgtcgatgatatttggtatctttgttaatgagatttattttgttctctcaaggcttggatttatgaatatcttccattaactcaaccccaacaaaagaatcagaacaccttgctgccccgggcctgtcgatggaactttggaggagcaacgcgtggacagagaaagaaagtcatggaatggagaaaagttttcgatgagcttcaattttctgatgcaagtgcaagtctacctattttatagatttataacaaagattttaactgctgttgtgttattttatattaattaattatattttcaggtcaactggaatccttacaaggacatgaatcctgcaattattccagaatattgcattgcagcagataacatctgctattctcggacatggctaatcagctttaacataaaagaggtgtatgtacctgatcggttttctaggcagtttgggagggaacaaggtcgcctccatggggtgcccatgtgggcaagaagaacttggagcaagtggaaggactggagggttgagtatgctcgtgaaatcgaggagttccatcaattggttggctgtcgtttcactcctgcagaaaccaatatcaactccctcccaattgagtctataactaaacaagatgctgcaggatgtagtcggagcacatctcagaacttctcttcaatggtaagctacaaataagaagctaatccttcatatgtttttgcttgcatagtggtccttattgtaattgctgtttgtgagatgcaggttgaagatctgaggaatgattttccagtaattgatcgttacctggagggacagttactccctgtggaagttgcaagctttctagagagagtgggtatgatgatcaagagttactccccaccacagagtagccgaaagaaagatcaagcagggcagggccaggacagcaatgtcaggtcaaagaacccaagaaagagggggaagccgtcattctttcaagatccttcaagccctccgaactcaagggcggaccgattcccagccgtgctgataccttatcaggatagcaagtgcgacatggttctggatggcaccgtccctctgctcgatggagcggaggagttcaaggaacaaggggtcatggacctctggcagaactcccacctgacgacgccgtcctgttcctcgctggactcgagctcgccggaatcaaggaagcggaggcagcaagaccgcgacgaaatccggctccccagggacaccgagaacctccgaaggagcgggcgtctctgtgtgcagctgaaaatgttcaagcacagggacggggtgggagccgaggcgaccaacccgatcttcctctgatcatccatggtttatgtacaaagtagcagaaaaacttgggctgctgacagttaactggtttatgtagcgtcgtagactttttgctggtagcgccttgccattcactgcgcagagcttgcaagctttatctccttgttaatactatctctctctagtctctaccatgtagttgggcaaaatgtagatgatgccaccaagacccttttaactgtgttgctcgtgaactggattgtgccctctcccgtttaatctgcagctcttgcaacatggtgaattggtgattttataatgatgctaagctttgactgcttgtagaatgatccaagtagagatgtagagagcctactgtgctatcacatcaattcatcagccttgtacgcttggattgtttgttgcaccagctactcctgctgctgttgatcctaaaaccagcttattgatatgctggcagtgcaccattgaaggctcctatagccatatttggcgaggcagtggctagccgaggacagtgttaccatgtgatcagtgatcattctacatgggaaagctaccagtgatgagagcgccacgtttcgccctagcagcgacctctggcacggggggccccacacgtcagcggtggaggcaaggcaaccacgaaggcaatcgccatcgcctgccctttcattgcccaaccaacgctcgcctgcatagaagaagctcttcgccttctttgctgtgctcttgttgcctctcgctcgctgctgcggctactcattgatcctggttagtttgctctctcttttctatcactctcatcgtgtgatatgatatgccagtatttttttttccttgcatctccttcgttcatggtgaatcccggatcgctttgtttgctcctgcattttggtattctttcatcatttcatccttgtgcttatgactgggaatcgcctgtgtggggtgtgtgtttctgttttcctgctgaatttttcaactgctatggatggtctccagcttctgtgtaagggttccatctcatctatggtcttcagttttttttttctcctttcccctttgttttctgtcccgatttccatatttgtggttgggttttagaggatagcggtcaattttattttgctcttcctagtcagttttagaaggaaatggatggttatcggatgtatttcttcgatattttgttccccctcttttgtgtgatgttttctatgattaaaatggtataccatcttcttgatcaagtgtatactcgttaatttagtgctggtattcttcctcatctgctgcaatattttaagatgatggaaatggctgctgttaggcgcacaaccaacttcatctacgtcatttcgattcaattttcctccagattttgtttctttatttttacagttgattagatgagtagttcagttcctgtttcacaacgtatcttttttgttcaggtaaactttgatggtttcttggctggttgctgctgtccttttgtaccttgtatgtggccaatcctggcattttgctttctccttattctgaagaaaatttaaagcagttgttcctagtgcttttgctctttgtggttgcagttctcttcctcttaagggtagagctcacgtcatctgtttaaaaacttctacagttttttggtgaactttagtgaatcaaacctggtatctacagtttttcccagccttattatcatcatgcctgatatatacagtccttttgattaccaatgtcaaagtttccagattctgtgctagttaattttttcatttccttgaggggaacaaagtctcaattacatgttcagttgctcatataagcaatagaccgctcattgaggacttgttaagttgttatcaaacttatgcaaattcttgccgtacttaacctggatgcttaaactgaaatttctctgcgagcaattcttggattgtatgcacacttaccacataacattccttctcttaatggaaccagatggaatccgcagaggcagaaccaacaaacaaaagcgtcattcaggtaattattatttatcaacaacgagcaagcgacaccaatttgctgaaccttcctttggctcttgtgatatatagtttgtacctaaatcataacattttgatgctcaaacatacagggaacccatgaactaaccgtatgccagacgacggagagactcgacacatggaagctgaatgagcagcagcaacaattggtcgatgcaagcgggctcggcaacctgatacacacagcaggcctagtcatcgatcgcatcgcgctcatggcattcttcgaactgtggagcaaggagaccaacactgctcagctcaatggctttgaaatggcaccctcactcagggacgccgcctacatactggggattccggtgacaggccgtgtggtgacaaccggagctgtgctcaacaagtcggtcgaagacctctgcttccagtatctggggcaagtgcctgattgcagggactgcaggggcagccatgtgaagctctcttggctgcaatccaagtttagccggatcccggaacgccccaccaatgatcagaccatgtatggcaccagggcatatctcctgttcttgattggatcagccttacttccagagagggacaggggctatgtctcaccaaagtatttgccacttctgtcagactttgacaaggtacaggaatatgcttggggtgctgctgctcttgctcatctctacaaggctctctccatcgccgtggcccattctgccagaaaaaggctattcggtagcgcggctttgctcatggtatgtttaacaaaaccattgtataggaaaatatcacttgaatttcgagtaggaaatgatcttccagttctatgaaactatcaaaaaactattttgattgttatgatctgttcatgttttctgaaaaggattaatgaacttcaacatgagaattgtaattgatagtaaggcataaagatgataggaaataacaaaattctccatttttgtttctcacaaaattttaccttacagaccaagtttgtgacttgtgccttcactgtgtccattgcgaaaatgttctgatatattctgaatatctgtctgtagggctggatatatgagtatattccggcattgcgccctgacatgtatgatcctccagaacacatcttcccacgagtactcaagtggacagggagcacgatctctcaaccggccaagaacgtttcagacatcaggaaagccttcggcctgcttcaagtttctgatgtaaaagtctatccatctgagttgtgattctcatcagtcatcaccacagttttgtgttcagcatttcatcctttcccttgccatttgatttgagaccatatgatgatatgaacaacaacttcaggtcaactgggagccctacaagggcgttgatcctgcatccattccgaagcattgcgctgctccggataacctctgcttctccagaacatggctggtcagcttcaacctcaaggaaatctacgccccggaccggttcgctcgccagtttgggcaagaacagcatcgcccgctcaacgatgtccccgcgttccagcggcagctgtggaacccggcagtggactggagcctgatgtacgcttcagagatcgaacggttccagcagctgatcaacgctgcagatggtggtgatcatggtcatacagcagatgccgccgccgccgccgccgcagatgttttcactccggcgaccatggcgcgagcttcccttgggctcagcctgatatccgtggtaaaactacctgtcggtgaaacacttttaatcacttaggtggacatctacccttttgctacatactatcaactaaatggttataaaaaaattaaaaaaaaaataacaaggtagattcatatgtaataatatgttatcctacaaatatgcaagctcaaattttacttatttaaattgtaataaaagtagcaaattaaattttaattagtatagatatattcgcaattaactttgttatcattgttacaacttacagaagtcgaatttgctggcatgtttgttatcaatctatcttgtcattttttttaaaaaaatcatagtcatatagctaacgtataataaacgtgtggacatgcaccgagtgattagattagaatccatctccctaacactcgtgctgaggaagctgtcacattgacgtgagcgtgtcatcgcggttcagttcgggtgattgcatcgtgcgtttcgttgttgtgatcgattggatcggttcatgcaggtggagggcgtcagggaggagctcccgaccgtcgcgcggtttctggagcaacaccgcctccccgccgagctggcgacgtccctgtccaggatccgcggtctcatcgaggcctcccctcctgctccgccgcttaagcgaggcgacgccgcgccacagccccagccccaggtgatcgcggtgatccctcccctggctgtgatgccaccgcgcgagcaggaagcgccgcatggcacgggggacgcggaggctccggggatcgtgcgcggcgacgccgacgacgacgacgccgtgccgccgaaggagcggtctgatgagcagcagcagcaggatgaggaggaggaggaggaggaggagcagaagtggcggcggcggcggcggcgggaggaggaggacggggcggcgaagggatcaggcggcggcggcggcgcggtgcggcggagcagccggagctgcgtgcaggcgaagaggttcaggcgcgtgggagggaagggctcgcagtcgtccgaccccatcgtgctgtgaatctgcggccgctgctctcatcagctttgctactagcctaccagtagtgctacctttgcagtgaactacggttgtgttcggtgtccatgtgtcatgtgtgttaggcttaggcagacggtcgaagagctctggtactggtacttactcctatgtatgtcgttgatcgttgaattcaggttatgtagcatttgatttgactactatggatttgatgactacgctagatttaaaaataaaataagcattgaatttaaatgctactccctctgtcccaaaataaaccaacttcgtactaggacgtgagacatcatgttcatttatactaggatgcgtcatattctattatgaggttagtttattttgggatggagggagtagtttgctagcgaatctcataagaatctaaaacattgtgggcttgatcgaccgggattgttgttgcgactgcatcaattgaacaccgtggtaggttatagctatttttcaactgttgcaggaacaatagttgttgataacacctgataattcaaaagatgatgtgtttgaatgactaacagaaaaataatatttgaatttggattgattctaaaggagagagagacagagagaagacgcaattgacttcttaagagcatatacaataagatgaatcagcaggctccaaaaactttaatgtcatcatattcctaggtggagggggagataattaaggaaagagaagagagcgagctataaatctggcaccgggcggtagcacaacttcacatgtcaaacaacttgcatgcagccagtactagcgattaaaaacatgttttgtgggtcccacatcacccccatttgatcccatgtgcttcgtctcacttcgcccttgtgccagatccacatgtggcgcacacaagatgggtgcccctgatgtgcgccatcctcttcgctcctctggcgtacgaaaaaaaaaaaatcgttgcctcggcttcagtagatcgacgttggacgcccgccctctcacaccgacaccggtcgtcccagctggcagttcaatgtcgctccagtcgatcccgacctccgtcattgctgtcaacaccggggcggcctcaaacccaaacccaatcaccacgccgccttgcccaacgtcacacctgtatccccccacactgtcgtgatggccggcatcgtggctctcgccttcccacatatatagctcactcgttcttgccattcttcttctagtgtgggtgtaggtgactgatcgatcaagttgctacttttcaccgtgctaactagcttctcggtcaaatagggcgacgactttagtgtggatggtggtggccacaatccctcatgttactcttccaccacagccaataagagctccactagtggtagtcatcggcactcacctacgctcgctcgttcattccggcaccccgtccgcggccggggcccacgctcgctcgttcattccggcaccccgtccgcagccggggcccatctcccgcgtcttgcagctacacaagatgtggaagagaaaacatcacaaagaaaaagtagaggatatgtttatactaggaaagctgagattagaaaaagaaaagcaatcaaaggaaaaaataaaaatgaggtttgaggtcatgggttaaattcatatggaattaacgtataggaatgtgattcaaaggaatttccatacttcaatcttacgttaacaacctagataagaaaaaattctaaggatttggattctcaaaattcatatgaaaattctttaatccaaaggtgccttaagtttgttgtatctcctcaactctttttcccttgagagggagttattttatacggttgtaatcacattaacgctgttgtacgatatacacgcacgtatgtgtcgtgcgtgtaatttacacacatttaaatattgtttgaggcacatgtactcacctaccaaacatgcatttgtgtaattactcaaagattattgatatataccggtggtaaatcggatttgaatctttataagctagatgcacaaccacgatatatagacatgaagtcatgtaatcacatcttagcttttgagtccatctcaacttgtatttggaattgttgtttgcttaccaccttataggatggattggaaaatagaaatccatcattgaaggtgcaatttatgtccagccacaaaaggaggaccattgtacaattcaaaattcaatccaactactcagtatctaaaggggttgatgataagtcagcttcactttttctttatctttgcttgaaatggtttagtttggttcatttttttttctatacaattagttgagaccaaattcagaaaggagctaaagaaccgatccagtcaaaaaatcaacaaatcttaatttgattaaaggaaatgttgttactagagcatttttaaaccaaaccaccgatcgagctagccaatcttcttcatataattttaatggatttttgtacaagcactttcggggggcaagccacctatgcctcctggtatgctaatgtttaaaatatactaatatacacattgaataattttttagagcctccatctaatatcgaacttttatactgcaagtgtaagttgtaaatttgcaagaggtagtttgagtcaaagtcacctctaattccccttaggtttggttgattatggtatttttaccaatgttcattttgaaccacccatatttaacgatattacttcaagctgtgtatgtttgtcaattttatactatgatcatccttaatccatctctcttctctaactccaattatgcagcaccaccaccatcatttacatctcatcacctcccctaagatcaagtttaatctactcatcacctcccctaagatcaagttcaagatctacctataccatacttgtagctcgagcgtctctgccagtgccacccaaggcttgagctcaagcttctccatagaggaaagcaacgacggttctcgaattttgcagccgagagtctccacaaattatggtgttgccatgttgttcctatttaattcttagatccagctggttggagttcgaaaaaggttgctgccatcctactcgcctccacatgagacatcggcgctatccacccacccatatctgtttagttggagttagagatggttgcaccacattgctcatgcttcttcatgagcttgtcattgccatcttacatttctactcatctgtcctccaaatccgctccatgcactaagattaacgacatcgatacgaccctgagctcgatctctatttgcattgcctagagtgccatctcaagctcgagctccatttatcttcaccaatgctcttgtggctcatgagtttgacttacttcttttttgacgcattttattgctgagttgctagtaggcatgatggacaaacataattaggagagaccgccactttatccatcaagctttaagcggtggaagtgggaaaccgaagttgaagaaaa

SEQ ID NO: 75264 - DNA, 22829 bp, Oryza sativa
tcctgcagccccgaattggttagaagaatgtgctttaaactatgaggtcatgggttcaaatcttgaatttggtaatttattttttttatttttccagaaaagaggaaacaaatgtttcagggagaaaaaaaagaaaaaaaagaaataaaaaaagagagagatcggtagagagagagaagggaggggatcgggagggagggaggggggcgatcgaaaagagagagatcggtagagagagagaagggaggggatcgggagggagggaggggggcgatcggtagagagggggagggagggagggggggcgatcgaaaagagagagatcagtagagagagagagaagggaggggatcgggagggagggaggggggcgatcggtaagaggggggatcgggagcgagagagagaaaagagagagaagggggagcgagagagggagagaagggaggggagcgagagagggtggatcgggagggaggggggatcggatgagaaggggagggggggtatagaatattcttaccacacacacacacacacacatatatatatatatatatatatatatatataatcagaatataatcatgtaagattttgttgtaaagatttaattgcaacgaacacaacggtataatcggattataaatcggataagtaatttaagagaaacttctctaagaaaaaaattgagtgtactagtattagttttttttttttggaaagaagggtgtctctctttagcactattcagctagtgctctcgatgtagtcgcgtccctaatctatcatatatatattggctacgcacaactactctctgcaggtatcttttcgcttcaaatcaggatgaacggtgagtcgttcacagcagctgtagctcgtcggtggtgaaaataatctcatgcaccaccgttcgccgttcgcttgagttcgcatgtgttctctcgtaacgaaggtagggtcgttcccatctgtggtgattttttgttagatgatacagagatatgattcgtttgttacagtataaagcacgtacaatagtcagatggaatagtccgatgggctttaaatgtaccgtggtcagatgggtttaaagttggcccaacatggcctttaaatatatatagggggggagagagagaggcggtaaccgaagacgttgttaggatcgccgtgagtttgagaaagatgtggggtacaacacaactgtcgtgtcctgaattggttgccgatctctccatatatatggatgagatcatatatcttgtttcacaacataaaccatctaattttacacaacatggaaaaaacatgtctataataaaaagtcccataaaagggaaaaataaaaaatgcgccgtctgtgaaaaagttaaaaaacacctttttggaaaacaataaccatccgattctagaaaaaaaaagagacaaaaaacatgtaaaaaaaccgttccacagaataaacaaagtatgattcaaaacctccataaaaaaagtttcctccgaaaaaacgttttcgcgaaaagaacctgttccgtgcaatgttacgctctatatatttctatctctatcaaaagcgaaataataaatttcttcttcgcattggttctcgacgtacttgttaagaaactacgggtgaaactacgggtgatgttatccacccaaaaaaaaataggaacaatggttactaatctaaccggtagagaagaggagatagctcctctctctccctttggtgtccctgtcgacaaccgacgcgatgttcctaaagatcgcatccctacggttggcaccgcttcacattgtataattgtactgttgatcaatgagaaaatatccgctcattcgctctattgtatcattcaattctctctcgctccaatcaacttcatccactttcaacggtactttttttattttcattcgtgttaacctactttctgagtcccgtgggtgccccccgcacatcaccagattaatttacttcaggttttttcgcacgtatatatccagttcatgatcacaatttgatttgatccgtcttggtccattttgaattttttttttgtccgttggtagagatcacgtccatcgctaaggatcgaccacgtcggtgccgatcaaatacgatgcttgcggcacacaaactttccttgagctgtatgtgccaaataaaagcagcaagcaaagtcttatggaaaaagtacaaattagccccctaactattttggtgaccgaattacccccataaactcgaaaatcagacattgctaaactttcaataccggataattacccccctcgaccgaatctagagcggttttatcctacgtggcgtacacgtggcaatctagtaagcattttattttttaaaatatagtgggacccactcgccataccttatcttcccctcttcttcttccttttcctctctctcgggttcagagtgtgcacggcgagcggcggcgcgcgggggcggatggtcggtcggcacgcggaggccagcgatggatagtgggcggcggcgtgctggggcggacgggcggttggcgcgcgtgggctagcggcggaatgcggagagggcacggcggaatgcggggagggcacggcgggcaacgggcggcgccgaggaggccaggagggtgttggaggcgacgggctacggcgacgagtcctcggctcaggcgggcgctgccgaggtcatccttcctgccggaggcagcggagagagaggtgcagagcctcttctctggttccgatgtggagtcggcgggatccacggcctccccccgtctctctctctctctctctcggctcaggcaggcggctggcgatgaatcctcctcggggagggcgcagcgagcggcgctcgtggcgcagagggcacggtgggtggcgccaaggagggcattggaggcggtgcgctacagcgacgagtaattcgctgcccatccacgtcgtccccatcgaccgtagtcgctgtcaaccggagccacacagccgcaccacacagcccaccgctgctcgccgccgctaaagatgccacctgattcttctgctgctcctggtgttccccgcttcgctgctgctcctgtaaaactccccgtcacaccggcaagcagcacacatctgtacatcctgtacatgcatgtacactgttcgtcgattcaatttctctcagaattcttccgtgacattgccacgggtagatcgcgtcattgccgcgagcagtgtgccagcgtccaccatgctgatgccaccctcgtccggtgggtggtgcgtgatggcgatgcccgagcgagctagccgagcagcgtcgccatgtgcaccgccgctcgctacccagctccgccctccgcctccgcatctcgcactgtggcggcgggtcttcgttgtgggaggagaggagcagcaggagacgcgcgagacgagggcggcgagaccggatgcgggccatgcggcctccacttccatcgacgtgccggagggcggcggggcagcagggggaagacgaagcagattgagcgccacttcaccgccttccgctcctgccacgacgccctccgcctccaccctcgccaagtcgccgtcgccctctgccatggccagaccaggccgctgcttgtcgccgccgccatggatgaggctgctgctgtggcgcatggggcagatggaagggtcgacgaggatggacggccacgcgtttcaggtctgcaatttttccccttcccttctttgcttctctcgttgacgtggtggaggcggcgcacggtccgtcgtcctggtcgtcggcatcgtggccgtccaaccacgtccgccagcgaacgcagagcaagctcgggtgaccggcgatggaggcggcgagttcgggaggtcggcggtgggggcggaggcagagcgcgtcgtccttggctcaccgcagccgcatgctctctcctctgctcaccgagagagagagatagagaaggaggagagaaaaaaacgctgataagtgggccccactagttttttttattggggcaattgtgtttttacctttgctttacgtctcaattgtgattttacccttgctttttagggttttgtgattttgcccctgcttttttgaaacgaagcatccgtctgccccggtttggacggtagtttggtgggcccgggatttccaaattaaacgaagaaagaaaatgctattataatttgtgaatgactattctacccttgcttcaatgaaacaaccaaatccccaaaccttgctgtcccgatccaattgaaaaccctagcatgctgggttgcaagcggcggcggcggccgcttacgcgacaagcggcggcgcgcggcagggaggagtggcggctcgggccagcacgcgatggagtcgggcgcgggcaagcgcggcggctccgtcagcacggcggccccgcggccgaggagcggcggctccgtcggcgcgtcggcgtttgctcggctaaaaactctgggttattacatgctttccataagttgtgagagcaggctgcaaaaacaaatagggccagctttgaggtgatctggtgatgtggtcattacttcttccacgaaattgtatgatattgttgctgcttactgctcgatccgtcgatatagatttgagctcttccagagttctccagccagtttacatctgagaaggatgtggtcagatggacagatgattctatcgtcggacaagtctcacagttggtgtttaatctgtttctgaatgcgagccagagggagattctgcaggtatttgggattgctttgggttacagatttgtaagtaaagtatagtaggcagctgaagttgtttgtttctgttgaagctaggaggacagttcttgtattttgctgaatttgatgctccgatagggctgcacctattagcgtttgaagtttggggcaattgtgtttctgcccttgctgtcaaaattttgtcaaaaatattgtgttctgacatcgtttataaactgtgttcaaattattgcgaaaattctatcaaaattgtccaaaatattgtgttatgtcaacttttataaaatttgtgaacatttaggtcccgtatgaaattcgcataaaattaacttgaaacatgtatcctgtgcaagccaaaacatgtccaggggtatatttgtccattcaccacacatttaacaccgttaccattagttaacagagtaggggcaggcaattgcttcgtttcaaaaaaacaggggcaaaatcacaaatcctaaaaaaacaggggtaaaatcacaattgagatgtaaagcaagggcagaaacacaattgccccttatttgtttttgctgactatatcgctacgtgtgtgccacgtaggatgaaaaccgcttcgaaccgtgttagggtggtaatttgtccggtattaagagtttggggtgttaaatgtcaggttttcgagtttagagggtaaatcagtcgaccgtaatagttagggggtaatttgtactttttccaagccttattggaacttaaactcctctcgtcacctagcttcttgctgctaccaagcagccaaacccaatcactgtgaatgcgacgtgctcttgacgatcgttcacgcaagatttgaggtgagagaaagtttccatgatttatccatatttttagattggttcaaccaaactacatgatatcaaacccaactagctctatatgtcgtctaaatagtgtcgagtctaaatttcagatctaacatattagagaggtccataatttaaaaaaaatcaattgctcttattacaatttcagatcaactagcgatattaatttgacttttgatattccatgcgtagtttgacataagtagctaaatgtggtgtagttactaattttgagtctctccggttctctcacttgcttttattgtagtcttattcacctttcacactttctctaactacctaggatttggtgtaccttttcccatagcaatgcacggacactttgctagttcaataaagaattgaataaaaggtgaaggatagaagaaaaatgatatatgtatttagatttggttaaaaattcagatccaaagttcaagatttgatttgagagaaagtggattaaatttgattagggttgatgtttggcatgagtgatgattttgacacattttctcctgaaacatatacgacacattttctttttggtgctatatgacatatttgtaagacatgtttctgccacaatgcatggaagaacggctaacagcttctgcccacacgtcaacccacaagcatcaccatttcctctacagtttgtgcaggtgcacagagaaaattctacagagttagcaaggcaggatactatgacaaatgcagtttcagaattacacccctgaaaccatcaaatattttcagagttattccgcggttttctttccctggctctgtacagatgaagccaaaggagtcatccggactcctaatttcatcatgaataccaatcaaaccactttggtgtgctgcattccactgataacttgaaacaaactagcaatagaagcgcgctacgctgcgccgcccgaatcaattgaagtccaatatgttcgatgaataatatgcatctactattcacccatagcattggtttatgctttcgtctatatcccataaactacccttataaaaaaaatttgcacatacaaaaatagtgtataggctaaaggagaaaaccgaaaggtatcggaagtttgaataaatagaaaaaaagggcaaattacatgccaatttcaatgagtttacagaggtttcaatgctacccctttttcctctgtacgctagaatcacattggactattggatgctaaaaacagaagacctaaatgcctactggtggtccatattaaatatatgcaaagctaaaatgaacagatggaaaatgatgttttttaagtgcaacatgcaagtgcactactcaacaacaatcctccgttatgtgcagttagtgacatcagtacacctgaaaaaaaatatactacctccatcccaaaatatatcgcaattttgagctgtgtacctaaacatacctttcaagatatagggctagaagtttttacattttgggacaaaggtagtagaaaattttaatagtaatgttagtacagctaaaacagtatagtatcaaccacttatatagagagataatattttcagtttggcatcacaattctaaacacatgaaaccaatttttctaccaaaagttctagcttttttggagtggagtagtacaaagtgctgctaccacgtggcaaagtttatgagcgaaagcatgcataatcaattaaccaaagtatggatgcaataacataagccttatagttctacaatgcatatatacttcttcaggtaggttccatttttttcttccctgttccttttaagtagcaggcaaaatatacaatgtggaaacaaagagcttgtaaaagcacaacggcagcaggctacactacagtttgacgaaacagatcgactgcacaacttttaggatttaaaagtgtgctttcacaaataatgaaaaaacatgtgtaaaatagtctggtgaactaaacagtgaaataatctctctgagcacagacatgtaaaagcaaaccaactgaaagacaaaatataaaaaagattgactcatgatattgctttacctttgcatcgtaacggttaggatatgtctagcaaagcattcccattgaaccagttgatgcacccttcaaaagaaatttacgtccgtctcagatatgaacaggaaatcagctttccgtaatggatccaatccatccatgtctttttcgacctaataaaaaaagaacatagagatatgtgatgaagcatgaataaatgaaggtcattctcgagactgctaatgttttcatgactcaaaaatggaaccatacttcttttaaagaaaatgattgaggacatatcctaacagtgtgtatagtcataatcgactgataacattcttttggtgcctttcgtgcagtggcgggcccaggattttgaacttgtgtattcgaaatggcgagaggaaaaaattttgttcatacacctaaaaacctaataattggcttgtatagtatcacacactaataattatataatatatagcgtatataacataaaattgagcataagttgcacacattgatagaattgatcatcacgtgaaattgtttaacatatagaaatactaattgataaacatatcaaagtaccaacatatggaatacaaaaatgatagaaaatgataaattgggaagaaatcttacaatttagagattaacttttcgacgcttgatattttgaaaataatcgatgatgtccttgtcctggcttgcaaaaagaattccctttcaatgaatgtaaccaaacaatcattcaagcatttttgtcccatcttggttctcaacttgtttttgatgtagttcattgaagaaaagaccctctacaaactaagcaaccaagcaagtatactaaatcaatcaattgtagttcccaatcctaaaatttgcattgcaattattcaaaattcgtgcttttgattcaccgtgtgtatgtggcagtgtggtggcggcgtggcccgttggcgtcttcgcggcctcggtcgtcggcggaaggcgggaaggggaggaaggcggctcagcgcccagccacccacacggccatgccgtcgccagcacaccacacgggcacacaggccacagcccacagcacgccgcgtgggcgcgcggcccgtcgctggagccggcgacgccgagtcgacgacgtgccactacctgcttggccgacggccgctgccggcgctgcgccgcagctcgcgcctccgccggtgcgcccagccggcggccgccccttccatgctgtggtgctgctcccgcgcagccgcgctggcgcggtctccggctcgctgcgacgccgccgccgcacgccgcgcccgccgcccacgccacaacacacgccgccggctgtggctgtctccaagcaaaattagggttagggtcttagggaattggggattttgggaggaggagtggaaagggggaggggagtgtaaaatttaggtccaatacagcagaaatggtaaaacaaggcccaaatgagtagtttaactctttttctttatctttttcatacatatatgaactatagagtaaatatacctattttttatccaaaatcttaggtatacatctgaatacccttgaattatagctgggcccgcccctgccttcgtgttttgtagagatggcatgaaagatacacatcaatgctagtctaaaattccatctcaagtgaatcttagggataaatgtgaaacaataaaccttgatgaggtaactaaagtagaaattaaatatttgaaatgggtgtaactcaatcatcaatgacataatggagctactgaaatggtgagaatcatttcctccattagctacttaaaagaggctaacagagcatgaatactcaattcacatcatatcacactggaagaggcattggcaacacatggatgaaaaaattcttcgtactcggcaacaccaacagaaaaaatctcttcatgcaagcaagagaaagctttaaaaacgaattggtgagatcaaatagtagagacacgaaggctatcaaagtacaatgtatatatggaagaaatttcatcagagcatatgagagcagtataataacgccggttgttatgttaccaatgtaactcagaagttgtactggatggtctttacaaaaattaagctcaattatgtagttatgttgttatacaacaatttgtgtattattcagcagatgaaatgcaagatgcatgacgacgatatacataattaaccttaatcatagaatcattatcataagattaaagatcaagcaaaatagcaatatagtctatatggctctggggaacttgaacggagctggcaatatttttcccttacatatgcaagcagtgtaagtaacattttacacttgatggtgtaaatatccatgtctaaataattttttgtataaaaagaattagtaagaatagctaatcaggttgtactggtcgaaaaagaattaaaacaataacaggagcatctgtaatatagaaacctataaagggtgaaggagatgtaacaatgtaaaataccttcgatagctttgataataataactgcatgcaacacccactaaaagtatgatctaacattgttaacgttatgataggatactttgcatagagatgaagagatcaattaaagaacacatctcaacaatatatggatttagaatacttcaagggaatataaataactctgatgtggtgacatacatatagttcttatgtagctaaaaataggaaagcaacctaggtaagttaaaaatgcgaggcgactgatagagaggattttgacattgaactcataaatcccttccctaagaaatgtgccatcacttgctatatacttttttgcttgtctgatgcaccctactgacatttttatgatcatattagacataaaagactaatgaattaccttcagtcacttactgattgtactttgagataccggccgatcaatgcagtaaacatttacccaatcaagttaattaacatgtaaagcaaagcagaatgggtatctacatccaagtggtgtatgtgtatttgcaggaaaaggtattaattagcaaacagacttacatatgtgatcctttcgtttatgcttccaaaaataaatgcaggcctgcacataaaaaaagttttgaatcaacggaatatggccttctaacaatgaaatctgtgcttcgaaaaatagatgcaggcctgcacataaaaaggagttttgaatcaacgaaatatggccttctaacagtgaaatttcagaagcataatgcaggcaaagcatttataacctcatatcttcagacttattgaccatgcaccacagaaaaatcaagtagaggtttctgttagatagatctcccacccgtacggcccaacggcacaacggaccttgaccgcgccctaatcgggggcgtccagcccaatggctggtgggctgtcacgtcctgataaattcatcccgaaataaaaatcattccctaaaaggaataatagaattaattaaaattcaaaaagaaattgacaaacactaaaatacgtgccagaaagattcgaatgtggtccggagaatttttgttaaattctccttggtctaaaaggagccctcaaattttacttgaattttcagagcaccgaaaatatttattaaacaacaacaacaattaacaaagtttattaaaaagaaaaagctaaaaataatccccctcctccctttgggccaagtctggcccaaagtctccctctctccccctcggcccgcagtccaagtccctctcccctccctttgtttttctctctttcctcccggcagcccactccctcctcctccttcctcccggcctgcctcggcccagcagcccggcccaagccaggtcgagccgagccagccgcgtgcacgcgcgccgcgcgtgcgctgactgcgcgcgctgaccgcgtggggcccacgcgccggtcgtcttcctcctcccgcacggcctcctctctctcccgtgaaaaccctagttcgttcctccctcgaatccgcgcgatttaagcgttggattccaaaattaattggggagaattaatcccctttccttcctctcccttttcccaataatctcccctttaatcgtgcactattttgaccggaacggctgcgccattcatggccgtcttccatggccgccgggcgccttttccgccgtcgttccccgctcctcccgtgctcggctcgcttccctccgctataaaacggaaccccctcgctccgttctctcgttttagccccctcccgcgccctccccgtggctgcaccacctctccccgcctcctccttctctttcctcggtgccggccaccctccagccgcccctaccgccttgcccgagcgccggtcggccgtgccggcgcctcctccagcgtcgcagccgcctcctctgcgccggcctgccctctgttgcccgcggaggcctccggaagtgcatccccgccggcaacagtggcgttgccgccactgttccgtcttcggccggctgctgttcatcgccggtacgccgaccgacgtcgccatctcctccgtcgacgtcgcagccgcctcctctcccccagtcagcccttcgtttcgcggggaaaccactggagacgcgtcctcaccggcaaaacagtggcgttgccgccactgtaccgcctgtgccgccttgccggtgcagcggctgtcgtcatcgccatcctccctcgacgtcgccgcgtcgccctccaccctggcctgccctcggtttcgccggaacgccgttgcccgcgtcggtctcgccctccgcctcgccggagttccttcggcaaccccttccgctgtgcccgtgcgccggccgacgtcgccatctcctcctccggcatcgcagcgtcaaggttgccctcggcctcgcctcccctccatccgaaccccgccggtgttcgttatcgtcgtctctgttcgtcctcgttgacgactcctccggtcggtcgttcgtcctcgccggctcgtcgtctcgctgcgccgccaccctcgtcgtcatcatagcggcgtgttccgcgccgtcctcgtctccgtgcagctgctgccggctgccctcatcgcctcctcgccggttcctgtcgttgtcctctcgtcgttcccggtcgtcgtggcattcgtccctccgtcaagccgttctcgtccgtcgtccgtgtccgtcaagtgtgccgctgcagccccgtcgttgtcttcgtcctcgcctccgcgtcgccaagcgttgcgccggccgcgtctcgccttcgtccaaggatcgccgccgaagtcgtcccctcgcctttcgtctccgtcattcccggccgtctccgccgcgcccgttcatcgttgtcgttccctcgcctcgtcgcgtggtggtaaggatctctccttcgctgccccgtcctcgtcctttcggtatcgcccgtgcccgttgtgcggttgtcgaccccggtacccgtgtaccggtgtcggtagttgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacgggatctgcttccgtcgacccgtggactgtctctgtgtactcggtctaccgcggtcctttaggttgacatgtggggtccgcatgtcaacggcgcagccttcctgtcttttccaggctagcgcttacacatgttttatagttgcaaaacctaattataataatccgcaaatctccatgtaacagcattaaacttcggatgatcatatcttggtcatacgagctctgaatcgatccgttcaagtctcctaatgtttgttataacctaaagaaccctgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttaagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggatactatggaatggttggcttatgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctgcctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagcctagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaatctttcccccccttcagtaagagaagctttagagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttccttggacggggattaatacactagcgttcgggaaaatgtatttttctcggtcgcgacatgggcccccgtcacactgcgccatataaaagaggggtggaggccggcacggcacaagggacgagattcaccgccgccgccaactccaccctacaaaccctaatccgatcgagaggggccgtagccagtgacgggaaatgccaccgccgcgccacgacctcgccgggatcgcccacgaccaccgctgttgcagccgtcatcgccgtcgacctcaccggcgccgcatccatgacaaccgagtgccaacgacgacgatggccggcacttcttcatcctccaacacctcaaccggtcggtctatctaaatcctctcccgttttcaatctctatagttcaaacatcaatcccaaatagaaccacccgactagatctaacctttttcccgcgcgcgccaaaaggccgtgggccaccgggaaaaagtttaaattaggtccctcggggggccgaaaaagaaaggaaaggaatagtagcatttttccttttaaattttgtcaatttttcatgcaaatttcaatagaattttgaatagatttttgcatgttttacctctgtttaaatttgaaccaacgggagaatttttacagagagtaaattacagagttttgctactgttcatatgatttttatatagtttttccgctgcaaatagataaaattgatgaaaattagtgtttctaaaattaaatttcgaaccaacgggagaatttaatttttggaacattaattatgtgctatgatattgtaattttctgaccaacgttgataattgcaatgttatagttatggttatatatgttatgtctaattctgcccaacggtgatataggcttaatgcataatattttaatgttaatgttgttctcaccgtacatgattattttaggtagctacttcttgatgggttgcattaaagatattccgaccctaaaaggagataactacgcagaatagaaaagaaaactcgaccttgctttcatcttgggagaggtggactgggtgttgactaccccatgtcctatagaacctgctgaacttatcagaggtgaaaatgagtcagatggtgactggcaaaagagacagagggacaatgctcctctcgtcatgtcgtatgacattgaacaaaagaaatggtccttagccaacaagaaatgtttggctatggtaaagaacacgattgagcctaccatattgggctcaatcccagagtgtgacgctgtctcagagtaccttgaaagaataaagaggcagtttactggctcttcaaagacttatgctacacagctgatcaagcagcttgtgaccgaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgaaaaactcattgctaattgtgtgcaagaggaggagagaattaaagagtcaaatggtggttcaattaactatgttaaagataacaagaaaaagaaccacaagtctcccacctcaaaagctaaacagtctcagcatctgcctcagcaacaacagttcgctgttgagaaagatcagtgtctccattgcaagaagacgggacattacaagaaagactgtcctgacttcttgaaaatgatcatggcaaggaaaggtgagaacattgttacatttgtaaatgaatctcattatgttggttactctagatccacatggtggattgattctggagcaattattcatgcttgtaattgtttaaaggcattccgttcgacgaggactacgcaaagaagagaaagctccattagagttgccaatggagttgaaaaaaaagttgaagctgttggagatcttcctctagagctcgcgaatggcttcacacttttacttcgagatgtcttttatgttccttctttgcaaagaaacttaataagtttatcaaagttggattttgatggatatgattgccgctttggaagtggcaaatgtgaactatggtataataatgcatgtattggtcttgctgtgctgtgagacgagctttatttgttatctctttttgagaatgtgaatgttgtgtcctcgttgacaaaagaaaacaagaaaagaaagagaactcccgatgtctcatcgaaactatggcactgtcgtttgggccatatttcgagggggggaattgagagactagttaagaattaaattcttcctccattggagttctcagacttagaacaatgcattaaaggaaaatttgtaaagagcatcaaaaagggtgcaaaacgaagcacaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggttgacatacgccttatgggcaagtccctggaccttttgcaaggttcttgctagagaatagaatagtagcccagtattcagcaccgggcgaacctcaacagaatggggtagctgaaaggcgtaaccgtacccttatggatatggtgcgcagcatgatgagctactccacactaccactgggtttatggatggaggcgttaaaaaccgctattcatattctcaacagagttccaagcaaatcggtgcccaaaacaccgtatgagctatggacaggaagcgtaccctcgatagctcacctccgtgtgtgggggagtcctgcagaggctaaagtatttaatccaaatattgggaagttggatcccaaaacagtcagttgccattttattggctatcctgaaagatcaaaaggctatcgtttctactgtccaaacagttatacaaagtttgtagaaacgagacacgccgtcttcttggaagacgaaatgattagggagagctcggtagttcgagaaattgatcttgaggagaggcgggtgtctgtacccgctccgtcgactcaggaacctttcttctctctacctgctgatgttgtgcctgcaatacctgtcattgaggtactggcacctgttgttacctctcctgtggcaacaatgaatgaaaatgataaacctgttatacaggattcaacagaaatggttgccacactaggaggagctgcaacagcctcaaatagataatgtgctagtacaggagactcaacaagagcctcaggtacaggatgtgccaaatgtgcaggcccctagaaggtctgaaagagtcaaaagatcggttatccgtgatgactataaagtttataatatagaagagtcgcatatggaggatgatcacacctcatatgaagaggccatgagaagcgctcgctcatctgaatggttggaagtcatgaaagatgaaatgaaattaatgaaactaaacaatgtttgggatttagaagaaattcctaaaggagacaaaacagtaggctgtaagtgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacgacatttctaaatggagatttggaggaaaaagtatacatggcgcaaccgaaaggttttgtcatgaaaggaaacggaaatatgggatgtcgtctaaagagatccatttatgaattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaatttttgtcctcaaactttgacatgaaagacctcggtgaggcttcatatgttttgggcatagagattcaccgagatagaacaaagtatgcattgggactttctcaaaagacatatatagaaaaggtgttgaagaaattcaatatgtacagatgcagtgctacacctgctcctatagtcaaaggggaaaagtatggggcatcgcaatgtcccagaaatcagtatgagctcaatgaaatgaaaacaaagccatatgcgtcagctataggaagcctagagtacgcgcaagtgtgcacacgacctaacttggcatttgttattgggttacttggcagatttcagagtaatctaggcccagagcactggaaattggtaaagaaagtcttgcattattttcaaggaacaaaaggcctcatgctgtcttatagaagatcagaatcgcttcagattatggggtattcagattctgattttacaaaagataatacaaagtcaacatcgggatatgtgttcaccctggcaggaggagctatttcatggaaaagctcaaaacagactatcactgcagggtctactatgtatgccgagtttatagcatgctatgaggcaacggggcaggtgaactggctaaagaagttcatactcagtttaaaggtggttgacagtattgagaaaccactaaagttatactgcgacaacgaacccgcagtaatgtacgctcacagcaatcagtcaagtggtgctgccaaacacattgacataaagtactatgttgtgaaggacaaagtccgggatcaaacaatcagtctcgagcacattagaacagaaaggatgctcgcggatccactcacgaaaggcctaccacccaacgtgttcaaggaacatgtagccggcatgggtttaagggaagccttatgaatcctggactacagggcccaaaagtaaagtatatgtttctgaatagagatgtgtatagtggctgtcgaatccatcggtgattgactgtgacgatgaaacatgctctattcacaaatctgtgatggaatagaaaaagctaaaagaaatagtgagatcaagggggagaatgttagatagatctcccacccatcgggcccaatggcataacggaccttgaccgcgccctgatcgggggcatccagcccaatggctggtgggcccccgtcacactgcgccatataaaagagaggtggaggccagcacggcacaagggacgagattcaccgccgccgccaactccaccctacaaaccctaatccgatcgagagggggcgcagccagtgacgggaaacgccaccgccgcgccatgacctcgccgggatcgcccacgaccaccgctgctgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaatcccaaatagaaccacccgactacatctaacctaggtgatcctagagcaaagtctaacagtttccaccagtcatataagcctgatatgaagaaagcatgagatgcaggactgtaaagagaactgagaaatcaatttgaggagtagtatcagcaggaggagatttggctgctgccacccatgtcgagtttcacctgttggttaccgcgtgcttgtaggcgctcgatgcggcacagatcttgcagaaccaagttcgcgtgggatggagaaagagacggtatggcggcgacagtggacatcgaacttgcaagaaggtggcagcagccgctgctagctcgctgggaagacgatgacggtaaccactggctccgcacggcggcagcaacggctggctcaacgagcttgagaggaaggcagcggctccggcttcgcgagctcgaggggaaggcggcagctggccacaggctccatgagaccatgagcaggcgtcggaggatttctgggaggggaaaacgtgagacaaaggaaaaaagaatgaccagacaaccatcgtcgccgagccgtggttgtcttcgtcgcagtcgtggccgagcctacgcagggtggtggcggcggcctgctgaccccgtctgggcagcggcggctctcacccctctttagggcatcggatccgctggtaccggcggttctcattcctttctctgggctgccggatccgccggcgaggagaacggggtcactggatccggcggccccggcctcctcacggggagatccggcgactcgttggtagggagcggcaatggtggcatggcgagtaggttgagggagtggaggagaagggaggctgcaatggcggcacgacgagtaggttgagggagtggaggaggagggagctgcggcggcgacgacgcacgcgagggaaggaggacggtgaggctgcggcgcgattggaggaggtgggcaaggcggcgtgcgtggggaggagaggacgggcggctagggtttgtactggctgaagaatccagaccatccgtttccaatccaacgatctgacgatggtggaagggtagtcatgctgggacacgtggacggtcaaatcggccttagcttgtgatccgacgggccacgttaacggggatgtacacgctattagcggaaagagcaagggtttttctgaaaaaaaaatgatgacgtggcgccctaatcctcagccattcccacggcttttaagtaaacaaattgctcatgttcatgtacttgattccatcatcttcagaatgtgttttaggttctcccttttctccctgtaatgcattggcgcagctagtttgaaattatgaatgttagtacctgacgtccctgtactgcatttgtgcagatagttacctgacaatgttctactaactgaatagcaatgtgctgtacttgacaaaagaaaagcctcaaacctgttctaagcaaatgagggggtgtttagatcaggggtgtaaagtttttgcgtgttacatcggatgtttcatgggatgtggcatggggtgttcggatactagtgacaaaactaattacagaactcgcaagtaaaccacgagacgaatttattaagcctaattaatccgtcattagcaatgtttactgtagcaccatattgtcaaatcatggagcaattaggcttaaaagattcgtctcgcaaaatagtcgcaaactgtacaattagttattttttagactatatttaatactttatgcaggtgttcaaacgttcaatgtgatagggtgtaaaattttggggtggatctaaacaggctctggaaaagaaaaagaaaaagaaagagaaaactaccatgatggatagcacaatgttacctagaagaggcccgtggtcacattaaaagtcagtgctgctacagggagaaactattctaacttttgaggggacagccactggtgtctaaacc

SEQ ID NO: 75265 - DNA, 21896 bp, Oryza sativa
tctccaatagtagaaatcttcacccataaactatacaaaaccatgtaatttgggtccgataatagtatagatgtttgattttgctgacataatatcgtagtcagtaaagtaaacataaaaataatatgtgcgtcccacatgtaactgaagtgagaagaaaaaatattgggcccgcgtgtcagtcccatcacctttcttctcttttcttcctaagcctgggagatggggggcagccgataggacgggagggggggaggaggaggtcggtgagcctgggagggagggagagagaccaaatgcgccggcgggagagcggggagaggaggtcggcgagtctagaagggagagaagaggataggaggttggtgagccttggagggagagagggagagaggcggtcggccgcaccggcgggaaagtggggagagacggtcggcgagcctaggagggagggggaggcaccggtggaagagggaggggagaggtgaccggtgaggttgggagtcatgttcgctgccgctaccgcaatgacgacaaagacgatgacgcacacgcgccactgcgcgcgcccaccgttccaccaccagccccgtgcacgaaggcagcgccgctcagctccagcccgtgcgccatcattgccaaggagacgaaaaccacggagcgcagctcctttccgttaagccactgcatgacgcggtcggcctccatgcccacgctaacattgccacctccccctcccccaggctcgccagctgcctctccccccctctcccactcgctgcatccccctctatcctaggcttgggaagaaaagaggaaagatgatgcggttgatacgcgtgccccacatattttcttctcatttcactaacatgtggacctcacatattatttttattttgctgactaggatgccatgttagcgaaacctagcaaggctagcatccatactactataggaatgagatctaaattgcacggttttatatagtttaaggttgaagatttttggtataggagataagagatgtcaaataaactaaacgtaaagttgagggacggcaaatggacttttttccattttaagcagcggcggtagggttggtaggtaggaagatccggcgccatgtacaaacgtcgccgtcggtcggtatcgttttccatcttcgacgtacacgttgatgttactaatacgtagtactggtaccacatggcagttagacacttaaacttggcgcctggatctggacatgccgacgtagatcggtcatcacacgttcaaaccccaccctgagttttttaaaatgaaaggtagtccctcggtttcacaatgtgactttctagcattgcccatatacatataatgaatctaaacatatatatatatatatatatatatatatatatatatatatatatatatatatatatatatatatatatatgtctagatttattaacatctaaataaatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggttttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccaagccgccgccctcctcgtggtcgccgtcgtcggcggtggcgttgccgccttctgccgctaccggccgccgcggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgataagcttcacgatctcctcctctacttcgcccacacctccagcgacagcagcggcgacaatggtggcggcagcttcctccactcccgacgtgccatcctgaacggccagccgtcatcgtcgcctctttgctggtggtagtcagagagagggagagagagagagagtgaaggggaagagataaaggagaggataagactgaatatgtggttggcgagcgagaggatatttacagtagtagttatcccgtacactgtcccatagtttttctgaaaggcatttgattacttattggttgcatgttcattagtttttctttaggaaactacggcgggtttgaacaccagcctgaactttattcatatggtaaataaactttacaaaggggggaggtacagagggacggggagaagaaactatcattagttttatcacattgtgaatgaattaattacttattagtcttggtgccaaaagaaataggtcttagatgctgacggagcgtggggctcctcaccgggagaccgcgcaggcccctctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttttttctttctctttggtgggcaaggtcctccttttatatctcaaggggatactacatgcaccacttctacctacttttcttctgggtggggacctaccctctcttgaccaaaacttggcttacaccttcgcctggaagctaaatcacaacttgtccttgagtgaggctcagcgccgtctctcgcctgacaccggggatctccctgttaccccctcattaatgggcggagatttgccatggctgctttccaaatgaccatccgacgagatgggtcatacctacctccactccaccggaggcagatgcatcgtgggagcacggttatctgccgatgacgcgaccggcgtcagaccagtcacagatcggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggtgagcgccgctgtgctcacctaacccacacacgtggcgccaaacccatagggggtcggggcgccccagctctcggggccgaaacgggagcggcccgacccctcggggagacagagggaggggcggccacatcaccctcgggcccgaccccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataatgagcggctttctttaagaccgctacattacttaagtagcgcgcgaaccgggacgagccagttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgaaagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccatttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacctggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtaggacgactggaagagcgactggttctacacccctctcgccgacgaagcgcgcctccgacttccgagccagcccccggcgcaggcctccagctggcgggcgccggtagatctgggagatggctacgacgccgttcttgaccgcctggcgggtctgcgatcccaggggctcacgggggccatggtgttcggcgactaccttcgtcgccggatcgcgccactccagcggcgcgcccggggcgcctgggagtacaccgggtccgaggactacatgaggacccaccaggggggcagatgggactgggcccctgaggatttcaagatggtggtccaacgggtgctgaatctcagctccgtggaggcatccctcatcccccaaggtgtcctctccctctgcagcgatccagagcgcgccaacatcctgaccatcatgcaagcggtcggggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggggaccgaaccatgccggggaaacctcatctcccccccaaggtggtcgtttagccgacctcctcgcaggttcgtccccgcgcccactgcggccgtattcattctcccaaggtgagttttcacttacccgttttctttttgtcttctggtttttcttccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccgggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgctccactgaacacagagcccctcctgcaggccctggctgccgcgaacacgacggtgctggacgggttaggtgcctagatggaggtcctgcaagcagagcgggcggagctcgacgcggcgtgggcgcgcgtcgaagaggggcagcgctcggtggaggccatggtggaggcgggccgcaaggcataccgccggcacgcctcagagctcgaggcccgtcggagggagctggcggagatcgccagggaggtggaggaggagcgggagactgccctcatcgccaccgccgtgctcaacgaggcgcgggacgatctccgccttcaacacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggatgcgctcaccgagcgggagcgatctctcgaggaggcagaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcacagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccagggggggcctcgcccagcgcctctcagagatggccgggactctccagcggctccccgaggagctcgaggagacgatcaagtcatcctcgagagacctcgcccggggggtagtggagtttgtactggcaagctaccaggccagggacccggacttctccccgtgggcagcactggacgagttccctcccggaaccgaggacgacgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaaagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcttcaaacggcgggggtcggggctagtgcctggggagatccacgtgtcgagactagccaggccgggagcgtggtgaccgagggttatggggacccgattgtgggcctttgccgattcccccccggagttcaccactccccggggcacggctcggttctgggccccgtttggcgatttccgccggcccgggccaccgagggcagggtcgagcacgagcgtgctaattcaagccaaaactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttactcagtccagcacgcgtttggacgcggcgtaggacgaggtcgtctacgcagagtgatcgggcccggacgtgacgctgatggtagcgccgcaggctctgctggtagcgcgcggctcgaagggccgcgcgccgccttcgttcttccaagtagtcgaggtcatctctgcaaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctagcagctcctcgatccacgagtcgccgtgcttcttgaggaatttgaaggtcttggttttgaggcccttgaggatttctgcgttggcgcgctccacttggccattgcttctggggtgggtgggagaggcgaagcagagcttaatgcccatgtcttcgcagtagccaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctgggccggctgatgggtttgcttggcgtggaactggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgcctggtggggtctgggctcgcgaggaagcgagccttgagagttcgtcggcgaccgcgttatcccgtctgggcacgtgccgaagctctatcccgttaaaatggcgctccatacgccgcacctggcgcacgtaagcatccatctgcgggtcagagcactggtactccttggagacctggttaacgaccaactgagagtcgcctaacaccaggaggcggcggatccccagtccaaccgccactctgagtcccgcaaggagtccctcgtactctgccatattgttggttgcccgaaagtcgaggtggaccaggtatttaaggacatctccgctcggcgaggtcaacgtaacccccgcaccggcgccctgaagagatagggagccgtcgaattgcatcacccaataggcggtgtgaggcagctgcgaagggcccgagctgacctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcatcgaagccatcagaatagcgtaaagcatcttctgggcctgagggtattgggtcttggcgtcccggagggcctcactaacaaagtagacgggccgctgcaccttttgtcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggctcctggcaccgtcggacaagcgggcagagggccagctccggtcgtcgggggcctcgggccgccgttcggctcgggggcctctcctccctgctctctcccgggtcgagtcgatacagggtgctctttgtccgagaggccgcgcggggcgcactcggcttctgtgccgacgacctcggggtcagagggcgacaggcgcggccttcccgcagtggccttggggccatcctggggtcgggggcgcctggcaccgtcggacaagcgggcagagggccagttccggtcgttgggggcctcgggccaccgttcggctcgggggcctctcctccctgctctctcccgggtcgagtcgacacagggtggggatgcgcggagcgagggtcgtcctcgtcgcgctccacgaccaacgctgcgctgaccacctgcggagttgccgccaggtagagtagcaacggctcatctggctccgggacgaccaggactgggggagaactgaggtacgccttcaactgagtgagggcccattcagcctcctccgtccagataaacggcccagagcgtttgaggagcttaaataggggtagcgccttctctcccagcctcgatatgaaccgacttagggcggccatacagccagtgacgcattgcacatccctaagcttgctgggggggcgcatccgctctatagctcgtatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatccgagagtaaggtctcctggttgtgtgttttcacaaccaagtcatcaacataggcctcaacattacgtcctatttggctacccaaagaaattcgagtagtacgttgaaaagtaggacctgcattctttaacccgacaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcgccacccgcgggcttggatgccgcggcgaggtggtccgcgcgctgctccatgcaagcaagcgcgactttgaggtcgccatggacggtgatggggccaccggggcccggcatcttcatctggagataggcgtagtggaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggagaaaccaccatcgcgatctgtcctccccgggcaacgcacggtgggtggtcggtctggtcgaaggtgagggcaacctccgaccaccgtgcccgccgcgtcgcctcatgggtaggggccacggccagaagctctcgcttcatggccttgaggctccggtgagaagcgtgagcacacgctcccccatcaacggtggcgacggtggcctcaggctcctggaaccctaggtcatcgtcggcatcgttgatgtcctcggcgggggccttctgcttggcctcaccacgccggttgccggcgggagccgccggggtattgccctcacggcgctcctgcctcctctcctcctcccacttcctcgtccgctcagccaaacttttgaccgcgcggcagtccacgaggtcgtggagggaggtattgtgcacggtgcaccacctgccggtcgggcgctccctactgggagcgccggcctccttctttttgtcgctcgcaggcctcccctttcgggtggcccacaaagcgccctcgacggcgaggacgtgaccctcgtcgtcggaatgggccgacctcttcttcctcctcctgtcccgccaccctgaccgagcagcggatccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtgccgcacaccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacttgggcgcggatatgtgccttggaagttcatggtgaactgctggcacaaatcctcccaagagtggaccgacgcgggtggcaagttcattagccaaccccgcgcctgtcctttcagggccatggggaagaaattcgccatgaccctgtcgtcacccccggcggcctcgatcccaatcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacatggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttggaggcgttgacgagggaatggcggacgaacggcgggtagcggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgtcgggttggagtctctggatcagggatgacgggtgggtgacgcaggagtgcgcccgcagcctggagcgcgccctggggcgtgctgccatctccgtagacgaggagacgacgctccccgtctcgccgtccttctccatcgcccgcgtgcggcgaagtcgcggatctttcgacctcctcgagcgcctcctcccgcccaagacttcggcgagagagggacagtggagtacgagctcgacggcgcgggttctgctccccgtcttcaccgctagcgctcggagagagattgtgcgccactgcccgttcggccattgggctgagcgggagaagcttggcgcacacgaaagaggacgagggcttagaaaaacacacgcaccccctacctggcgcgccagatgacggagcgtggggctcctcactgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttccctttctttggtgggcaaggtcctccttttatatctcaagggatactacatgcaccacttctacctacctttcttctgggtggggacctaccctctcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagttcggcatgctacacgtctgcccttcttcatacaatgacttccttgcaatggttgcgatgaagcctggaatgtatctggccggggctgacatgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgtggcgtggggcgctcgtccaacccgcaataaacgcggttaggtgagcgccgctgtgctcacctaacccacacatgtggcgccaaacccacagggggtcggggccccccagccctcggggccgaaacgggagcggcccgacccctcggggagacagagggagggacggccacatcaccctcgggcccgaccccccccccccccccgagggggtctggccacgtgggtgactgcagctgccccaaacctctagtcaagatacccccggtcccatgtcaccgacaatccccatgtttctaattatatagttttaaaagtcacaccagttgctaccacttatgtcatctcctcctttacttgcttgctcgatctaccactatttctattcattctctttggaatttttaaaaattggatcttatagttttaaaagtttattgtcacgttgggtttcgtttttttaatttctatatgtcccgtcaaacgttgccattatactcctctatggcctgtccactatctcttctctttattatcattgagattttaaaaatcgaatataattatcgtttgggttcatttttacttctagaagtcctgccaaaccgttagcggctttgccattgtacttctctacagctcgctcgctgcctcacttttttattgtcattgagattttaaaatcgaacatgattatcattgttttttttttactttttagaagttccgaacctttaaaaattagggtttcattttttataatttttagaagtcccgtaaaatgatgccactatgcttctctatggcccgtccgccacctactctttattgtcattgtgattctagaaatcaaacataactatcgttggaatttatttttattttctagaagtcctgtcaaccgttggctgctctgcaactatactcctataaaccccgctcgttgcttctcctttttatagtcattgagattttaaaaatcgaatatgataatcaaatggggtttatttttttttactatctagaagtcctggcaaccgccttgctcgttttcttcatggcctgctggtcgtccctccttttaatcgtcattaggatctatttggtgttttatcaacagtttttatatgttgtatcaaccgtcaccactctactcttttataggtatgttacttaatttatctcgtcatgtgttttagatggtcttttctttcaatagtctttatttttatcacaaattttagttatttataaattttattcctaattgaaatcttatttttatttttccaattttagaatttatttttttttcaaattttaattaatatcatattgtgttcttttaatttttttatttttttattttcaatttcagttgtttcaaaattgtattcctagttgaactctcttttaatttttctaatttcagatattattttattttttattctgaattttcattaatcttgtattaggttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttttcaaattttgattaatctcgtattgggttcttacatggaaacttctttaaatattgcttatttttaattccgaatttcagctatttttaaattgtattttttacttagactctccttttttttctaattttggattttattttatttttatttcgaattttgattaatctcgtattgggttcttatatgaaaacttctttcaatattgcttattttaattcctaattttagctatttttaaattgtatttctacttgaactctccttttctttctttttcttttttccgattaatgtgagaatttctagctcccagagtgaacgcagtggctacttttaaagctgttttaataatataatagatagatagattcggcatattttaataaaaaacaagatactaaacatgacatgtgaataacaggaggatgatcaagtgatagtactaaacacaaacatgctaataacaagaataatatcatctagtaacatgttaacactaaagtgaatagagtgatatgcggagaacgctccggattcaaaggcgatggtgttggtgttgtcgctaccgttgccattggcgtctcctccattccattgctagtcgacgtagaggaagaccgttgctgttggcgtcttctcctccattgctgctcgacgtagaggaagaagaacctggcgtagaggaagcagtgtagagagcttattgtctatcggttccgctttctcataaaaacagaaaagacaagaaaacgagcggctggctcgccagccccgttgctccgctccgctaactcggcccggttggctcgactcggcgcacgagcgcgcggtggcagttcgaccaccatcttaaccgctcgacatgtgctctcatttagcaacttacttctcattggttccaaggtgggattaatcttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccaggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgccccca
